US012721888B2

(12) United States Patent
Gangaiah et al.

(10) Patent No.: US 12,721,888 B2
(45) Date of Patent: Sep. 1, 2026

(54) IMMUNOGENIC PROBIOTIC COMPOSITIONS AND METHODS OF USE INCLUDING IN VACCINATION

(71) Applicant: BiomEdit, Inc., Indianapolis, IN (US)

(72) Inventors: Dharanesh Mahimapura Gangaiah, Fishers, IN (US); Arvind Kumar, Fishers, IN (US); Nallakannu Pillay Lakshmanan, Fishers, IN (US); Shrinivasrao Mane, Fishers, IN (US)

(73) Assignee: BiomEdit, Inc., Fishers, IN (US)

( * ) Notice: Subject to any disclaimer, the term of this patent is extended or adjusted under 35 U.S.C. 154(b) by 480 days.

(21) Appl. No.: 18/036,259

(22) PCT Filed: Nov. 10, 2021

(86) PCT No.: PCT/US2021/058779
§ 371 (c)(1),
(2) Date: May 10, 2023

(87) PCT Pub. No.: WO2022/103837
PCT Pub. Date: May 19, 2022

(65) Prior Publication Data

US 2024/0058440 A1 Feb. 22, 2024

Related U.S. Application Data

(60) Provisional application No. 63/111,979, filed on Nov. 10, 2020.

(51) Int. Cl.

| | |
|---|---|
| ***A61K 39/07*** | (2006.01) |
| ***A61K 35/741*** | (2015.01) |
| ***A61K 35/747*** | (2015.01) |
| ***A61K 39/09*** | (2006.01) |
| ***A61K 39/12*** | (2006.01) |
| ***A61K 39/215*** | (2006.01) |
| ***A61K 39/245*** | (2006.01) |
| ***A61K 39/39*** | (2006.01) |
| *A61K 35/00* | (2006.01) |
| *A61K 39/00* | (2006.01) |

(52) U.S. Cl.
CPC ............ *A61K 39/39* (2013.01); *A61K 35/747* (2013.01); *A61K 39/12* (2013.01); *A61K 39/215* (2013.01); *A61K 2035/115* (2013.01); *A61K 2039/542* (2013.01)

(58) Field of Classification Search
None
See application file for complete search history.

(56) References Cited

FOREIGN PATENT DOCUMENTS

| | | | | | |
|---|---|---|---|---|---|
| CN | 105219683 | A | * | 1/2016 | |
| WO | 2001/021200 | A1 | | 3/2001 | |
| WO | 2006/124630 | A1 | | 11/2006 | |
| WO | WO-2006124630 | A2 | * | 11/2006 | ............. A61K 39/39 |
| WO | 2020/163284 | A1 | | 8/2020 | |
| WO | 2020/163398 | A1 | | 8/2020 | |

OTHER PUBLICATIONS

WP_003670646.1. aminotransferase [Limosilactobacillus reuteri]. Dated Oct. 11, 2019.*
Sundararaman et al. Role of probiotics to combat viral infections with emphasis on COVID-19. Applied Microbiology and Biotechnology (2020) 104:8089-8104. Published online: Aug. 19, 2020.*
Ogawa et al. Oral immunoadjuvant activity of *Lactobacillus casei* subsp. casei in dextran-fed layer chickens. British Journal of Nutrition (2006), 95, 430-434.*
Genbank: CP027805.1 Limosilactobacillus reuteri strain WHH1689 chromosome, complete genome. Dated Apr. 26, 2018.*

* cited by examiner

*Primary Examiner* — Nianxiang Zou
(74) *Attorney, Agent, or Firm* — Hoffmann & Baron LLP

(57) ABSTRACT

The present invention provides probiotic compositions and methods for improving animal health, particularly improving and enhancing vaccine response. The probiotic compositions include one or more isolated strains of *Lactobacillus* species bacteria which colonizes the gastrointestinal tract to increase the health and enhance the immune system and immune response of an animal.

31 Claims, 10 Drawing Sheets

Specification includes a Sequence Listing.

| | 1 | 2 | 3 | 4 | 5 | 6 | 7 | 8 | 9 | 10 | 11 | 12 | 13 |
|---|---|---|---|---|---|---|---|---|---|---|---|---|---|
| Vaccination | No | No | No | No | No | No | No | IBV | IBV | IBV | No | IBV | No |
| Probiotic Treatment | 3632 | 3630 | No | No | 3632 | 3632 and 3630 | 3632 and 3630 | 3632 and 3630 | No | No | Bacillus | Bacillus | Bacillus |
| Challenge | No | No | No | IBV M41 | IBV M41 | IBV M41 | IBV M41 | IBV M41 | IBV M41 | No | IBV M41 | IBV M41 | No |

IMMUNOGENIC PROBIOTIC COMPOSITIONS AND METHODS OF USE INCLUDING IN VACCINATION

CROSS REFERENCE TO RELATED APPLICATIONS

The present application is a national stage application which claims priority from PCT Application No. PCT/US2021/058779 filed Nov. 10, 2021, which in turn claims priority from U.S. Provisional Application Ser. No. 63/111,979 filed Nov. 10, 2020. Applicant claims the benefits of 35 U.S.C. § 120 as to the PCT application and priority under 35 U.S.C. § 119 as to the said U.S. Provisional application, and the entire disclosures of all applications are incorporated herein by reference in their entireties.

SEQUENCE LISTING

This application contains a Sequence Listing, which was submitted in ASCII format via EFS-Web, and is hereby incorporated by reference in its entirety. The ASCII copy, created on 9 Nov. 2021, is named "2848-20 PCT Seq-Listing_ST25" and is 6,468,762 bytes in size.

FIELD OF THE INVENTION

The present invention relates to probiotic compositions and methods for improving animal health, particularly improving and enhancing vaccine response. The probiotic compositions include one or more isolated strains of *Lactobacillus* bacteria which colonizes the gastrointestinal tract to increase the health and enhance the immune system and immune response of an animal.

BACKGROUND

Direct fed microbials (DFMs), often also called probiotics, are microorganisms which colonize, at least temporarily, the gastrointestinal tract of an animal and provide some beneficial effect to that animal. The microorganisms can be bacterial species, for example those from the genera *Bacillus, Lactobacillus, Lactococcus*, and *Enterococcus*. The microorganisms can also be yeast or even molds. The microorganisms can be provided to an animal orally or mucosally or, in the case of birds for instance, ocunasally i.e., spray, or provided to a fertilized egg, i.e. in ovo.

The beneficial activity provided by DFMS or probiotics can be the synthesis of vitamins or other nutritional molecules needed for a healthy metabolism of the host animal. A DFM or probiotic can also protect the host animal from disease, disorders, or clinical symptoms caused by other, pathogenic microorganisms. For example, the DFM or probiotic may produce factors having inhibitory or cytotoxic activity against certain species of pathogens, such as deleterious or disease-causing bacteria or immunomodulatory activity, such as improving or enhancing immune response to foreign agent(s) or foreign antigen, such as with vaccines or antigen administration.

Vaccines provide a useful tool to prevent the spread of infectious diseases or treat diseases. However, development of vaccines to provide sustained immunity to particular infectious diseases can be laborious and time consuming. Individuals that are immunodeficient or immunocompromised may have a reduced or ineffective/insufficient immune response to a vaccine or administered antigen. Furthermore, duration of immunity may not be sufficient to provide effective protection against these diseases. Many challenges remain in developing safer and more effective vaccines against the more complex diseases.

Thus, there is a need to develop further, more efficient, technologies for eliciting an efficient immune response.

SUMMARY OF THE INVENTION

The invention provides methods for stimulating an immune response, for vaccinating a subject for an infectious respiratory disease, for increasing antibody titer in a subject, including upon or with vaccination to said subject, for enhancing an immune response in a subject administered a vaccine, particularly an infectious respiratory virus vaccine, all and any of which include administration of an effective amount of an immunogenic probiotic composition comprising at least one *Lactobacillus reuteri* strain. In embodiments of the methods, a combination of two or at least two *Lactobacillus reuteri* strains are administered.

In one embodiment, the present disclosure provides a method of stimulating an immune response in a subject. In one embodiment, the present disclosure provides a method of enhancing, increasing or improving an immune response in a subject. The method includes administering an effective amount of an immunogenic probiotic composition comprising at least one *Lactobacillus reuteri* strain. In an embodiment, the method includes administering an effective amount of an immunogenic probiotic composition comprising at least one *Lactobacillus reuteri* strain wherein the at least one *Lactobacillus reuteri* strain comprises at least one sequence selected from SEQ ID NO:1-55 and sequences having at least 98%, at least 98.5%, at least 99%, or at least 99.5% sequence identity with at least one of SEQ ID NO:1-55. In an embodiment, the method comprises administering an effective amount of an immunogenic probiotic composition comprising at least one *Lactobacillus reuteri* strain, and optionally, an infectious disease vaccine, particularly an infectious respiratory disease vaccine, to a subject.

In one embodiment, the present disclosure provides a method of vaccinating a subject for an infectious respiratory disease. The method includes administering an effective amount of an immunogenic probiotic composition comprising at least one *Lactobacillus reuteri* strain and wherein the at least one *Lactobacillus reuteri* strain comprises at least one sequence selected from SEQ ID NO:1-55 and sequences having at least 98%, at least 98.5%, at least 99%, or at least 99.5% sequence identity with at least one of SEQ ID NO:1-55, and an infectious respiratory disease vaccine to a subject.

In an embodiment of the method(s), a combination of two isolated *Lactobacillus reuteri* strains are administered. In embodiments, an infectious respiratory disease vaccine is administered in combination with the at least one *Lactobacillus reuteri* strain or with the two isolated *Lactobacillus reuteri* strains. The at least one or the two *Lactobacillus reuteri* strains may be administered prior to a vaccine; may be administered prior to and in conjunction with a vaccine; may be administered prior to, in conjunction with, and following a vaccine; or may be administered in combination with or shortly following a vaccine. A vaccine may be administered as a single dose or multiple doses. The at least one or the two *Lactobacillus reuteri* strains may be administered prior to and/or between and/or in combination with a vaccine dose or multiple vaccine doses.

In an embodiment of the method(s) of the invention, a combination of two isolated *Lactobacillus reuteri* strains includes or comprises or is a combination of a first isolated

*Lactobacillus reuteri* strain and a second isolated *Lactobacillus reuteri* strain. In one embodiment, the isolated first *Lactobacillus reuteri* strain includes at least one of: a nucleic acid sequence having at least 95%, at least 96%, at least 97%, at least 98%, or at least 99% sequence identity with SEQ ID NO:26, a nucleic acid sequence having at least 95%, at least 96%, at least 97%, at least 98%, or at least 99% sequence identity with SEQ ID NO: 1, a nucleic acid sequence having at least 95%, at least 96%, at least 97%, at least 98%, or at least 99% sequence identity with SEQ ID NO: 3, and a nucleic acid that encodes for an amino acid sequence having at least 95%, at least 96%, at least 97%, at least 98%, or at least 99% sequence identity with SEQ ID NO: 8.

In one embodiment, the second isolated second *Lactobacillus reuteri* strain includes at least one of: a nucleic acid sequence having at least 95%, at least 96%, at least 97%, at least 98%, or at least 99% sequence identity with SEQ ID NO:25, a nucleic acid sequence having at least 95%, at least 96%, at least 97%, at least 98%, or at least 99% sequence identity with SEQ ID NO: 27, a nucleic acid sequence having at least 95%, at least 96%, at least 97%, at least 98%, or at least 99% sequence identity with SEQ ID NO: 28, and a nucleic acid sequence having at least 95%, at least 96%, at least 97%, at least 98%, or at least 99% sequence identity with SEQ ID NO: 29.

In one embodiment, the isolated first *Lactobacillus reuteri* strain has a nucleic acid or amino acid sequence including at least one of SEQ ID NOs: 1-24, 26, and 49-55, sequences having at least one nucleic acid or amino acid sequence difference from the sequence of at least one of SEQ ID NOs: 1-24, 26, and 49-55, sequences having one or more nucleic acid or amino acid sequence difference from the sequence of at least one of SEQ ID NOs: 1-24, 26, and 49-55, sequences having at least one nucleic acid or amino acid sequence difference from the sequence of at least one of SEQ ID NOs: 1-24, 26, and 49-55 and further having at least 99% sequence identity with at least one of SEQ ID NOs: 1-24, 26, and 49-55, sequences having at least one nucleic acid or amino acid sequence difference from the sequence of at least one of SEQ ID NOs: 1-24, 26, and 49-55 and further having at least 99% sequence identity with one or more of SEQ ID NOs: 1-24, 26, and 49-55, sequences having at least 98%, at least 98.5%, at least 99%, or at least 99.5% sequence identity with at least one of SEQ ID NOs: 1-24, 26, and 49-55. In one embodiment, the isolated first *Lactobacillus reuteri* strain has a genomic nucleic acid sequence including at least one of SEQ ID NOs: 49-55, sequences having one or more nucleic acid sequence difference from the sequence of at least one of SEQ ID NOs: 49-55, sequences having at least one nucleic acid sequence difference from the sequence of at least one of SEQ ID NOs: 49-55 and further having at least 97%, at least 98%, at least 99% or at least 99.5% sequence identity with one or more of SEQ ID NOs: 49-55, sequences having at least 98%, at least 98.5%, at least 99%, or at least 99.5% sequence identity to SEQ ID NOs: 49-55.

In an embodiment, the isolated first *Lactobacillus reuteri* strain is *Lactobacillus reuteri* strain 3632, which corresponds to ATCC Patent Deposit Number PTA-126788.

In one embodiment, the isolated first *Lactobacillus reuteri* strain comprises or has a genomic nucleic acid sequence corresponding to the genomic nucleic acid sequence of ATCC strain PTA-126788, or a variant thereof comprising or having a nucleic acid sequence at least 98%, at least 98.5%, at least 99%, or at least 99.5% sequence identity to the genomic nucleic acid sequence of ATCC strain PTA-126788.

In some embodiments, the isolated second *Lactobacillus reuteri* strain has a nucleic acid sequence or amino acid sequence including at least one of SEQ ID NOs: 25, 27-43, and 44-48, sequences having at least 98%, at least 98.5%, at least 99%, or at least 99.5% sequence identity with at least one of SEQ ID NOs: 25, 27-43, and 44-48.

In one embodiment, the isolated second *Lactobacillus reuteri* has a nucleic acid or amino acid sequence including at least one of SEQ ID NOs: 25, 27-43, and 44-48, sequences having at least one nucleic acid or amino acid sequence difference from the sequence of at least one of SEQ ID NOs: 25, 27-43, and 44-48, sequences having one or more nucleic acid or amino acid sequence difference from the sequence of at least one of SEQ ID NOs: 25, 27-43, and 44-48, sequences having at least one nucleic acid or amino acid sequence difference from the sequence of at least one of SEQ ID NOs: 25, 27-43, and 44-48 and further having at least 99% sequence identity with at least one of SEQ ID NOs: 25, 27-43, and 44-48, sequences having at least one nucleic acid or amino acid sequence difference from the sequence of at least one of SEQ ID NOs: 25, 27-43, and 44-48 and further having at least 99% sequence identity with one or more of SEQ ID NOs: 25, 27-43, and 44-48, sequences having at least 98%, at least 98.5%, at least 99%, or at least 99.5% sequence identity with at least one of SEQ ID NOs: 25, 27-43, and 44-48. In one embodiment, the isolated second *Lactobacillus reuteri* strain has a genomic nucleic acid sequence including at least one of SEQ ID NOs: 44-48, sequences having one or more nucleic acid sequence difference from the sequence of at least one of SEQ ID NOs: 44-48, sequences having at least one nucleic acid sequence difference from the sequence of at least one of SEQ ID NOs: 44-48 and further having at least 97%, at least 98%, at least 99% or at least 99.5% sequence identity with one or more of SEQ ID NOs: 44-48, sequences having at least 98%, at least 98.5%, at least 99%, or at least 99.5% sequence identity to SEQ ID NOs: 44-48.

In an embodiment, the second *Lactobacillus reuteri* is *Lactobacillus reuteri* strain 3630, which corresponds to ATCC Patent Deposit Number PTA-126787.

In one embodiment, the isolated second *Lactobacillus reuteri* strain comprises or has a genomic nucleic acid sequence corresponding to the genomic nucleic acid sequence of ATCC strain PTA-126787, or a variant thereof comprising or having a nucleic acid sequence at least 98%, at least 98.5%, at least 99%, or at least 99.5% sequence identity to the genomic nucleic acid sequence of ATCC strain PTA-126787.

In one embodiment, the present disclosure provides a method of increasing antibody titer in a subject. The method includes administering an effective amount of an immunogenic probiotic composition comprising at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO: 1-55, and an infectious respiratory disease vaccine to a subject. The method includes administering an effective amount of an immunogenic probiotic composition comprising two isolated *Lactobacillus reuteri* strains, a first *Lactobacillus reuteri* strain and a second *Lactobacillus reuteri* strain, wherein the first *Lactobacillus reuteri* strain comprises at least one sequence selected from SEQ ID NO: 1-24, 26, and 49-55 and sequences having at least 98%, at least 98.5%, at least 99%, or at least 99.5% sequence identity with at least one of SEQ ID NO: 1-24, 26, and 49-55, wherein the second

*Lactobacillus reuteri* strain comprises at least one sequence selected from SEQ ID NO: 25, 27-43, and 44-48 and sequences having at least 98%, at least 98.5%, at least 99%, or at least 99.5% sequence identity with at least one of SEQ ID NO: 25, 27-43, and 44-48 and an infectious respiratory disease vaccine to a subject.

In one embodiment, the present disclosure provides a method of decreasing viral load in a subject. The method includes administering an effective amount of an immunogenic probiotic composition comprising at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO: 1-55, and optionally, an infectious respiratory disease vaccine to a subject. The method includes administering an effective amount of an immunogenic probiotic composition comprising two isolated *Lactobacillus reuteri* strains, a first *Lactobacillus reuteri* strain and a second *Lactobacillus reuteri* strain, wherein the first *Lactobacillus reuteri* strain comprises at least one sequence selected from SEQ ID NO: 1-24, 26, and 49-55 and sequences having at least 98%, at least 98.5%, at least 99%, or at least 99.5% sequence identity with at least one of SEQ ID NO: 1-24, 26, and 49-55, wherein the second *Lactobacillus reuteri* strain comprises at least one sequence selected from SEQ ID NO: 25, 27-43, and 44-48 and sequences having at least 98%, at least 98.5%, at least 99%, or at least 99.5% sequence identity with at least one of SEQ ID NO: 25, 27-43, and 44-48 and an infectious respiratory disease vaccine to a subject.

In one embodiment, the present disclosure provides a method of stimulating an immune response in a subject. The method includes administering an effective amount of an immunogenic probiotic composition comprising at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity thereto, and optionally, an infectious respiratory disease vaccine to a subject. The method includes administering an effective amount of an immunogenic probiotic composition comprising two isolated *Lactobacillus reuteri* strains, a first *Lactobacillus reuteri* strain and a second *Lactobacillus reuteri* strain, wherein the first *Lactobacillus reuteri* strain comprises at least one sequence selected from SEQ ID NO: 1-24, 26, and 49-55 and sequences having at least 98%, at least 98.5%, at least 99%, or at least 99.5% sequence identity with at least one of SEQ ID NO: 1-24, 26, and 49-55, wherein the second *Lactobacillus reuteri* strain comprises at least one sequence selected from SEQ ID NO: 25, 27-43, and 44-48 and sequences having at least 98%, at least 98.5%, at least 99%, or at least 99.5% sequence identity with at least one of SEQ ID NO: 25, 27-43, and 44-48 and an infectious respiratory disease vaccine to a subject.

In one embodiment, the present disclosure provides an immunogenic probiotic composition. The composition includes at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO: 1-55, and a pharmaceutically acceptable carrier. In an embodiment, the immunogenic probiotic composition comprises two isolated *Lactobacillus reuteri* strains, a first *Lactobacillus reuteri* strain and a second *Lactobacillus reuteri* strain, wherein the first *Lactobacillus reuteri* strain comprises at least one sequence selected from SEQ ID NO: 1-24, 26, and 49-55 and sequences having at least 98%, at least 98.5%, at least 99%, or at least 99.5% sequence identity with at least one of SEQ ID NO: 1-24, 26, and 49-55, wherein the second *Lactobacillus reuteri* strain comprises at least one sequence selected from SEQ ID NO: 25, 27-43, and 44-48 and sequences having at least 98%, at least 98.5%, at least 99%, or at least 99.5% sequence identity with at least one of SEQ ID NO: 25, 27-43, and 44-48.

DETAILED DESCRIPTION

Figure 1:
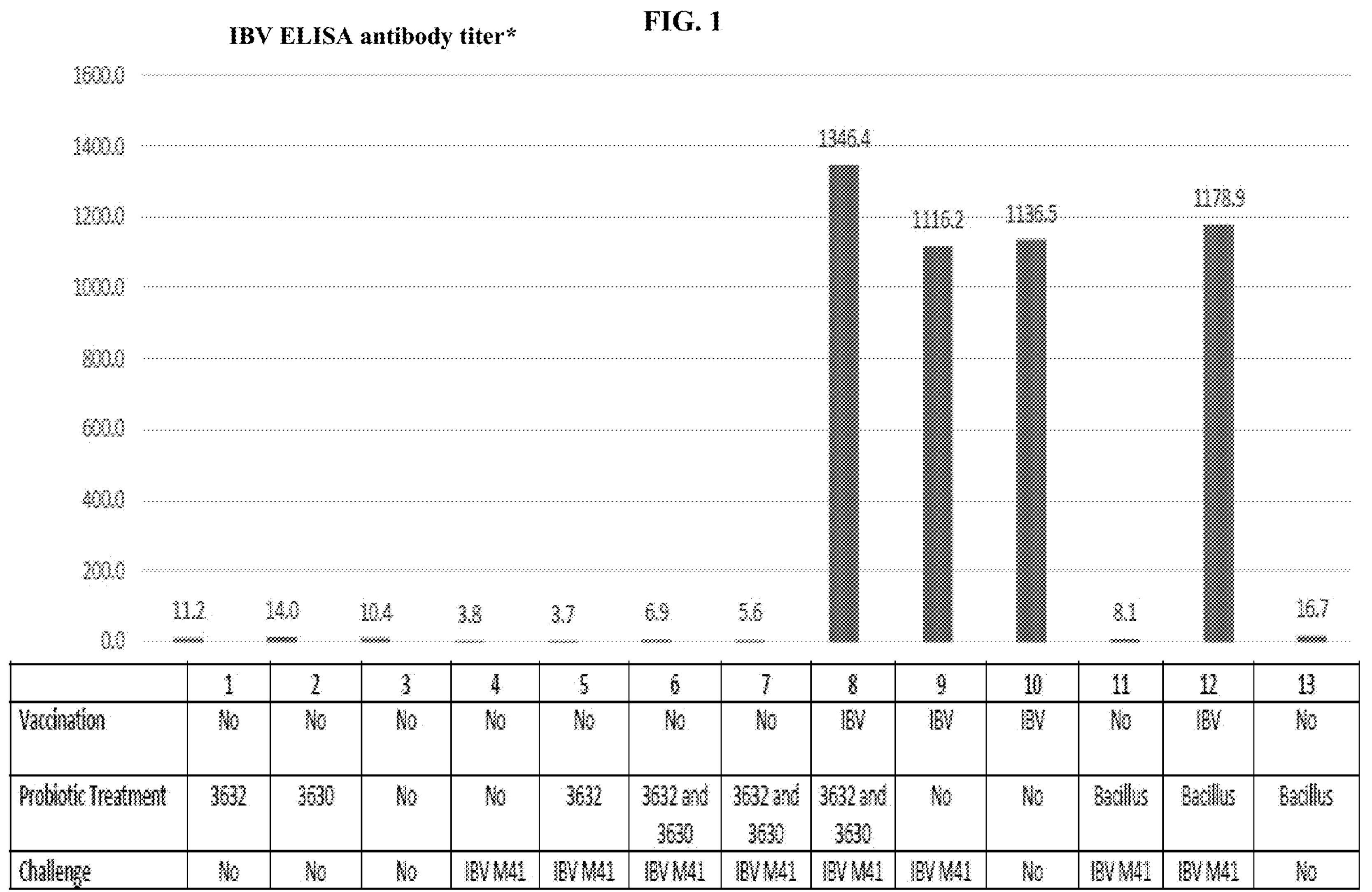
FIG. 1 depicts the effect of *Lactobacillus reuteri* cells on infectious bronchitis vaccine serology. Blood samples were collected for serology on Study day 24. Approximately 20% increase in antibody titer is observed when 3630 and 3630 are administered.

The present disclosure provides immunogenic probiotic compositions and methods of use.

In one embodiment, the invention provides an immunogenic probiotic composition including at least one isolated *Lactobacillus reuteri* strain. The at least one *Lactobacillus reuteri* strain includes at least one of a isolated first *Lactobacillus reuteri* strain and a isolated second *Lactobacillus reuteri* strain.

The at least one isolated *Lactobacillus reuteri* strain may include one *Lactobacillus reuteri* strain or a combination of two or more *Lactobacillus reuteri* strains. The *Lactobacillus reuteri* strains may have been selected for gut adaptation in poultry. The *Lactobacillus reuteri* strains may be been isolated from poultry.

In one embodiment, the isolated first *Lactobacillus reuteri* has a nucleic acid or amino acid sequence including at least one of SEQ ID NOs: 1-24, 26, and 49-55, sequences having at least 98%, at least 98.5%, at least 99%, or at least 99.5% sequence identity with at least one of SEQ ID NOs: 1-24, 26, and 49-55. In one embodiment, the isolated first *Lactobacillus reuteri* has a nucleic acid genome sequence including at least one of SEQ ID NOs: 49-55, sequences having at least 98%, at least 98.5%, at least 99%, or at least 99.5% sequence identity with at least one of SEQ ID NOs: 49-55. In one embodiment, the isolated first *Lactobacillus reuteri* strain has a nucleic acid genome sequence comprising SEQ ID NOs: 49-55, or a sequence having at least 98%, at least 98.5%, at least 99%, or at least 99.5% sequence identity with SEQ ID NOs: 49-55.

In one embodiment, the isolated first *Lactobacillus reuteri* has a nucleic acid or amino acid sequence including at least one of SEQ ID NOs: 1-24, 26, and 49-55, sequences having at least one nucleic acid or amino acid sequence difference from the sequence of at least one of SEQ ID NOs: 1-24, 26, and 49-55, sequences having one or more nucleic acid or amino acid sequence difference from the sequence of at least one of SEQ ID NOs: 1-24, 26, and 49-55, sequences having at least one nucleic acid or amino acid sequence difference from the sequence of at least one of SEQ ID NOs: 1-24, 26, and 49-55 and further having at least 99% sequence identity with at least one of SEQ ID NOs: 1-24, 26, and 49-55, sequences having at least one nucleic acid or amino acid sequence difference from the sequence of at least one of SEQ ID NOs: 1-24, 26, and 49-55 and further having at least 99% sequence identity with one or more of SEQ ID NOs: 1-24, 26, and 49-55, sequences having at least 98%, at least 98.5%, at least 99%, or at least 99.5% sequence identity with at least one of SEQ ID NOs: 1-24, 26, and 49-55.

In a preferred embodiment, the isolated first *Lactobacillus reuteri* strain is *Lactobacillus reuteri* strain 3632. As used herein, "*Lactobacillus reuteri* strain 3632", "LR 3632", and "3632" "ATCC Patent Deposit Number PTA-126788", "strain PTA-126788", V and "PTA-126788" may be used interchangeably.

In some embodiments, the isolated second *Lactobacillus reuteri* strain has a nucleic acid sequence or amino acid sequence including at least one of SEQ ID NOs: 25, 27-43, and 44-48, sequences having at least 98%, at least 98.5%, at least 99%, or at least 99.5% sequence identity with at least one of SEQ ID NOs: 25, 27-43, and 44-48. In embodiments, the isolated second *Lactobacillus reuteri* strain has a nucleic acid genome sequence comprising SEQ ID NOs: 44-48, or a sequence having at least 98%, at least 98.5%, at least 99%, or at least 99.5% sequence identity with SEQ ID NOs: 44-48.

In one embodiment, the isolated second *Lactobacillus reuteri* has a nucleic acid or amino acid sequence including at least one of SEQ ID NOs: 25, 27-43, and 44-48, sequences having at least one nucleic acid or amino acid sequence difference from the sequence of at least one of SEQ ID NOs: 25, 27-43, and 44-48, sequences having one or more nucleic acid or amino acid sequence difference from the sequence of at least one of SEQ ID NOs: 25, 27-43, and 44-48, sequences having at least one nucleic acid or amino acid sequence difference from the sequence of at least one of SEQ ID NOs: 25, 27-43, and 44-48 and further having at least 99% sequence identity with at least one of SEQ ID NOs: 25, 27-43, and 44-48, sequences having at least one nucleic acid or amino acid sequence difference from the sequence of at least one of SEQ ID NOs: 25, 27-43, and 44-48 and further having at least 99% sequence identity with one or more of SEQ ID NOs: 25, 27-43, and 44-48, sequences having at least 98%, at least 98.5%, at least 99%, or at least 99.5% sequence identity with at least one of SEQ ID NOs: 25, 27-43, and 44-48.

In a preferred embodiment, the second *Lactobacillus reuteri* is *Lactobacillus reuteri* strain 3630. As used herein, "*Lactobacillus reuteri* strain 3630", "LR 3630", "3630", "ATCC Patent Deposit Number PTA-126787", "strain PTA-126787" and "PTA-126787" may be used interchangeably.

In a preferred embodiment, the at least one isolated *Lactobacillus reuteri* strain includes strain 3632 and 3630.

In an embodiment, the at least one isolated *Lactobacillus reuteri* strain is a combination of *Lactobacillus reuteri* strain 3632 and strain 3630. In an embodiment, a combination of two or more *Lactobacillus reuteri* strains is a combination of strain 3632 and strain 3630. In an embodiment, a combination of two or more *Lactobacillus reuteri* strains is a combination of strain PTA-126788 and PTA-126787.

In an embodiment, the isolated strains of the present disclosure are not genetically modified by recombinant or genetically engineered means.

In a preferred embodiment, the at least one isolated *Lactobacillus reuteri* strain is selected from strain 3632 and 3630. In a preferred embodiment, the composition, particularly an immunogenic probiotic composition, comprises a combination of isolated *Lactobacillus reuteri* strains 3632 and 3630. In a preferred embodiment, the composition, particularly an immunogenic probiotic composition, comprises a combination of isolated *Lactobacillus* strains PTA-126788 and PTA-126787. In a preferred embodiment, the composition, particularly an immunogenic probiotic composition, comprises a combination of isolated *Lactobacillus* strains PTA-126788 and PTA-126787 or a *lactobacillus* strain having at least 98% or 99% amino acid or nucleic acid identity to strain PTA-126788 and isolated *Lactobacillus* strain PTA-126788 and PTA-126787 or a *lactobacillus* strain having at least 99% amino acid or nucleic acid identity to strain PTA-126787. In a preferred embodiment, the composition, particularly an immunogenic probiotic composition, comprises a combination of isolated *Lactobacillus* strains PTA-126788 and PTA-126787 or a *lactobacillus* strain having at least 98% or at least 99% amino acid or nucleic acid identity to strain PTA-126788 and isolated *Lactobacillus* strains PTA-126788 and PTA-126787 or a *lactobacillus* strain having at least 98% or at least 99% amino acid or nucleic acid identity to strain PTA-126787, wherein the strains each and/or together have probiotic activity or capability. In a preferred embodiment, the composition, particularly an immunogenic probiotic composition, comprises a combination of isolated *Lactobacillus* strains PTA-126788 and PTA-126787 or a *lactobacillus* strain having at least 98% or at least 99% amino acid or nucleic acid identity to strain PTA-126788 and isolated *Lactobacillus* strains PTA-126788 and PTA-126787 or a *lactobacillus* strain having at least 98% or at least 99% amino acid or nucleic acid identity to strain PTA-126787, wherein the strains each and/or together have immunogenic probiotic activity or capability and capability and activity to improve animal health.

In some embodiments, compositions disclosed herein include an isolated first *Lactobacillus reuteri* strain and an isolated second *Lactobacillus reuteri* strain at a ratio of approximately 0.75-1.5:1. In a preferred embodiment, the composition includes about equal amounts of the isolated first *Lactobacillus reuteri* strain and the isolated second *Lactobacillus reuteri* strain, or approximately 1:1.

In an embodiment, the composition includes about equal amounts, such as equal amounts measured as CFU/kg or CFU/ml of the composition, of the isolated first *Lactobacillus reuteri* strain and the isolated second *Lactobacillus reuteri* strain, or approximately 1:1.

The compositions disclosed herein can be formulated as animal feed, feed additive, food ingredient, vaccine additive or ingredient, water additive, water-mixed additive, consumable solution, consumable spray additive, consumable solid, consumable gel, injection, or combinations thereof. In one embodiment, the composition includes water.

In some embodiments, the compositions disclosed herein includes the isolated first *Lactobacillus reuteri* strain in an amount of about $10^2$-$10^8$ CFU/kg of the composition, about $10^6$-$10^8$ CFU/kg of the composition, about $10^4$-$10^7$ CFU/kg of the composition, about $10^3$-$10^5$ CFU/kg of the composition, about $10^2$ CFU/kg of the composition, about $10^3$ CFU/kg of the composition, about $10^6$ CFU/kg of the composition, about $10^7$ CFU/kg of the composition, or about $10^8$ CFU/kg of the composition. In some embodiments, the compositions disclosed herein includes the isolated first *Lactobacillus reuteri* strain in an amount of about $10^2$-$10^8$ CFU/ml of the composition, about $10^6$-$10^8$ CFU/ml of the composition, about $10^4$-$10^7$ CFU/ml of the composition, about $10^3$-$10^5$ CFU/ml of the composition, about $10^3$ CFU/ml of the composition, about $10^4$ CFU/ml of the composition, about $10^5$ CFU/ml of the composition, about $10^6$ CFU/ml of the composition, about $10^7$ CFU/ml of the composition, or about $10^8$ CFU/ml of the composition.

In some embodiments, the compositions disclosed herein includes the isolated second *Lactobacillus reuteri* strain in an amount of about $10^2$-$10^8$ CFU/kg of the composition, about $10^6$-$10^8$ CFU/kg of the composition, about $10^4$-$10^7$ CFU/kg of the composition, about $10^3$-$10^5$ CFU/kg of the composition, about $10^2$ CFU/kg of the composition, about $10^3$ CFU/kg of the composition, about $10^6$ CFU/kg of the composition, about $10^7$ CFU/kg of the composition, or about $10^8$ CFU/kg of the composition. In some embodiments, the compositions disclosed herein includes the isolated second *Lactobacillus reuteri* strain in an amount of about $10^2$-$10^8$ CFU/ml of the composition, about $10^6$-$10^8$ CFU/ml of the composition, about $10^4$-$10^7$ CFU/ml of the composition, about $10^3$-$10^5$ CFU/ml of the composition, about 10 CFU/ml of the composition, about $10^4$ CFU/ml of the composition, about $10^5$ CFU/ml of the composition, about $10^6$ CFU/ml of the composition, about $10^7$ CFU/ml of the composition, or about $10^8$ CFU/ml of the composition.

In some embodiments, the immunogenic probiotic composition includes at least one *Lactobacillus reuteri* strain and an infectious disease vaccine. In some embodiments, the immunogenic probiotic composition includes at least one *Lactobacillus reuteri* strain and an infectious respiratory disease vaccine. In some embodiments, the immunogenic probiotic composition includes at least one *Lactobacillus reuteri* strain and an infectious respiratory virus vaccine.

In some embodiments, the immunogenic probiotic composition includes at least one *Lactobacillus reuteri* strain and does not include an infectious respiratory disease vaccine. The present disclosure also provides methods of increasing animal health, wherein the method includes administering an effective amount of the composition to an animal.

The composition disclosed herein and above increases animal health by providing positive health benefits when administered to an animal, as compared to an animal that has not been administered the composition. As used herein, "animal" includes bird, a human, or a non-human mammal. Specific examples of birds include poultry such as chickens or turkey. Specific examples of animal include chickens, turkey, dogs, cats, cattle and swine. The chicken may be a broiler chicken or egg-laying or egg-producing chicken. The animal may be a human. The animal may be a non-human mammal.

Positive health benefits include decreasing feed conversion ratio, increasing weight, increasing lean body mass, decreasing pathogen-associated lesion formation in the gastrointestinal tract, decreasing colonization of pathogens, reducing inflammation, and decreasing mortality rate. Positive immunogenic health benefits include increasing seroconversion in animals administered a vaccine, increasing antibody titer(s) against a pathogen in animals administered a vaccine against the pathogen, reducing viral load of a virus in an animal, enhancing or increasing the reduction of viral load in an animal immunized with a vaccine against the virus, improving resistance against a virus, reducing colonization of a virus present in a herd or flock or group of animals where some animals are vaccinated against the virus, reduction of virus mediated lesions in an animal with vaccination against the virus or in an animal subjected to or exposed to the virus, reducing fecal load of virus in an animal, reducing viral shedding in feces of an animal and decreasing mortality rate on exposure to a virus.

In some embodiments, the compositions disclosed herein decreases feed conversion ratio by at least 1%, at least 5%, at least 25%, or at least 50%. In some embodiments, the compositions disclosed herein increases poultry weight by at least 1%, at least 5%, at least 25%, or at least 50%. In some embodiments, the compositions disclosed herein decrease pathogen-associated lesion formation in the gastrointestinal tract by at least 1%, at least 5%, at least 25%, or at least 50%. In some embodiments, the compositions disclosed herein decrease pathogen colonization by at least 1%, at least 5%, at least 25%, or at least 50%. In some embodiments, the compositions disclosed herein reduce inflammation by at least 1%, at least 5%, at least 25%, or at least 50%. In some embodiments, the compositions disclosed herein decrease mortality rate by at least 1%, at least 5%, at least 25%, or at least 50%.

In some embodiments, the compositions disclosed herein increased seroconversion with vaccine administration by at least 1%, at least 5%, at least 10%, at last 20%, at least 25%, or at least 50%. In some embodiments, the compositions disclosed herein increased virus specific antibody levels with vaccine administration by at least 5%, at least 10%, at last 20%, at least 25%, at least 50%, at least 60%, up to 100%. In some embodiments, the compositions disclosed herein reduced virus shedding in feces by at least 10 fold, at least 20 fold, at least 50 fold, at last 100 fold, at least 200 fold, over 100 fold, or over 200 fold.

In some embodiments, following values may be combined in any manner to create a minima, a maxima, or a range for decreasing feed conversion ratio, increasing poultry weight, increasing lean body mass, decreasing pathogen-associated lesion formation in the gastrointestinal tract, decreasing colonization of pathogens, and decreasing mortality rate, 1%, 5%, 25%, 50%, and 75%.

For example, the decrease in pathogen-associated lesion formation may be decreased by approximately 1% to 5%, and more preferably between approximately 5% to 50%.

In an embodiment, the composition of the inventions can be used as an immune modulator, an immunostimulant or an adjuvant. The composition of one or more *L reuteri* strain may be combined with one or more other or alternative immune modulator, immunostimulant or adjuvant. Immune modulators or immune stimulants may include cytokines or hormones which stimulate the immune response. An adjuvant may include, but is not limited to, complete Freund's adjuvant, incomplete Freund's adjuvant, saponin, mineral gels such as aluminum hydroxide, surface active substances such as lysolecithin, pluronic polyols, polyanions, peptides, oil or hydrocarbon emulsions, keyhole limpet hemocyanins, dinitrophenol, and potentially useful human adjuvant such as BCG (bacille Calmette-Guerin) and *Corynebacterium parvum*. Mineral salt adjuvants include but are not limited to: aluminum hydroxide, aluminum phosphate, calcium phosphate, zinc hydroxide and calcium hydroxide.

As used herein, a bacterial pathogen includes *Salmonella, Clostridium, Campylobacter, Staphylococcus, Streptococcus*, and *E. coli* bacterium. Further examples of pathogens include *Salmonella typhimurium, Salmonella infantis, Salmonella* Hadar, *Salmonella enteritidis, Salmonella* Newport, *Salmonella* Kentucky, *Clostridium perfringens, Staphylococcus aureus, Streptococcus uberis, Streptococcus suis, Escherichia coli, Campylobacter jejuni*, and *Fusobacterium necrophorum*.

As used herein a viral pathogen includes an infectious respiratory virus. Infectious respiratory viruses relevant to different animals are known and recognized in the art. Chickens (or poultry) are susceptible to respiratory viruses including Newcastle disease virus (NDV), avian influenza virus, infectious bronchitis virus (avian coronavirus), infectious laryngotracheitis virus, avian pneumovirus, adenoviruses, reoviruses. Swine (or pigs) are susceptible to porcine reproductive an respiratory syndrome virus (PRRSV), swine influenza virus (SIV), pseudorabies virus (PRV), as well as porcine respiratory coronavirus (PRCV), porcine cytomegalovirus (PCMV), porcine paramyxovirus (PPMV), hemagglutinating encephalomyelitis virus (HEV), encephalomyocarditis virus, porcine parvovirus, porcine adenovirus, porcine enterovirus. Cattle are susceptible to type I bovine herpesvirus (infectious bovine rhinotracheitis virus), parainfluenzavirus Type 3, bovine respiratory syncytial virus (BRSV), bovine viral diarrhea virus (BVDV), bovine adenovirus, bovine coronavirus. Humans are susceptible to respiratory syncytial virus (RSV), parainfluenza viruses, adenoviruses, influenza viruses, human coronaviruses (such as SARSCoV and the recent SARSCoV-2 (COVID-19)).

The compositions may be administered orally, parentally, nasally, or mucosally. Parental administration includes subcutaneous, intramuscular and intravenous administration.

In some aspects, administration includes feeding the poultry, or spraying onto the poultry. In other aspects, administration includes on ovo administration or in ovo administration. In an embodiment, administered comprises in ovo administration. In an embodiment, administered comprises spray administration. In an embodiment, administered comprises immersion, intranasal, intramammary, topical, or inhalation.

In an embodiment, administered comprises administration of a vaccine. In an embodiment, the animal is administered a vaccine prior to the administration of the composition. In an embodiment, the animal is poultry and the poultry is administered a vaccine prior to the administration of the composition. In an embodiment, the animal is swine and the swine is administered a vaccine prior to the administration of the composition. In an embodiment, the animal is administered a vaccine concurrently with the administration of the composition. In an embodiment, the animal is poultry and the poultry is administered a vaccine concurrently with the administration of the composition. In an embodiment, the animal is poultry and the poultry is administered a vaccine, wherein said vaccine comprises a vaccine that aids in the prevention of coccidiosis. In an embodiment, the animal is swine and the swine is administered a vaccine concurrently with the administration of the composition.

In aspects the animal is vaccinated in conjunction with administration. The animal may be vaccinated prior to administration of the compositions disclosed herein. The animal may be vaccinated with an coccidiosis vaccine. Coccidiosis vaccines are known in the art, for example, COCCIVAC.

In some embodiments, administration is by way of injection or infusion. In one embodiment, the composition is administered to a cow by way of intra-mammary infusion.

In an embodiment of the method(s), the method does not comprise administration of an antibiotic.

In some embodiments, the compositions or combinations may additionally include one or more prebiotic. In some embodiments, the compositions may be administered along with or may be coadministered with one or more prebiotic. Prebiotics may include organic acids or non-digestible feed ingredients that are fermented in the lower gut and may serve to select for beneficial bacteria. Prebiotics may include mannan-oligosaccharides, fructo-oligosaccharides, galacto-oligosaccharides, chito-oligosaccharides, isomalto-oligosaccharides, pectic-oligosaccharides, xylo-oligosaccharides, and lactose-oligosaccharides.

The compositions may further include one or more component or additive. The one or more component or additive may be a component or additive to facilitate administration, for example by way of a stabilizer or vehicle, or by way of an additive to enable administration to an animal such as by any suitable administrative means, including in aerosol or spray form, in water, in feed or in an injectable form. Administration to an animal may be by any known or standard technique. These include oral ingestion, gastric intubation, or broncho-nasal spraying. The compositions disclosed herein may be administered by immersion, intranasal, intramammary, topical, mucosally, or inhalation. When the animal is a bird the treatment may be administered in ovo or by spray inhalation.

Compositions may include a carrier in which the bacterium or any such other components is suspended or dissolved. Such carrier(s) may be any solvent or solid or encapsulated in a material that is non-toxic to the inoculated animal and compatible with the organism. Suitable pharmaceutical carriers include liquid carriers, such as normal saline and other non-toxic salts at or near physiological concentrations, and solid carriers, such as talc or sucrose and which can also be incorporated into feed for farm animals. When used for administering via the bronchial tubes, the composition is preferably presented in the form of an aerosol. A dye may be added to the compositions hereof, including to facilitate chacking or confirming whether an animal has ingested or breathed in the composition.

When administering to animals, including farm animals, administration may include orally or by injection. Oral administration can include by bolus, tablet or paste, or as a powder or solution in feed or drinking water. The method of administration will often depend on the species being feed or administered, the numbers of animals being fed or administered, and other factors such as the handling facilities available and the risk of stress for the animal.

The dosages required will vary and need be an amount sufficient to induce an immune response or to effect a biological or phenotypic change or response expected or desired. Routine experimentation will establish the required amount. Increasing amounts or multiple dosages may be implemented and used as needed.

The strains disclosed herein demonstrate certain phenotypic properties. Without wishing to be bound by theory, it is believed that these phenotypic properties at least contribute to increasing animal health.

In some embodiments, the isolated strains secrete at least one of cyclic dipeptides (cyclo(his-phe) and cyclo (phe-pro), short chain fatty acids (2-hydroxy-3-methylvalerate and alpha-hydroxyisocaproate), betaine, dimethylglycine, essential amino acids (e.g., allo-threonine, phosphothreonine, histidine, lysine, phenylalanine, tryptophan, leucine, isoleucine, and cysteine s-sulfate), nucleotides (e.g., adenosine 5'-monophosphate (AMP), uridine 5'-monophosphate (UMP), cytidine 5'-monophosphate (5'-CMP), and cytidine 2'3'-cyclicmonophosphate), myo-inositol, and indolin-2-one. Some of the aforementioned molecules provide beneficial characteristics to the host, including increased weight, pro-inflammatory effects, and antibiotic effects.

In some embodiments, the composition including the isolated first *Lactobacillus reuteri* strain (strain 3632) and the isolated second *Lactobacillus reuteri* strain (strain 3630) in combination, will secrete certain beneficial molecules in larger quantities than when individually cultured. For example, with combinations and cocultures of strains 3630 and 3632, increased levels of each of the following are provided or secreted (as determined from culture supernatants): dimethylglycine, allo-threonine, 1-methyl-4-imidazoleacetate, 4-imidazoleacetate, lysine, N6-methyllysine, N6, N6-dimethyllysine, 5-aminovalerate, and tyrosine, 4-hydroxyphenylpyruvate, indolacetate, and gamma-glutamylglutamine, glucose 6-phosphate, 4-hydroxyl-2-oxoglutaric acid, and myo-inositol, Uridine 5'-monophosphate (UMP), Cytidine 5'-monophosphate (5'-CMP), 3'-5'-uridylyluridine, O-sulfo-L-tyrosine, indole 3 acetamide, indolin-2-one and daidzein. In particular, when the strains 3630 and 3632 are combined in cultures or are grown together, significant and synergistic amounts (more than just additive) of some beneficial molecules are present or secreted. In particular embodiments, significant amounts of the molecules 4-hydroxyphenylpyruvate and glucose 6-phosphate are secreted or present with combinations of strains 3630 and 3632, or with compositions including a mix of about equal amounts of strains 3630 and 3632.

In some embodiments, the animal administered the composition exhibits a shift in the microbiome content of the gastrointestinal tract. For example, there may be an increase in the amount of bacteroidaceae bacteria in the gut of an animal that has been administered the composition described herein, as compared to an animal that was not administered the composition.

In embodiments of the present invention, the composition includes a combination of two isolated *Lactobacillus reuteri* strains.

Without wishing to be bound by a particular theory, it is believed that the immunogenic probiotic composition of the present disclosure can stimulate a subject's immune response. In this regard, and in particular, the composition is believed to improve vaccine efficacy, and decrease viral load and/or increase viral titer of a subject that is infected with an infectious respiratory disease or that is administered a vaccine for an infectious respiratory virus.

In some embodiments, the immunogenic probiotic composition is administered in conjunction with an infectious respiratory disease vaccine. By way of example, the composition may be administered before, after, or concurrently (either separately or co-administration) with an infectious respiratory disease vaccine. The composition may be administered to a subject as part of a vaccination or treatment regimen for an infectious respiratory disease. The infectious respiratory disease vaccine may be a live attenuated vaccine, inactivated vaccine, or subunit vaccine. Subunit vaccines include a protein or glycoprotein components of a viral pathogen that are capable of inducing a protective immune response.

In a preferred embodiment, the immunogenic probiotic composition is administered to the subject orally and the vaccine is administered by inhalation or ocular route. In another preferred embodiment, the immunogenic probiotic composition is administered to the subject orally and the vaccine is administered parenterally.

Infectious respiratory disease includes coronavirus disease including avian coronavirus disease infectious bronchitis due to infectious bronchitis virus (IBV); porcine reproductive and respiratory syndrome (PRRS); influenza disease including avian influenza, canine influenza and swine influenza; parainfluenza disease, including canine parainfluenza and feline influenza; adenovirus disease including avian adenovirus, porcine adenovirus, bovine adenovirus. The infectious respiratory diseases also apply in corresponding instances to humans, including such as human coronavirus disease and COVID-19, influenza, respiratory syncytial virus disease, parainfluenza.

Examples of infectious respiratory disease vaccines include MILDVAC-ARK, MILDVAC-GA-98, MILDVAC-Ma5, a vaccine to control infectious bronchitis virus (IBV) (Merck (Intervet) Animal Health). This live virus vaccine is prepared from a cloned Ma5 strain of Massachusetts type bronchitis; PREVACENT PRRS vaccine, a modified live virus vaccine to control PRRS; and NOBIVAC Canin e Parainfluenza Vaccine (Merck (Intervet)).

Some infectious respiratory diseases may be caused by coronavirus, as in the case of IBV. Examples of human coronaviruses include SARS COV-2, SARS COV, MERS COV, 229E, NL63, OC43, and HKU1. A coronavirus vaccine may include a coronavirus viral protein. A coronavirus vaccine may be based on mRNA or otherwise. A coronavirus vaccine may be a live attenuated vaccine.

In some embodiments, the invention provides a method of stimulating an immune response in a subject by administering to the subject an immunogenic probiotic composition disclosed herein. The composition may be administered in conjunction with an infectious respiratory disease vaccine. The composition may be administered prior to an infectious respiratory disease vaccine. The composition may be administered prior to and in conjunction with an infectious respiratory disease vaccine. The composition may be administered in conjunction with an infectious respiratory disease vaccine and also after the vaccine is administered, such as for a period of days or week thereafter.

In some embodiments, the invention provides a method of stimulating an immune response in a subject by administering to the subject an immunogenic probiotic composition disclosed herein in conjunction with an infectious respiratory disease viral protein. An infectious respiratory disease viral protein is a protein encoded by the viral genome. In a preferred embodiment, the viral protein is a surface exposed viral protein.

The immune response may be measured by any method known in the art. Examples of measuring immune response include measuring antibody titer, cytokine profiling, and histopathology methods. Quantitative PCR may be utilized to measure immune response, circulating or shed virus, or viral response.

Cytokine profiling is typically done using ELISA using lung/tracheal/intestinal homogenates or serum samples. In the absence of reagents needed for ELISA (antibodies for detection of various cytokines) cytokine profiling is done using qRT-PCR on mRNA isolated from RNAlater preserved samples. For example, tissue samples can be collected in RNAlater for cytokine mRNA isolation and/or examination either qualitatively and/or quantitatively by qRT-PCR Commonly affected cytokines in COVID 19 disease include, but not limited to, IL-4, IL-6, IL-10, TNF-α, IFN-γ, CCL-17, and CCL-22.

Histopathology involves chemical fixation of tissues in buffered formalin, processing, sectioning, and staining with common stains like eosin and haemotoxylin and is typically done to capture the microscopical pathological changes in tissues caused by infectious respiratory disease, such as with coronavirus such as COVID-19 or with influenza. At a more granular level, histopathology can be used to examine parameters including qualitative and/or quantitative changes in immune cell populations, structural changes, edema, hemorrhage, etc. due to an infectious respiratory disease, including COVID-19 disease (or SARS-CoV-2 infection). Since around 60% of the COVID-19 patients have diarrhea, histopathology of gut associated lymphoid tissues, such as Peyer's patches allows examination of immune cell infiltration and inflammation.

In an embodiment, stimulating an immune response includes increasing the antibody titer of an antibody selective for a viral antigen. The antibody titer can be measured by way of ELISA, or another suitable method.

In a preferred embodiment, the immunogenic probiotic composition is administered to the subject orally and the vaccine is administered by inhalation (oculonasal route), oral route or parenterally. In a embodiment, the immunogenic probiotic composition is administered to the subject orally, such as through or in feed or food or in water such as in daily water administered to the animal, and the vaccine is administered by inhalation (oculonasal route), oral route or parenterally.

In one embodiment, the invention provides a method of vaccinating a subject for an infectious respiratory disease. The method includes administering the immunogenic probiotic composition described herein and an infectious respiratory disease vaccine to a subject.

In some embodiments, the invention provides a method of increasing antibody titer in a subject when the subject is exposed to an infectious respiratory disease. In some embodiments, the invention provides a method of increasing antibody titer in a subject when the subject is exposed to an infectious agent, particularly an infectious respiratory agent. The method includes administering an effective amount of the immunogenic probiotic composition described herein to a subject before or after exposure to an infectious respiratory disease or infectious disease agent. In one embodiment, the administration of a compound provided herein, particularly an immunogenic probiotic composition provided herein, to a subject having respiratory viral infection or exposed to a respiratory virus reduces peak viral load. In one embodiment, the administration of an immunogenic probiotic composition provided herein to a subject having respiratory viral infection reduces or inhibits viral replication. In one embodiment, the administration of an immunogenic probiotic composition provided herein to a subject having respiratory viral infection reduces or inhibits viral transmission. In one embodiment, the administration of a immunogenic probiotic composition provided herein to a subject having respiratory viral infection or exposed to a respiratory viral agent stimulates antibody production which is selective or specific for an infectious respiratory disease antigen or enhances or increases the amount of antibody selective for an infectious respiratory disease antigen. In an embodiment, the antibody is selective for an infectious respiratory disease antigen. In some embodiments, the composition is administered to the subject at the onset of symptoms of an infectious respiratory disease. In some embodiments, the immunogenic probiotic composition is administered in conjunction with an infectious respiratory disease vaccine. In some embodiments, the antibody titer is increased by at least 10%, at least 20%, at least 30%, at least 50%, or at least 75%, as compared to a subject that was not administered the immunogenic probiotic composition. In some embodiments, the infectious respiratory disease is a coronavirus, influenza virus, parainfluenza virus, adenovirus, respiratory syncytial virus, parvovirus, reovirus, paramyxovirus or viral diarrhea virus associated disease In some embodiments, the invention provides a method of decreasing viral load in a subject. The method includes administering an effective amount of the immunogenic probiotic composition described herein to a subject before or after exposure to an infectious respiratory disease. In one embodiment, the administration of an immunogenic composition described herein to a subject decreases peak viral load. In some embodiments, the composition is administered to the subject at the onset of symptoms of an infectious respiratory disease. In some embodiments, the immunogenic probiotic composition is administered in conjunction with an infectious respiratory disease vaccine. In some embodiments, the viral load is decreased by at least 10%, at least 20%, at least 30%, at least 50%, or at least 75%, as compared to a subject that was not administered the immunogenic probiotic composition.

In some embodiments, the invention provides a method of decreasing viral shedding in a subject. The method includes administering an effective amount of the immunogenic probiotic composition described herein to a subject before or after exposure to an infectious respiratory disease. In some embodiments, the composition is administered to the subject at the onset of symptoms of an infectious respiratory disease. In some embodiments, the immunogenic probiotic composition is administered in conjunction with an infectious respiratory disease vaccine. In some embodiments, the viral shedding is decreased by at least 10%, at least 20%, at least 30%, at least 50%, or at least 75%, as compared to a subject that was not administered the immunogenic probiotic composition.

Definitions

As used herein, "isolated" means that the subject isolate has been separated from at least one of the materials with which it is associated in a particular environment, for example, its natural environment.

Thus, an "isolate" does not exist in its naturally occurring environment; rather, it is through the various techniques known in the art that the microbe has been removed from its natural setting and placed into a non-naturally occurring state of existence. Thus, the isolated strain or isolated microbe may exist as, for example, a biologically pure culture in association with an acceptable carrier.

As used herein, "individual isolates" should be taken to mean a composition, or culture, comprising a predominance of a single species, or strain, of microorganism, following separation from one or more other microorganisms. The phrase should not be taken to indicate the extent to which the microorganism has been isolated or purified. However, "individual isolates" can include substantially only one species, or strain, of microorganism.

In certain aspects of the disclosure, the isolated *Lactobacillus reuteri* strain exist as isolated and biologically pure cultures. It will be appreciated by one of skill in the art, that an isolated and biologically pure culture of a particular *Lactobacillus reuteri* strain, denotes that said culture is substantially free (within scientific reason) of other living organisms and contains only the individual *Lactobacillus reuteri* strain in question. The culture can contain varying concentrations of said isolated *Lactobacillus reuteri* strain. The present disclosure notes that isolated and biologically pure microbes often necessarily differ from less pure or impure materials.

In some embodiments of the present invention, the composition includes a combination of two isolated *Lactobacillus reuteri* strains. In some embodiments of the present invention, the composition includes a combination of two or more isolated *Lactobacillus reuteri* strains.

As used herein, the term "bacterial consortia", "bacterial consortium", "microbial consortia", or "microbial consortium" refers to a subset of a microbial community of individual microbial species, or strains of a species, which can be described as carrying out a common function, or can be described as participating in, or leading to, or correlating with, a recognizable parameter, such as a phenotypic trait of interest (e.g. increasing vaccine efficacy). The community may comprise two or more species, or strains of a species (eg., *Lactobacillus reuteri* strains 3632 and 3630), of microbes. In some instances, the microbes coexist within the community symbiotically.

As used herein, the terms "colonize" and "colonization" include "temporarily colonize" and "temporary colonization".

As used herein, "probiotic" refers to a substantially pure microbe (i.e., a single isolate) or a mixture of desired microbes, and may also include any additional components (e.g., carrier) that can be administered to an animal to provide a beneficial health effect. Probiotics or microbial compositions of the invention may be administered with an agent or carrier to allow the microbes to survive the environment of the gastrointestinal tract, i.e., to resist low pH and to grow in the gastrointestinal environment.

As used herein, "carrier", "acceptable carrier", or "pharmaceutical carrier" are used interchangeably and refer to a diluent, adjuvant, excipient, or vehicle with which the compound is administered. Such carriers can be sterile liquids, such as water and oils, including those of petroleum, animal, vegetable, or synthetic origin; such as peanut oil, soybean oil, mineral oil, sesame oil, and the like. Water or aqueous solution saline solutions and aqueous dextrose and glycerol solutions are preferably employed as carriers, in some embodiments as injectable solutions. Alternatively, the carrier can be a solid dosage form carrier, including but not limited to one or more of a binder (for compressed pills), a glidant, an encapsulating agent, a flavorant, and a colorant. The choice of carrier can be selected with regard to the intended route of administration and standard pharmaceutical practice. See Handbook of Pharmaceutical Excipients, (Sheskey, Cook, and Cable) 2017, 8th edition, Pharmaceutical Press; Remington's Pharmaceutical Sciences, (Remington and Gennaro) 1990, 18th edition, Mack Publishing Company; Development and Formulation of Veterinary Dosage Forms (Hardee and Baggot), 1998, 2nd edition, CRC Press.

As used herein, "delivery" or "administration" means the act of providing a beneficial activity to a host. The delivery may be direct or indirect. An administration could be by an oral, ocular, nasal, inhalation, parenteral, or mucosal route. For example without limitation, an oral route may be an administration through drinking water, animal feed, or edible solid, a nasal route of administration may be through a spray or vapor, and a mucosal route of administration may be through direct contact with mucosal tissue. Mucosal tissue is a membrane rich in mucous glands such as those that line the inside surface of the nose, mouth, esophagus, trachea, lungs, stomach, gut, intestines, and anus. In the case of birds, administration may be in ovo, i.e. administration to a fertilized egg. In ovo administration can be via a liquid which is sprayed onto the egg shell surface, or an injected through the shell. Mucosal route of administration includes administration by inhalation of spray, aerosol, nebulized material, or vapor.

As used herein, the terms "treating", "to treat", or "treatment", include restraining, slowing, stopping, inhibiting, reducing, ameliorating, or reversing the progression or severity of an existing symptom, disorder, condition, or disease. A treatment may also be applied prophylactically to prevent or reduce the incidence, occurrence, risk, or severity of a clinical symptom, disorder, condition, or disease.

As used herein, "subject" includes bird, poultry, a human, or a non-human mammal. Specific examples include chickens, turkey, dogs, cats, cattle, and swine. The chicken may be a broiler chicken, egg-laying or egg-producing chicken. As used herein, the term "poultry" includes domestic fowl, such as chickens, turkeys, ducks, quail, and geese.

As used herein, "vaccine" refers to a composition that improves immunity to a particular disease. A vaccine typically contains an agent that resembles a disease-causing pathogen, and is often made from weakened or killed forms of the pathogen, its toxins or one of its surface proteins.

As used herein, the term "immunogenic" means than an agent is capable of eliciting an immune response, including an innate, humoral, or cellular immune response, and both. "Immunogenic" includes "immunomodulatory". An immunogenic composition is a composition that elicits an innate, humoral, or cellular immune response, or both.

As used herein, the term "immune response" includes a response by a subject that involves generation of antibodies that bind to an antigen (i.e., an antibody response). This does not exclude generation of a cell-mediated response.

The phrase "stimulating an immune response" includes a) generating an immune response against an antigen (e.g., a viral antigen) in a naïve individual; or b) increasing, reconstituting, boosting, or maintaining an immune response in an individual beyond what would occur if the composition was not administered. A composition is immunogenic if it is capable of attaining either of these criteria when administered in single or multiple doses.

As used herein "stimulating" an immune or immunological response refers to administration of a composition that initiates, boosts, modulates, or maintains the capacity for the host's immune system to react to a virus or antigen, at a level higher than would otherwise occur.

By "stimulating" is meant directly or indirectly increasing the level and/or functional activity of a target system (e.g., immune system). In certain embodiments, "stimulation" or "stimulating" means that a desired/selected response is more efficient (e.g., at least 10%, 20%, 30%, 40%, 50%, 60% or more), more rapid (e.g., at least 10%, 20%, 30%, 40%, 50%, 60% or more), greater in magnitude (e.g., at least 10%, 20%, 30%, 40%, 50%, 60% or more), and/or more easily induced (e.g., at least 10%, 20%, 30%, 40%, 50%, 60% or more) than if the vaccine had been used alone.

The term "adjuvant(s)" describes a substance, compound, agent or material useful for improving an immune response or immune cell or component stimulation, and may in some instances be combined with any particular antigen in an immunological, pharmaceutical or vaccine composition. Adjuvants can be used to increase the amount of antibody and effector T cells produced and to reduce the quantity of antigen or immune stimulant or modulator and the frequency of injection. Although some antigens are administered without an adjuvant, there are many antigens that lack sufficient immunogenicity to stimulate a useful immune response in the absence of an effective adjuvant. Adjuvants also improve the immune response from "self-sufficient" antigens, in that the immune response obtained may be increased or the amount of antigen administered may be reduced. An adjuvant can serve as a tissue depot that slowly releases the antigen and also as a lymphoid system activator that non-specifically enhances the immune response (Hood et al., Immunology, Second Ed., 1984, Benjamin/Cummings: Menlo Park, California, p. 384). In a preferred aspect an adjuvant is physiologically and/or pharmaceutically acceptable in a mammal, particularly a human. The standard adjuvant for use in laboratory animals is Freund's adjuvant. Freund's Complete adjuvant (FCA) is an emulsion containing mineral oil and killed mycobacteria in saline. Freund's incomplete adjuvant (FIA) omits the mycobacteria. Both FIA and FCA induce good humoral (antibody) immunity, and FCA additionally induces high levels of cell-mediated immunity. However, neither FCA nor FIA are acceptable for clinical use due to the side effects. In particular, mineral oil is known to cause granulomas and abscesses, and *Mycobacterium tuberculosis* is the agent responsible for tuberculosis. Previously known and utilized adjuvants include, but are not limited to, complete Freund's adjuvant, incomplete Freund's adjuvant, saponin, mineral gels such as aluminum hydroxide, surface active substances such as lysolecithin, pluronic polyols, polyanions, peptides, oil or hydrocarbon emulsions, keyhole limpet hemocyanins, dinitrophenol, and potentially useful human adjuvant such as BCG (bacille Calmette-Guerin) and *Corynebacterium parvum*. Mineral salt adjuvants include but are not limited to: aluminum hydroxide, aluminum phosphate, calcium phosphate, zinc hydroxide and calcium hydroxide. Preferably, the adjuvant composition further comprises a lipid of fat emulsion comprising about 10% (by weight) vegetable oil and about 1-2% (by weight) phospholipids. Preferably, the adjuvant composition further optionally comprises an emulsion form having oily particles dispersed in a continuous aqueous phase, having an emulsion forming polyol in an amount of from about 0.2% (by weight) to about 49% (by weight), optionally a metabolizable oil in an emulsion-forming amount of up to 15% (by weight), and optionally a glycol ether-based surfactant in an emulsion-stabilizing amount of up to about 5% (by weight). There have been many substances that have been tried to be used as adjuvants, such as the lipid-A portion of gram negative bacterial endotoxin, and trehalose dimycolate of mycobacteria. The phospholipid lysolecithin exhibited adjuvant activity (Arnold et al., Eur. J Immunol. 9:363-366, 1979). Some synthetic surfactants exhibited adjuvant activity, including dimethyldioctadecyl ammonium bromide (DDA) and certain linear polyoxypropylenepolyoxyethylene (POP-POE) block polymers (Snippe et al., Int. Arch. Allergy Appl. Immunol. 65:390-398, 1981; and Hunter et al., J. Immunol. 127:1244-1250, 1981).

Any examples or illustrations given herein are not to be regarded in any way as restrictions on, limits to, or express definitions of any term or terms with which they are utilized. Instead, these examples or illustrations are to be regarded as being described with respect to one particular embodiment and as being illustrative only. Those of ordinary skill in the art will appreciate that any term or terms with which these examples or illustrations are utilized will encompass other embodiments which may or may not be given therewith or elsewhere in the specification and all such embodiments are intended to be included within the scope of that term or terms. Language designating such nonlimiting examples and illustrations includes, but is not limited to: "for example," "for instance," "e.g.," and "in one embodiment." In this specification, groups of various parameters containing multiple members are described. Within a group of parameters, each member may be combined with any one or more of the other members to make additional sub-groups. For example, if the members of a group are a, b, c, d, and e, additional sub-groups specifically contemplated include any one, two, three, or four of the members, e.g., a and c; a, d, and e; b, c, d, and e; etc.

Throughout this specification, quantities are defined by ranges, and by lower and upper boundaries of ranges. Each lower boundary can be combined with each upper boundary to define a range. The lower and upper boundaries should each be taken as a separate element. Two lower boundaries or two upper boundaries may be combined to define a range.

Deposit Information

*Lactobacillus reuteri* strain "3630" was deposited on 19 Jun. 2020 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-126787.

*Lactobacillus reuteri* strain "3632" was deposited on 19 Jun. 2020 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-126788.

Access to the deposits is available during the pendency of this application to persons determined by the Commissioner of Patents and Trademarks to be entitled thereto under 37 C.F.R. § 1.14 and 35 U.S.C. § 122. Upon allowance of any embodiments in this application, all restrictions on the availability to the public of the variety is irrevocably removed.

The deposits is maintained in the ATCC depository, which is a public depository, for a period of 30 years, or 5 years after the most recent request, or for the effective life of the patent, whichever is longer, and is replaced if a deposit becomes nonviable during that period.

The present disclosure may be better understood with reference to the examples, set forth below. The following examples are put forth so as to provide those of ordinary skill in the art with a complete disclosure and description of how the compounds, compositions, and/or methods claimed herein are made and evaluated, and are intended to be purely exemplary and are not intended to limit the disclosure. It is appreciated that other embodiments and uses is apparent to those skilled in the art and that the invention is not limited to these specific illustrative examples or preferred embodiments.

Example 1

Isolation and Characterization of *L. reuteri* 3630 and 3632

*L. reuteri* 3630 and 3632 were isolated from chicken cecum. Morphology of these strains include opaque, circular colonies with slight whitish center. The LR 3630 colonies have whitish pigmentation and the LR 3632 colonies include dull orange pigmentation. These strains are non-spore forming The strains are sequenced by PacBio sequencing. 3632 contained 7 contigs and yield a total estimated genome size of 2.4 Mb and LR 3630 contained 5 contigs yielding an estimated genome size of 2.4 Mb. Phylogenetic relationships of the genomes are explored with UBCG v3.0 using default settings. This software tool employs a set of 92 single-copy core genes commonly present in all bacterial genomes. These genes then are aligned and concatenated within UBCG using default parameters. The estimation of robustness of the nodes is done through the gene support index (GSI), defined as the number of individual gene trees, out of the total genes used, that present the same node. A maximum-likelihood phylogenetic tree is inferred using FastTree v.2.1.10 with the GTR+CAT model. LR strains 3632 and 3630 isolates show closest relationship to *L. reuteri.*

Example 2

Effect of Probiotics on Infectious Bronchitis Vaccine Serology

The effect of probiotics on Infectious Bronchitis Vaccine serology is tested. Chickens are divided into thirteen test groups, each group having 14 birds. See Table 1 for test groups and relevant treatments.

TABLE 1

| Group ID | Number of Chickens Enrolled | Vaccination/Probiotic Treatment(s) | Vaccination/ Probiotic Route | Challenge (26 DOA*** ) | Challenge Volume/Route | Necropsy (31 DOA*** ) |
|---|---|---|---|---|---|---|
| 1 | 14 | None | NA | None | N/A | 5 days post challenge |
| 2 | 14 | None/LR3632 | NA/DW* | None | N/A | |
| 3 | 14 | None/LR3630 | NA/DW* | None | N/A | |
| 4 | 14 | None | NA | IBV M41 | 60 μL total or 30 μL per eye/Ocular | |
| 5 | 14 | None/LR3632 | NA/DW* | IBV M41 | 60 μL total or 30 μL per eye/Ocular | |
| 6 | 14 | None/LR3632 and LR3630 | NA/Spray** | IBV M41 | 60 μL total or 30 μL per eye/Ocular | |
| 7 | 14 | None/LR3632 and LR3630 | NA/DW* | IBV M41 | 60 μL total or 30 μL per eye/Ocular | |
| 8 | 14 | IBV/LR3632 and LR3630 | Spray/DW* | IBV M41 | 60 μL total or 30 μL per eye/Ocular | |
| 9 | 14 | IBV/None | Spray/NA | IBV M41 | 60 μL total or 30 μL per eye/Ocular | |
| 10 | 14 | IBV/None | Spray/NA | None | N/A | |
| 11 | 14 | None/*Bacillus* | NA/DW* | IBV M41 | 60 μL total or 30 μL per eye/Ocular | |
| 12 | 14 | IBV/*Bacillus* | Spray/DW* | IBV M41 | 60 μL total or 30 μL per eye/Ocular | |
| 13 | 14 | None/*Bacillus* | NA/DW* | None | N/A | |

NA—not applicable;
DW—drinking water;
*SD 0-SD 26
**SD 0
*** day of age

At 24±2 days of age, blood drawn for serological testing.

Chickens in treatment groups 4, 5, 6, 7, 8, 9, 11, and 12 are challenged with IBV Mass at approximately 4 weeks of age by the ocular route (60 μL per chicken or 30 μL/eye).

After challenge a health observation is performed every day until necropsy at 5 days post challenge.

At SD 26±2 (day of challenge) to SD31±2 (day of necropsy), chickens in groups 1, 4, 5, 6, 7, 8, 9, 10, 11, and 12 have daily cloacal swabs taken for PCR.

Five days post challenge (SD31±2), chickens are euthanized and necropsied:

Examine lung from all chickens from groups 1-13 for gross lesions and record.

Examine trachea from all chickens from groups 1-13 for gross lesions and record.

Collect tracheal swabs from chickens in group 1-13 for IBV testing by PCR.

Dissect trachea from each chicken in groups 1, 4, 7 and 11. Place in a tube of 1.0 mL PBS, rock tube back and forth at least 5 times, remove trachea and retain PBS for sampling.

Collect ~2 cm section of trachea from each birds in groups 1-13 in buffered formalin for histology.

Collect approximately a dime size of lung tissue in a cryotube from each bird in groups 1, 4, 7 and 11. Store at −60° C. or below for microbiome analysis.

Collect approximately a dime size of lung tissue in formalin for all groups (1-13) for histology.

Collect contents of left cecum in a cryotube from each bird in groups 1, 4, 7, and 11. Place on ice packs or dry ice until stored long term at −60° C. or below for microbiome analysis.

Dissect right cecal tonsil from all birds in groups 1-13, cut the tissue in two pieces (longitudinally); transfer one piece to buffered formalin for histology and another piece to a another tube stored at −60° C. or below for IBV testing by PCR or other in vitro analysis.

Group 1—Birds in group 1 serve as no-treatment/non-challenge control and receive clean water during SD 0 to SD 26±2.

Group 2 and 5: Birds in group 2 and 5 receive *Lactobacillus reuteri* 3632 (Lot #20200424-LBRT3632.01-GF) via drinking water during SD 0 to 26±2. The probiotic is in the form as a lyophilized cake and each vial contains 200 doses. Each vial is Q.S.'d (quantum sufficit) to 100 ml with clean drinking water for 2 doses/mL dilution and volume is calculated of probiotic added to the bell waterer during the each probiotic treatment day and documented on a Probiotic Treatment Preparation form. For example, for 14 chickens: Need 14 chickens doses÷2 doses/mL=7.0 mL diluted probiotic.

Group 3: Birds in group 3 receive *Lactobacillus reuteri* 3630 (Lot #202000421-LBRT3630.01-GF) via drinking water during SD 0 to 26±2. The probiotic is available as lyophilized cake and each vial contains 200 doses. Each vial is diluted with 100 mL with clean drinking water for 2 doses/mL dilution and volume is calculated of probiotic added to the bell waterer during the each probiotic treatment day.

Group 4: Birds in group 4 serve as no-treatment/challenge controls. Birds receive clean water during SD 0 to SD 31±2.

Group 6: Birds in group 6 receive *Lactobacillus reuteri* 3632 (Lot #20200424-LBRT3632.01-GF) and *Lactobacillus reuteri* 3630 (Lot #202000421-LBRT3630.01-GF) via spray on SD 0. The probiotic is available as lyophilized cake and each vial contains 400 doses. Each vial is diluted with 28.0 mL of clean drinking water and mixed, 28.0 mL from each diluted vial of probiotic is combined (extra volume is used to prime the spray cabinet at approximately 40 mL). The spray cabinet administers 14.0 mL total to the cabinet for 100 birds. Birds are confined to the appropriate space (approximately 14%) when the probiotics are administered via commercial spray cabinet at 140 L/chicken.

Group 7: Birds in group 7 receive *Lactobacillus reuteri* 3632 (Lot #20200424-LBRT3632.01-GF) and *Lactobacillus reuteri* 3630 (Lot #202000421-LBRT3630.01-GF) via drinking water during SD 0 to 26±2. The probiotic is available as lyophilized cake and each vial contains 400 doses. Each vial is Q.S.'d (quantum sufficit) to 100 ml with clean drinking water for 4 doses/mL dilution and volume is calculated of probiotic added to the bell waterer during the each probiotic treatment day and documented on a Probiotic Treatment Preparation form.

Group 8: Birds in group 8 receive IBV vaccine via coarse spray route on SD 0 along with *Lactobacillus reuteri* 3632 (Lot #20200424-LBRT3632.01-GF) and *Lactobacillus* The probiotic is available as lyophilized cake and each vial contains 400 doses. Each vial is Q.S.'d (quantum sufficit) to 100 ml with clean drinking water for 4 dose/mL dilution and volume is be calculated of probiotic added to the bell waterer during the each probiotic treatment day and documented on a Probiotic Treatment Preparation form. The bulk re-hydrated probiotic can be used for all groups for that probiotic's water treatment.

Group 9 and 10: Birds in groups 9 and 10 receive IBV vaccine via coarse spray route on SD 0. Vaccine is administered according to manufacturer's instructions.

Group 11 and 13: Birds in group 11 and 13 receive *Bacillus amyloliquefaciens* spores (Lot #20200511-BAML.01GF) via drinking water during SD 0 to 26±2. The probiotic is available as lyophilized cake and each vial contains 200 doses. Each vial is diluted with 100.0 mL of clean drinking water for 2.0 doses/mL. From the re-hydrated probiotic, 0.5 mL/chicken is added to the bell waterer during each probiotic treatment day.

Group 12: Birds in group 12 receive IBV vaccine via coarse spray route on SD 0 and *Bacillus amyloliquefaciens* spores (Lot #20200511-BAML.01GF) via drinking water during SD 0 to 26±2.

The probiotic is available as lyophilized cake and each vial contains 200 doses. Each vial is Q.S.'d with clean drinking water to 100 mL for 2 doses/mL. From the re-hydrated probiotic, 0.5 mL/chicken is added to the bell waterer during each probiotic treatment day.

The birds are challenged with Avian Infectious Bronchitis Virus (IBV) Mass 41 strain. The titer is 6.70 log 10 EID50/mL and the dosage is 4.0 log 10 EID50/mL, 60 μL/bird, Ocular.

On SD 26±2, at 4-weeks-of-age, each bird from treatment groups 4, 5, 6, 7, 8, 9, 11, and 12 is challenged with 60 μL per bird (30 μL per eye) of IBV M41 challenge virus. Challenge is administered using a micropipette with sterile tip.

Chickens are observed daily post-challenge until necropsy (SD 27±2 through SD31±2). Clinical signs of IBV may include: coughing, sneezing, tracheal rales, depression, ruffled feathers, inappetence, huddling, wet or watery feces, and reluctance to move/rise.

On SD 24±2 (1-2 days before challenge), approximately 1-2 mL of blood samples are collected from the brachial vein using a 20-25 gauge needle and appropriately sized syringe. Blood is transferred to a serum tube or serum separator tube and allowed to coagulate.

Trachea and lung from each bird is evaluated on SD 33±2 at necropsy for gross lesion, and scored as normal or abnormal (serous, catarrhal or caseous exudates present in the trachea and congestion (pneumonia) in the lungs).

Cloacal swabs are collected from each bird in treatment groups 1, 4, 5, 6, 7, 8, 9, 10, 11, and 12 from SD 26±2 (day of challenge) to SD31±2 (day of necropsy).

Tracheal swabs are collected from each bird from groups 1-13 at 5 days post challenge at necropsy (SD31±2).

Dissect trachea from each bird in groups 1, 4, 7 and 11 and place in a cryotube with 1.0 mL of PBS (phosphate buffered saline), rock the vial back and forth at least 5 times and retain the rinse in a cryotube and store at −60° C. or below for microbiome analysis. The trachea can be removed and used for further sampling for histopathology.

Lung samples and tracheal samples are tested for microbiome data analysis.

Approximately a dime size piece of lung tissue and approximately 2 cm long section of trachea is collected from each bird from treatment groups 1-13 on SD 31±2 in buffered formalin.

Right cecal tonsil, secondary lymphoid tissue located at the cecal-rectal junction. Dissect ~2 cm long cecal-rectal junction is collected on SD 31±2. Each sample is cut into two pieces longitudinally (contents may be gently removed), one piece is stored in cryotubes for PCR testing (or other in vitro analysis) and another piece is stored in buffered formalin.

Antibody titer is measured from blood samples collected on study day 24. Antibody titer results are depicted in FIG. 1. Study group 8 (administered strains LR3632 and LR3630) shows approximately 20% increase in antibody titer as compared to chickens that were not administered strains 3632 and 3630.

Tracheal virus load and viral shedding (D0, D1, D2, D3, D4, and D5) are tested with varying amount of at least one of 3630, 3632, and vaccine.

Example 3

Antiviral Effect of *L. reuteri* on Porcine Reproductive and Respiratory Syndrome (PRRSV)

The effect of LR cells and LR supernatant (3630 and 3632) are tested on MARC-145 (Monkey Kidney) cells in a prevention and therapeutic context, in connection with PRRSV. Virus: GFP-PRRSV, MOI of 1.0; Bacteria: Stock ($10^6$ cells/mL).

MARC-145 cells are prepared 2-3 days prior to study. The cells are treated with undiluted and 2-fold serially diluted Bacteria/extract up to 1:32 (1:64) before or after PRRSV infection. In a prevention context, *Lactobacillus* cells or culture supernatant are added first and virus is added 2-4 hrs later. In a therapeutic context, virus is added first and *Lactobacillus* cells or culture supernatant is added next, 10 min or 1 hr post infection. The PRRSV inhibitory effect is analyzed by GFP expression and CPE up to 72 hours post infection (hpi).

Figure 2:
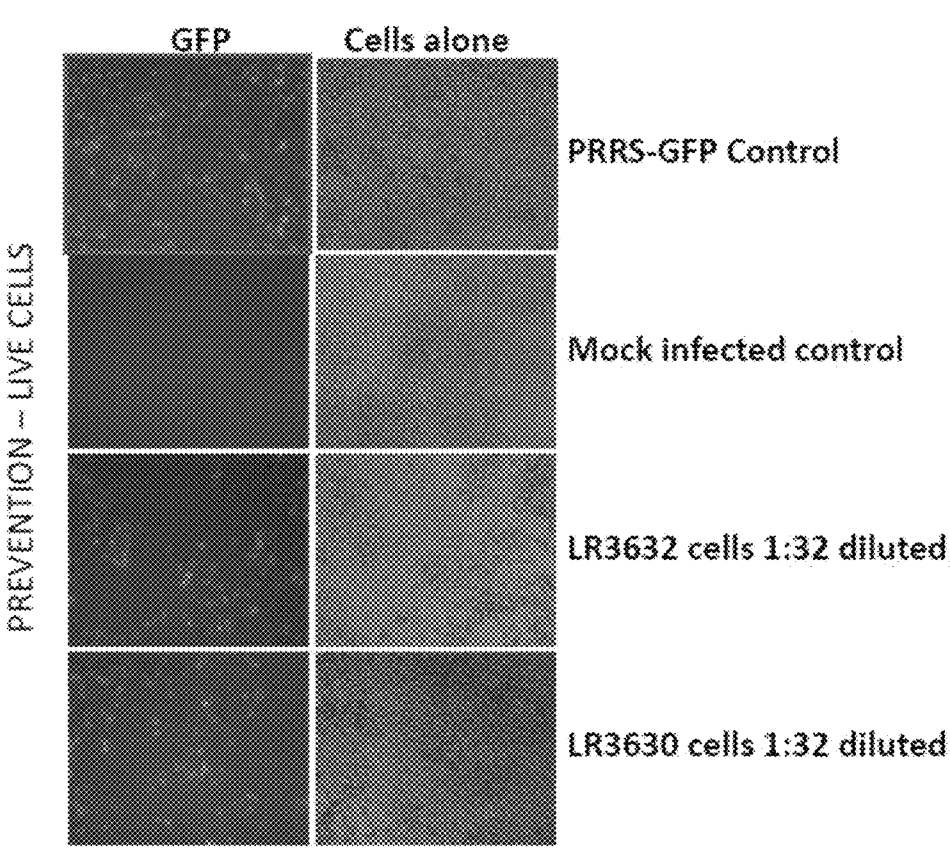
FIG. 2 depicts the effect of *Lactobacillus reuteri* cells on MARC-145 cells in preventing PRRSV infection.
Figure 3:
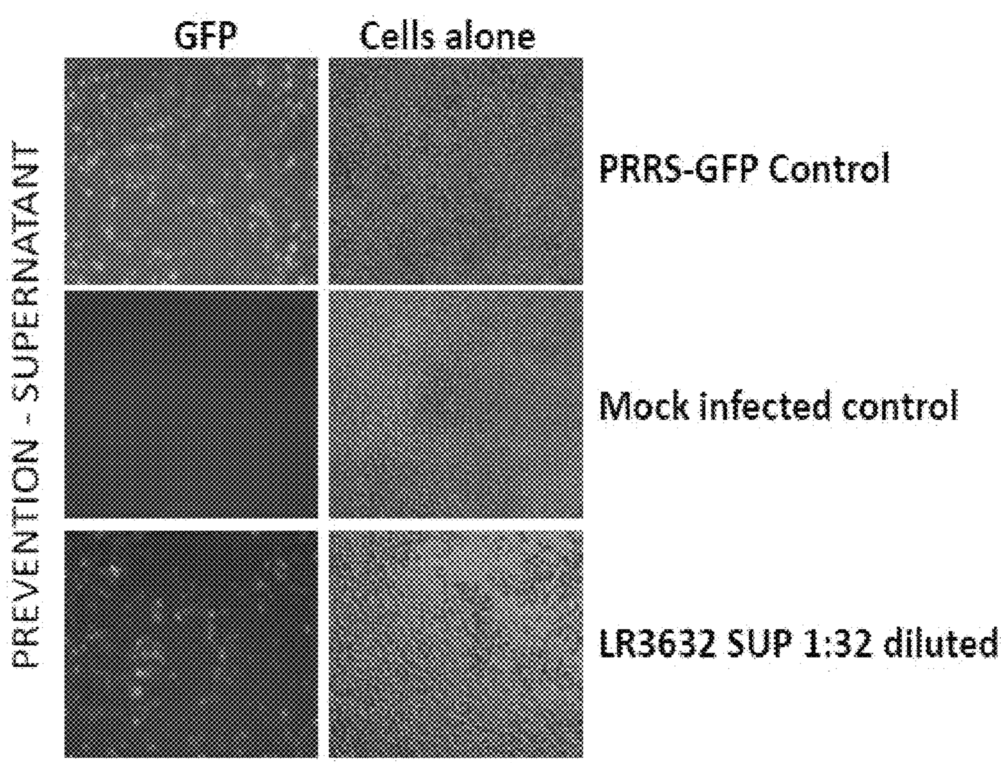
FIG. 3 depicts the effect of *Lactobacillus reuteri* supernatant on MARC-145 cells in preventing PRRSV infection.
Figure 4:
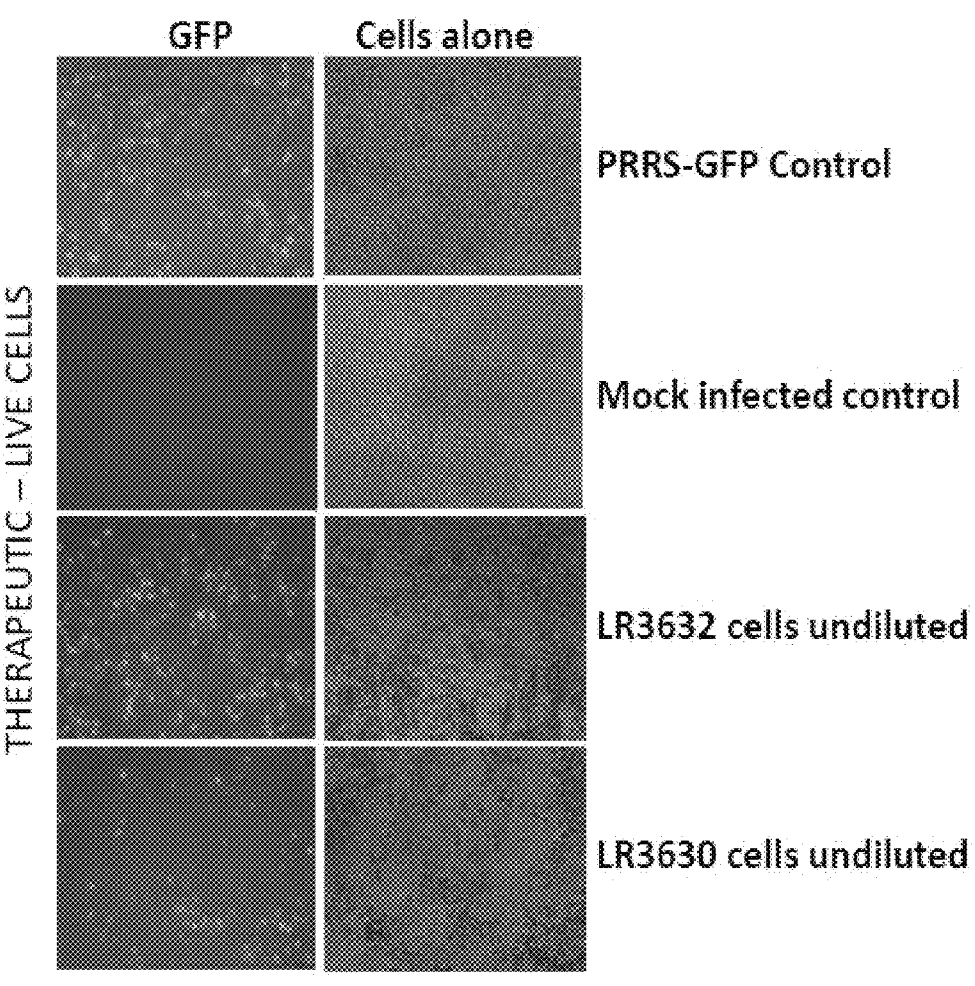
FIG. 4 depicts the effect of *Lactobacillus reuteri* cells on MARC-145 cells in treating PRRSV infection.
Figure 5:
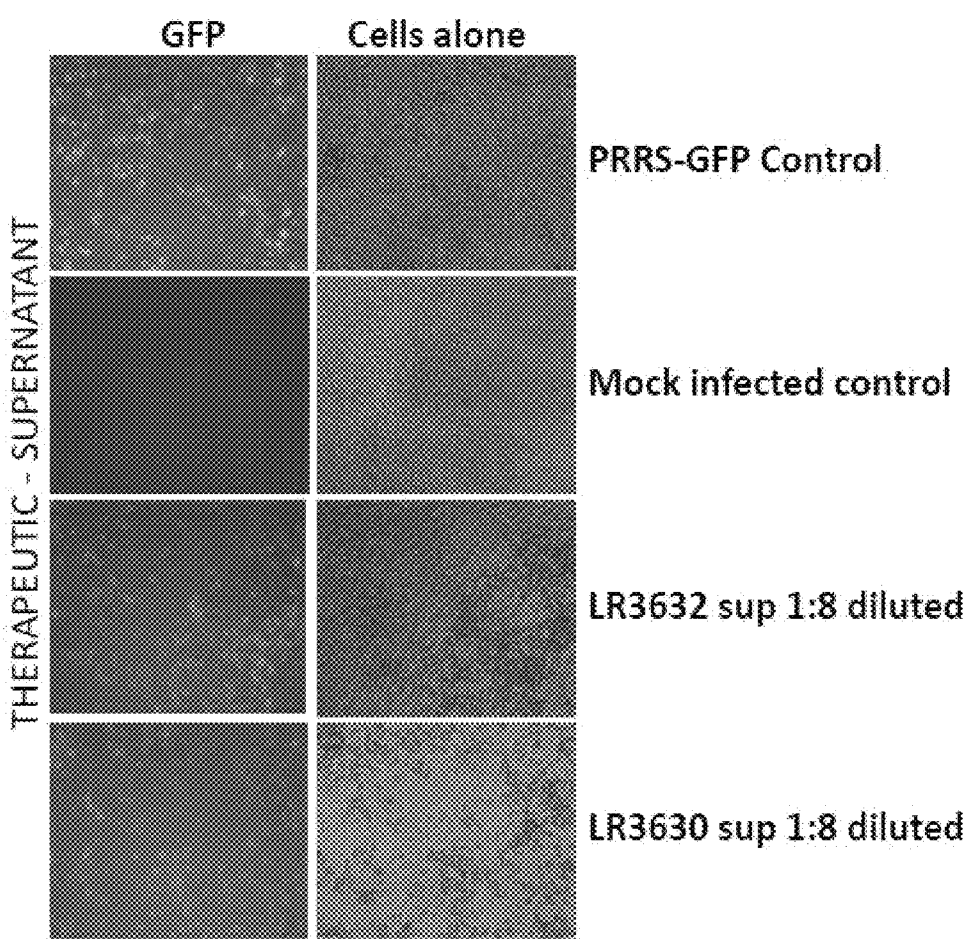
FIG. 5 depicts the effect of *Lactobacillus reuteri* supernatant on MARC-145 cells in treatment of PRRSV infection.

Live *Lactobacillus reuteri* strain 3632 or strain 3630 cells show more than 50% inhibitory effect on PRRSV at 1:16 to 1:32 dilutions in prevention setting. See FIG. 2. Similar inhibition (30-40%) was shown for both *Lactobacillus reuteri* supernatants in prevention setting. See FIG. 3. *Lactobacillus reuteri* strain 3632 and strain 3630 live cells somewhat inhibited PRRSV but both supernatants more efficiently inhibited virus replication in therapeutic setting. See FIGS. 4 and 5.

The efficacy of a PRRSV vaccine in combination with strains 3630 and 3632 is evaluated in growing swine following heterologous challenge with a virulent PRRS virus. The efficacy of vaccine in combination with *L. reuteri* strains 3630 and 3632 is based on the effectiveness of the vaccine to reduce lung lesions and viremia compared to a vaccinated control where 3630 and 3632 are not administered.

Blood samples for determination of PRRSV viremia are collected on Days 0 and 35. Nasal swabs to assess viral load are collected on Days 0 and 35. A body weight measurement (lbs) is taken on Day 0 and prior to the challenge on Day 35.

On Day 35, a 2 mL challenge dose is administered intranasally, with approximately 1 mL per nostril. The post-challenge phase is from Day 35 to Day 49. All pigs are individually assessed for depression, body condition and respiratory distress on Days 35-49 and scored for each clinical sign. Blood samples for PRRSV serum antibody determination (FFN) are collected on Days 42 and 49. Blood samples for determination of PRRSV viremia are collected on Days 38, 42, 45, and 49. Nasal swabs to assess viral load are collected on Days 38, 42, 45, and 49. A body weight measurement is obtained at the time of necropsy on Day 49. On Day 49, animals are humanely euthanized and lungs are scored by the Study Investigator who was blinded to treatment. Each of the seven pulmonary lobes is examined both visually and by palpation for gross characteristic lesions attributed to PRRSV. The amount of lesion/consolidation in each pulmonary lobe is scored as an actual between 0 and 100% of the lobe. The score for each lobe is entered into a weighted formula to calculate the percentage of lung with lesions.

Antibody titer is measured from blood samples collected on study day 24. Viral shedding is tested.

Example 4

Clinical Outcome and Virus Shedding in a Hamster SARS-CoV-2 Challenge Model

The effect of LR 3630 and LR 3632 are tested in a hamster SARS-CoV-2 challenge model. Male golden Syrian hamsters 5-7 weeks of age are tested in a 13 day study. On SD −7 to SD −1 and SD 1 to SD 4, hamsters in TG03, TG04, and TG05 receive appropriate dose of probiotic (see Table 2) via oral gavage once daily. On SD 0, all animals in TG02, TG03, TG04, and TG05 are be challenged via intranasal route with SARS-CoV-2 at a concentration of 105 TCID50 in 100 μL (50 μL per naris).

All animals are observed once per day and clinical scores are recorded.

Fecal swabs are collected daily from Days −1 to Day 5. Blood samples are collected on Days −7, −2, 1, 3, and 5. The blood volume collected in a week from an individual animal do not exceed 0.5 mL. At time of necropsy, larger volumes of blood are collected. All animals are be euthanized, and samples is collected for in vitro analysis.

TABLE 2

| Treatment Groups | | | | | |
|---|---|---|---|---|---|
| Group | Compound/Dose | Treatment Route/ Frequency | Dose of SARS-Cov-2 | Challenge Route | Number of Animals per Group |
| TG01 | No treatment (held in a separate room) | Not applicable (N/A) | No challenge | N/A | 7 |
| TG02 | No treatment | Not applicable | $10^5$ $TCID_{50}$ | IN (50 μL per nare) | 7 |

TABLE 2-continued

| Treatment Groups | | | | | |
|---|---|---|---|---|---|
| Group | Compound/Dose | Treatment Route/ Frequency | Dose of SARS-Cov-2 | Challenge Route | Number of Animals per Group |
| TG03 | *L. reuteri** ($10^7$ CFU/animal/day) | ***Gavage/ daily study Day −7 to 5 | on SD0 | IN (50 μL per nare) | 7 |
| TG04 | *L. reuteri*** ($10^5$ CFU/animal/day) | ***Gavage/ daily study Day −7 to 5 | | IN (50 μL per nare) | 7 |
| TG05 | *B. amyloliquefaciens* ($10^7$ CFU/animal/day) | ***Gavage/ daily study Day −7 to 5 | | IN (50 μL per nare) | 7 |

CFU-colony forming unit;
IN-intransal;
SD-Study day;
*each dose contains $5 \times 10^6$ CFU of *L.reuteri* strain 3630 in 0.25 mL and $5 \times 10^6$ CFU of *L.reuteri* strain 3632 in 0.25 mL
**each dose contains $5 \times 10^4$ CFU of *L.reuteri* strain 3630 in 0.25 mL and $5 \times 10^4$ CFU of *L.reuteri* strain 3632 in 0.25 mL
***no probiotic treatment on SD 0 (challenge day)

TABLE 3

| Schedule of Study Events. | | | | | | | | | |
|---|---|---|---|---|---|---|---|---|---|
| Day | Treat groups 3-5 (oral or gavage) | Challenge | Fecal swabs | Euthanize & sample including group 1 | Blood samples | Nasal Washes | Wt. | Clinical scoring | FECAL Appear-ance |
| −14 to −8 | | | | | | | | | |
| −7 | X | | | | X | | X | X | |
| −6 | X | | | | | | | X | |
| −5 | X | | | | | | | X | |
| −4 | X | | | | | | X | X | |
| −3 | X | | | | | | | X | |
| −2 | X | | | | X | X | | X | |
| −1 | X | | X | | | | X | X | |
| 0 | | X | X | | | | X | X | X |
| 1 | X | | X | | X | X | X | X | X |
| 2 | X | | X | | | | X | X | X |
| 3 | X | | X | | X | X | X | X | X |
| 4 | X | | X | X | X | X | X | X | X |
| 5 | | | X | X | X | X | X | X | X |

Challenge Virus:
SARS-CoV-2/Canada/ON/VIDO-01/2020/Vero'76/p.2 (Seq. available at GISAID—EPI-ISL-413015)
Titer:
$1\times10^5$~ TCID50 100 μL dose
Dosage/Volume/Route:
$1\times10^5$ TCID50/100 μL dose/IN

TABLE 4

| Formulations | |
|---|---|
| *Lactobacillus reuteri* 3632 | |
| Appearance | Lyophilized cake |
| Antigen composition | *Lactobacillus reuteri* 3632 |
| Dosage/Volume/Route | TG03 - $5 \times 10^6$ CFU/0.25 mL oral gavage<br>TG04 - $5 \times 10^4$ CFU/0.25 mL oral gavage |
| *Lactobacillus reuteri* 3630 | |
| Appearance | Lyophilized cake |
| Antigen composition | *Lactobacillus reuteri* 3630 |
| Dosage/Volume/Route | TG03 - $5 \times 10^6$ CFU/0.25 mL oral gavage<br>TG04 - $5 \times 10^4$ CFU/0.25 mL oral gavage |

TABLE 4-continued

| Formulations | |
|---|---|
| *Bacillus amyloliquefaciens* | |
| Appearance | Lyophilized cake |
| Antigen composition | *B. amyloliquefaciens* |
| Dosage/Volume/Route | TG05 - $10^7$ CFU/0.5 ml/oral gavage |

On the morning of SD 0, all animals in groups TG02, 03, 04, and 05 are challenged. TG01 is not challenged.

TABLE 5

| Clinical scores are measured as follows. | |
|---|---|
| Weight Score | |
| 0 | weight gain, or loss 0-4.9% |
| 1 | 5 to 14.9% loss |
| 2 | at to 24.9% loss |
| 3 | greater than 25% loss |

TABLE 5-continued

| Clinical scores are measured as follows. | |
|---|---|
| Nasal Signs | |
| 0 | no symptoms |
| 1 | discharge on external nares |
| 2 | nasal rattling or sneezing |
| 3 | mouth breathing |
| Activity Level | |
| 0 | fully playful |
| 1 | responds to play but does not initiate play |
| 2 | alert but not playful |
| 3 | not playful, not alert |

Nasal washes are done by introducing 400 uL of sterile saline flushed into one naris while the runoff is collected directly into the collection tube from the other naris. A short nozzle teat infusion cannula attached to a 1 mL syringe is introduced into the naris in such a way that the naris is blocked by the diameter of the cannula, so the flush is forced to go into one nasal cavity and run out the other, rather than back flowing out.

Nasal washes are done on SD −2, 1, 3, and 5. The nasal washes are stored at −80° c. and is used for viral quantification by qRT-PCR and for cytokine analysis. Those samples that are positive for virus by qRT-PCR are used for virus isolation and titration (TCID50) by cell culture.

Blood samples are collected in EDTA on SD −7, −2, 1, 3, and 5. The blood volume collected in a week from an individual animal do not exceed 0.5 mL. unless that animal is being euthanized.

Blood samples, nasal wash, and full necropsy are done on all euthanized hamsters. Hamsters are deeply anesthetized with isoflurane for nasal wash as described above.

Samples of nasal turbinates and each lung lobe are collected for viral load, RNA, and histopathology. Lungs are weighed, photographed, and any pathology noted prior to collection of tissue.

Primary outcome determinants include body weight, clinical scores, virus titers, cytokine profile analysis, and histopathology.

Example 5

Clinical Outcome and Virus Shedding in a Hamster SARS-CoV-2 Challenge Model

The experimental conditions of Example 4 are duplicated with the additional step of administering a coronavirus viral protein (e.g., surface exposed protein) in conjunction with at least one of LR 3630 and LR 3632.

Example 6

Effect of Infectious Bronchitis Vaccine Dose and Probiotic Treatment on Protection Against Virulent Infectious Bronchitis in Specific Pathogen Free Chickens This study relates to the development and evaluation of probiotic products and probiotic vectored vaccines to 1) improve gut health, 2) address food borne diseases, 3) improve production traits, and 4) enhance immune responses to vaccines. The general objective of this study was to collect translational data to assist in improving general health and immune response to various vaccines in animals and humans.

Objectives of this study are to determine the influence of probiotics on immune response to sub-optimal doses of infectious bronchitis virus vaccine, and to determine the effect of probiotics on virulent infectious bronchitis challenge virus shedding in specific pathogen free chickens.

Prophylactic use of vaccines has greatly improved the animal welfare and production performance of animals. However general health status of the animal affects the immune response to various vaccines which indirectly influence the vaccine efficacy and/or duration of the protection.

Infectious bronchitis virus (IBV) vaccine is one of the most commonly used vaccines to prevent infectious bronchitis disease in chickens. Infectious bronchitis virus is an avian coronavirus. In general, most of the IBV vaccines are effective against homologous IBV virus induced disease but provide limited or no protection against heterologous virulent IBV. Under commercial production conditions, due to subclinical infection and gut health issue, it is not uncommon to see unsatisfactory immune response to IBV vaccine.

It has been shown that the appropriate use of relevant probiotics improves the gut microbiome which leads to improvement in gut health. It has also been shown that certain metabolites of probiotics improve both local and systemic immune response, cellular and humoral immunity, and have anti-microbial activities. This study is designed to further evaluate the effect of probiotics on IBV vaccine efficacy and challenge virus shedding.

The schedule of events for this study are provided in Table 6.

TABLE 6

| Schedule of Events | | |
|---|---|---|
| Study Date (SD) | Chicken Age (Days) | Activity |
| 0 | 0 | Specific Pathogen Free (SPF) chickens (105) arrive at day of age. At arrival birds will be released, tagged in the neck, vaccinated and/or probiotic administration according to Table 7. Extra birds will be euthanized. |
| 7-10 | 7-10 | Birds will be tagged via wing web. |
| 1-28 ± 2 | 1-28 ± 2 | Daily administration of probiotics in drinking water to groups 2, 3, 4 and 5 |
| 0-28 ± 2* | 0-28 ± 2 | Weekly health observations. |
| 26 ± 2 | 26 ± 2 | Blood samples collected from all groups (1-9) |
| 28 ± 2 | 28 ± 2 | Challenge groups 1 through 9. |
| 29 ± 2-33 ± 2 | 29 ± 2-3 ± 2 | Daily health observations of all chickens. |
| 33 ± 2 | 33 ± 2 | Necropsy (must be 5 days post-challenge) of all remaining birds |

*Perform weekly health observations after release of acclimation.

The treatment groups for the study are provided in Table 7.

TABLE 7

Treatment Groups.

| Group ID | Number of Chickens Enrolled | Vaccination/ Probiotic Treatment(s) | Vaccination/ Probiotic Route | Challenge (28 ± 2 DOA) | Challenge Volume/ Route | Necropsy (33 ± 2 DOA) |
|---|---|---|---|---|---|---|
| 1 | 10 | None | NA | IBV M41 | 60 μL total or 30 μL per eye/Ocular | 5 days post challenge |
| 2 | 10 | IBV at 3.8 $EID_{50}$/LR3632 + L R3630 | Spray/DW* | IBV M41 | 60 μL total or 30 μL per eye/Ocular | |
| 3 | 10 | IBV at 2.8 $EID_{50}$/LR3632 + L R3630 | Spray/DW* | IBV M41 | 60 μL total or 30 μL per eye/Ocular | |
| 4 | 10 | IBV at 1.8 $EID_{50}$/ LR3632 + LR3630 | Spray/DW* | IBV M41 | 60 μL total or 30 μL per eye/Ocular | |
| 5 | 10 | IBV at 0.8 $EID_{50}$/LR3632 + L R3630 | Spray/DW* | IBV M41 | 60 μL total or 30 μL per eye/Ocular | |
| 6 | 10 | IBV at 3.8 $EID_{50}$/ None | Spray/NA | IBV M41 | 60 μL total or 30 μL per eye/Ocular | |
| 7 | 10 | IBV at 2.8 $EID_{50}$/None | Spray/NA | IBV M41 | 60 μL total or 30 μL per eye/Ocular | |
| 8 | 10 | IBV at 1.8 $EID_{50}$/ None | Spray/NA | IBV M41 | 60 μL total or 30 μL per eye/Ocular | |
| 9 | 10 | IBV at 0.8 $EID_{50}$/ None | Spray/NA | IBV M41 | 60 μL total or 30 μL per eye/Ocular | |

NA—not applicable;
DW—drinking water;
*SD0-SD28 ± 2

Study Design

- Housing space requirements for SPF chickens:
  - 0 to 6 weeks of age=83 sq inches (0.6 square feet)
  - Isolators contain 1152 square inches of space.
  - Each isolator can hold 14 chicks until 6 weeks of age.
- A total of 105 (90 for enrollment and 15 extras) Specific Pathogen Free (SPF) chickens arrive at day of age (DOA) and the healthiest chicks will be distributed into nine treatment groups. Nine groups contain 10 birds per group (see Treatment Groups, Table 7). Remaining unused chickens are humanely euthanized. Discrepancies in chicken numbers are documented.
- On the day of arrival, birds are released from acclimation by site veterinarian and documented.
- After arrival and release for acclimation, birds were observed weekly until challenged then daily until the end of study and health observations were documented.
- Birds were vaccinated and/or treated with probiotics according to Table 7.
- Chickens are housed in isolators by group (one group per isolator).
- At 26±2 days of age, all chickens have blood drawn for serological testing.
- Chickens in treatment groups 1 through 9 were challenged with IBV Mass at 4 weeks of age by the ocular route (60 μL total chicken or 30 μL/eye).
- After challenge a health observation was performed every day until necropsy at 5 days post challenge.
- Five days post challenge (SD33±2), all surviving chickens are euthanized and necropsied:
  - Collect tracheal swabs from all surviving chickens in group 1-9 for IBV testing by PCR.
  - Dissect trachea from each chicken in groups 1-9. Place in a tube of 1.0 mL PBS, rock tube back and forth at least 5 times, remove trachea and retain PBS for microbiome sampling.
  - Collect ~2 cm section of trachea from each bird in groups 1-9 in buffered formalin for histology.

Animal Selection and Identification

Details on the animals for the study are provided in Table 8.

TABLE 8

Animal Selection and Identification

| | |
|---|---|
| Species: | *Gallus gallus* |
| Breed: | White Leghorn |
| Sex: | Mixed |
| Number of Animals: | 105 chickens (90 required and 15 extras for attrition). Discrepancies in chicken numbers are documented at arrival. |

TABLE 8-continued

| Animal Selection and Identification | |
|---|---|
| Age at arrival: | DOA |
| Source of the Animals: | Valo BioMedia |
| Animal Identification: | Chickens double tagged (neck tag on day of arrival and wing tag applied 7-10 days after arrival) |
| Immunological Status: | Specific Pathogen Free (SPF) |

Animal Management

Husbandry

All chickens were housed and cared for under the Guide for the Care and Use of Agricultural Animals in Research and Teaching and all local standard operating procedures Non-medicated feed was provided ad libitum. Poultry feed lot/batch numbers utilized within the duration of the study are recorded. Clean water is provided ad libitum. Feed and water containers are cleaned and replaced as needed.

The chickens are observed and cared for by animal care staff and observed daily for the first seven days and at least once weekly until challenge. After challenge, daily observations are conducted until time of necropsy. Observations are documented.

Any chicken exhibiting a health concern is noted accordingly. Birds found dead post-challenge are necropsied to determine the cause of death, samples are not required, but may be taken to determine the cause of death. Any chicken requiring veterinary attention is treated as deemed necessary and any treatment is documented.

Housing

Chickens are housed in isolators by group that are HEPA filtered in and out for containment. Environmental conditions are maintained and adjusted appropriately for their age, according to the Guide for the Care and Use of Agricultural Animals in Research and Teaching, 3rd Edition. Daily care and husbandry tasks are performed according to SOPs. Movements in primary housing due to facility, animal welfare, or study specific reasons after arrival are acceptable and are documented. Animal facilities are properly cleaned, disinfected, and set-up prior to animal arrival. Fogging of animal rooms prior to animal occupancy is completed per SOPs. Facility entry requirements and care order are maintained to minimize the risk of organism spread between groups and other site rooms/buildings.

Identification

Chickens have identification (ID) tags applied, each of the same number. One tag is applied to the skin at the back of the neck (at arrival) and the second tag is applied to the wing-web (7-10 days after arrival). If tag falls off and can be retrieved, they are re-applied. Identification completion will be documented.

Conditioning

Beak trimming may be required to mitigate pecking issues or negative behaviors. Trimming of the beaks is performed by a veterinarian or designee utilizing a hot blade beak trimmer (example: Lyon beak trimmer).

If mild pecking occurs (superficial), an anti-pecking spray or lotion is utilized to treat the affected area on the chicken. Mild pecking trauma may have first aid applied to areas of trauma. First aid treatments of Pick-No-More® or Blu Kote® are pre-approved. Treatment is documented.

Randomization Procedures

90 SPF chickens are identified by a wing and neck tag. Each chicken is tagged with a unique chicken identification (ID) number. Tag ID numbers are completely randomized and assigned to 9 treatment groups; 10 SPF chickens per treatment group (as outlined in Table 7). Treatment Groups are not randomized to housing unit as separation and care order needs to be maintained to prevent cross-contamination between groups. All randomizations are done Microsoft Excel®.

Blinding/Masking Method

Laboratory personnel (except Fort Dodge GO) involved with the testing of study samples are blinded from study treatment groups. All samples are labeled with the unique chicken ID but have no association to treatment.

Vaccination and Probiotic Treatment

Probiotic Information—the probiotic and strain information is detailed in Tables 9 (LR3630) and 10 (LR3632).

TABLE 9

| LR3630 | |
|---|---|
| Serial/Lot No: | 20200421-LBRT3630.01-GF |
| Appearance: | Lyophilized |
| Antigen composition: | *Lactobacillus reuteri* 3630 (10 doses/vial single probiotic) |
| Route/Volume: | Refer to Table 7 |
| Storage conditions: | 2-8° C. |

TABLE 10

| LR3632 | |
|---|---|
| Serial/Lot No: | 20200424-LBRT3632.01-GF |
| Appearance: | Lyophilized |
| Antigen composition: | *Lactobacillus reuteri* 3632 (20 doses/vial single probiotic) |
| Route/Volume: | Refer to Table 7 |
| Storage conditions: | 2-8° C. |

IBV Vaccine Information—the vaccine information is detailed in Table 11.

TABLE 11

| | |
|---|---|
| Serial/Lot No: | MILDVAC-Ma5 10,000 dose/vial (Merck (Intervet) Animal Health) |
| Appearance: | Lyophilized |
| Antigen composition: | IBV Mass. |
| Route/Volume: | Coarse Spray route: 70 μL/chicken (based on spray pattern in fixed area). |
| Storage conditions: | 2-8° C. |

Probiotic and Vaccine Preparation

Group 1—Birds in group 1 serve as no-treatment/challenge control and receive clean water during SD 0 to SD 33±2.

Group 2 through 5: Birds in group 2 through 5 receive various dilutions of IBV vaccine (3.8, 2.8, 1.8 and 0.8 $EID_{50}$/70 μL dose respectively) by coarse spray using a spray cabinet at day of age. $EID_{50}$ refers to the Egg (or Embryo) Infective Dose, or the amount of virus that will infect 50% of inoculated eggs. *Lactobacillus reuteri* 3632+3630 via drinking water during SD 0 to 28±2. The probiotic is made available as lyophilized cake and each vial contains 400 doses. Each vial (one of each probiotic) is Q.S.'d (quantum sufficit) to 100 ml with clean drinking water for 4 doses/mL (0.25 mL/bird/dose) dilution and volume is calculated of probiotic added to the bell waterer during the each probiotic treatment day and documented. The bulk re-hydrated probiotic can be used for all groups for that probiotic's water treatment.

Group 6 through 9: Birds in group 6 through 9 receive various dilutions of IBV vaccine (3.8, 2.8, 1.8 and 0.8 $EID_{50}$/70 μL dose respectively) by course spray using a spray cabinet at day of age.

All IVPs (probiotics) and IBV vaccine are carefully mixed periodically during use. All IVP and IBV vaccine administration are documented.

Vaccine and Probiotic Administration

Commercial vaccine is administered to DOA SPF chicks via coarse spray route and probiotic is administered via drinking water.

A commercial spray cabinet is utilized to administer vaccine to birds in treatment groups 2 through 9 by the coarse spray route: 70 μL per bird. Spray cabinet is designed for 100 birds vaccinated at 7.0 mL total (70 μL per bird), so birds are confined to approximately 20% (2 groups or 20 birds with corresponding vaccination rates) of the total area of the spray basket. After vaccination, birds are placed directly into the isolators with a heat lamp to encourage preening.

Drinking water administration of probiotics is administered daily from SD 0 to SD28±2 (day of challenge). Probiotics are prepared daily and placed into bell drinkers.

The IBV vaccine is carefully mixed periodically during use. All IVP (probiotics) and IBV vaccine administration is documented.

IBV Vaccine Titration

The IBV commercial vaccine is titrated in 9-day-old embryonated SPF eggs by the allantoic fluid inoculation method. On day of vaccination at least three replicates of 1:10 fold serial dilutions of the virus are performed. Each dilution is used to inoculate at least 6 eggs per dilution, 0.1 mL per egg. Eggs are candled at 24 hours post-inoculation to remove infertile and dead eggs. Eggs are candled 7 days post inoculation and the live/dead documented. On the $7^{th}$ day post-inoculation, eggs are euthanized by refrigeration (minimum of 2-4 hours) and then examined individually for signs of disease including stunting, curling, clubbed down, and urates. Titration results are calculated by Reed Muench method. Titration procedure will be documented and included in the SMF.

Challenge

Challenge Information—information on the avian infectious bronchitis virus strain is provided in Table 12.

TABLE 12

| Avian Infectious Bronchitis Virus M41 Strain | |
|---|---|
| Serial/Lot No: | 4073-023-24Mar2018 |
| Titer: | 6.70 $\log_{10}$ $EID_{50}$/mL |
| Appearance: | Straw yellow looking in color |
| Antigen composition: | Infectious Bronchitis Virus M41 strain |
| Dosage/Volume/Route: | 4.0 $\log_{10}$ $EID_{50}$/mL, 60 μL/bird, Ocular |
| Storage conditions: | −70° C. or colder |

Challenge Virus Preparation

On day of challenge, the IBV M41 challenge virus is thawed rapidly in a 37±2° C. water bath and diluted in Phosphate Buffered Saline (PBS) to the target dose of 4.0 $\log_{10}$ $EID_{50}$/mL. Preparation of challenge virus is documented appropriately. Following challenge preparation, the IBV M41 challenge virus is placed on wet ice for transport to the animal facilities.

Challenge Virus Titration

The IBV M41 challenge virus is titrated in 9-day-old embryonated SPF eggs by the allantoic fluid inoculation method. On day of challenge at least three replicates of 1:10 fold serial dilutions of the challenge virus are performed. Each dilution is used to inoculate at least 6 eggs per dilution, 0.1 mL per egg. Eggs are candled at 24 hours post-inoculation to remove infertile and dead eggs. Eggs are candled 7 days post inoculation and the live/dead documented. On the $7^{th}$ day post-inoculation, eggs are euthanized by refrigeration (minimum of 2-4 hours) and then examined individually for signs of disease including stunting, curling, clubbed down, and urates. Titration results are calculated by Reed Muench method. Titration procedure is documented.

Challenge Virus Administration

On SD 28±2, at 4-weeks-of-age, each bird from all treatment groups is challenged with 60 μL per bird (30 μL per eye) of IBV M41 challenge virus. Challenge is administered using a micropipette with sterile tip. Ocular inoculation is performed by trained individuals to ensure the challenge is completely absorbed into each eye. Challenge virus administration is documented.

Post Challenge Observations

Clinical staff (Veterinarians, Clinical Associates, Veterinary Technician or designee) observe chickens daily post-challenge until necropsy (SD 29±2 through SD33±2). Clinical signs of IBV may include: coughing, sneezing, tracheal rales, depression, ruffled feathers, inappetence, huddling, wet or watery feces, and reluctance to move/rise. If a chicken exhibits a health concern, it is noted. Pre-mortality examination findings are documented. Health concern evaluations are documented.

A veterinarian humanely euthanizes, if necessary, and necropsy the chicken to determine the cause. If clinical signs are present at necropsy, clinically relevant samples may be collected, submitted for testing or stored appropriately (frozen or in neutral buffered formalin). Necropsy and deposition of animals are documented.

Sample Collection, Processing, and Testing

Blood Samples

On SD 26±2 (1-2 days before challenge), approximately 1 mL of blood sample is collected from the brachial vein using a 20-25 gauge needle and appropriately sized syringe. Blood is transferred to a serum tube or serum separator tube and allowed to coagulate. All blood collection information is recorded.

Following coagulation, blood samples are centrifuged up to 3000×g for 10-20 minutes. Samples are processed and serum collected within 24 hours of blood collection. Serum samples collected from each bird is separated into at least two aliquots. One or more aliquots may contain 120 μL or greater of serum for sample testing and the remaining aliquots placed for long-term storage. Serum samples are stored at ≤−10° C. An aliquoted sample from each bird is sent for IBV ELISA (Enzyme Linked Immunosorbent Assay).

Tracheal Swabs

Tracheal swabs are collected from each bird from groups 1-9 at 5 days post challenge at necropsy (SD33±2). Following collection, swab samples are transferred to a collection tube containing 3 ml of PBS and frozen at or below −10° C. The IBV viral nucleotides are purified. PCR detection of IBV is completed.

Tracheal Washing for Microbiome Analysis

Dissect trachea from each bird and place in a cryotube with 1.0 mL of PBS (phosphate buffered saline), rock the vial back and forth at least 5 times and retain the rinse in a cryotube and store at −60° C. or below for microbiome analysis. The trachea is removed and used for further sampling for histopathology. Samples are documented and tested as needed.

Trachea for Histopathology

Approximately 2 cm long section of trachea are collected from each bird on SD 33±2 in buffered formalin. Samples are documented.

Adverse Events (AE)

An adverse event (includes all associated terms) is any observation in animals, whether or not considered to be product-related, that is unfavorable and unintended and occurs after the use of an investigational veterinary product. In a commercial poultry production setting and with previous experiences, the following health conditions are common and expected, as outlined below. For the purpose of this study, these types of events are considered non-serious adverse events until the incidence exceeds the thresholds listed in any Treatment Group administered an investigational product.

TABLE 13

Thresholds
Thresholds for SPF Chickens in General (expected occurrences)

| Condition | Incidence | Threshold |
|---|---|---|
| Early Mortality | 5-10% | 10% |
| Pecking | 0-80% | 80% |
| Non-absorbed yolk sac | 10-20% | 20% |
| Foot/Leg abnormalities | 10-20% | 20% |
| Navel infection | 10-20% | 20% |
| Pendulous Crop | 10-20% | 20% |
| Eye abnormalities | 5-10% | 10% |

Clinical Symptoms Associated with Infectious Bronchitis Virus:

Mortality, depression (hunched back, ruffled feathers), conjunctivitis, cough, sneezing, dyspnea, wet droppings, and vent pecking occurring post-challenge are to be expected and are not considered adverse events.

Statistical Analysis

The primary outcome is presented as categorical variable; positive or negative for IBV in tracheal swabs. Secondary variable include serum IBV titers, and trachea histopathological finding. Summary statistics for all categorical variables are reported as frequencies and percentages. All analyses are conducted per-protocol with the provision that additional statistical methods may be used to further define the nature of the endpoints and/or study variables if deemed necessary; all methods will be documented.

Results

This study was designed to evaluate the effects of a combination of probiotic *Lactobacillus reuteri* strains LR3632 and LR3630 after administration of suboptimal doses of avian coronavirus IBV vaccine. Results from the study are tabulated below in Table 14. Administration of vaccine dose at 2.8 $EID_{50}$ or 3.8 $EID_{50}$ was required in both the probiotic treated and untreated groups for any chickens to test positive for seroconversion. Probiotic Treated Group 3 showed a slightly increased fraction of animals seroconverted (70%) with suboptimal dose of 2.8×$EID_{50}$ compared to the untreated Group 7 (50%) with the same suboptimal dose of vaccine. At a higher dose of 3.8×$EID_{50}$ the treated and untreated were more similar in seroconversion rate. In this study, none of the animals (untreated or probiotic treated) showed vaccine response and seroconversion at the lowest suboptimal vaccine doses of 1.8× and 0.8×$EID_{50}$.

TABLE 14

| Sample # | Chicken ID# | Raw OD | S/P Ratio | Titer | Titer Grp | Result | GROUP | Admin | Fraction Animals Seroconverted |
|---|---|---|---|---|---|---|---|---|---|
| 7 | 217 | 0.181 | 0.024 | 100 | 0 | neg | 1 | n/a | n/a |
| 13 | 223 | 0.17 | 0 | 1 | 0 | neg | 1 | n/a | n/a |
| 14 | 224 | 0.176 | 0.01 | 42 | 0 | neg | 1 | n/a | |
| 19 | 229 | 0.181 | 0.024 | 100 | 0 | neg | 1 | n/a | n/a |
| 33 | 243 | 0.178 | 0.015 | 63 | 0 | neg | 1 | n/a | |
| 36 | 247 | 0.179 | 0.018 | 75 | 0 | neg | 1 | n/a | |
| 51 | 263 | 0.226 | 0.15 | 625 | 0 | neg | 1 | n/a | |
| 60 | 272 | 0.18 | 0.021 | 88 | 0 | neg | 1 | n/a | |
| 69 | 281 | 0.174 | 0.004 | 17 | 0 | neg | 1 | n/a | |
| 75 | 287 | 0.17 | 0 | 1 | 0 | neg | 1 | n/a | |
| 3 | 213 | 0.433 | 0.732 | 3051 | 3 | pos | 2 | 3.8 + PRO | 0.60 |
| 9 | 219 | 0.268 | 0.268 | 1117 | 1 | pos | 2 | | |
| 24 | 234 | 0.297 | 0.35 | 1459 | 1 | pos | 2 | | |
| 32 | 242 | 0.267 | 0.265 | 1105 | 1 | pos | 2 | | |
| 39 | 250 | 0.306 | 0.375 | 1563 | 1 | pos | 2 | | |
| 45 | 256 | 0.209 | 0.103 | 429 | 0 | neg | 2 | | |
| 47 | 259 | 0.241 | 0.192 | 800 | 0 | neg | 2 | | |
| 71 | 283 | 0.221 | 0.136 | 567 | 0 | neg | 2 | | |
| 80 | 292 | 0.286 | 0.319 | 1330 | 1 | pos | 2 | | |
| 82 | 294 | 0.221 | 0.136 | 567 | 0 | neg | 2 | | |
| 22 | 232 | 0.31 | 0.386 | 1609 | 1 | pos | 3 | 2.8 + PRO | 0.70 |
| 23 | 233 | 0.297 | 0.35 | 1459 | 1 | pos | 3 | | |
| 28 | 238 | 0.313 | 0.395 | 1647 | 1 | pos | 3 | | |
| 31 | 241 | 0.379 | 0.58 | 2418 | 2 | pos | 3 | | |
| 44 | 255 | 0.267 | 0.265 | 1105 | 1 | pos | 3 | | |
| 50 | 262 | 0.232 | 0.167 | 696 | 0 | neg | 3 | | |
| 57 | 269 | 0.226 | 0.15 | 625 | 0 | neg | 3 | | |
| 63 | 275 | 0.279 | 0.299 | 1246 | 1 | pos | 3 | | |
| 66 | 27 | 0.268 | 0.268 | 1117 | 1 | pos | 3 | | |
| 70 | 282 | 0.224 | 0.145 | 604 | 0 | neg | 3 | | |
| 34 | 244 | 0.197 | 0.069 | 288 | 0 | neg | 4 | 1.8 + PRO | |
| 35 | 246 | 0.173 | 0.001 | 4 | 0 | neg | 4 | | |

TABLE 14-continued

| Sample # | Chicken ID# | Raw OD | S/P Ratio | Titer | Titer Grp | Result | GROUP | Admin | Fraction Animals Seroconverted |
|---|---|---|---|---|---|---|---|---|---|
| 38 | 249 | 0.176 | 0.01 | 42 | 0 | neg | 4 | | |
| 40 | 251 | 0.189 | 0.046 | 192 | 0 | neg | 4 | | |
| 48 | 260 | 0.192 | 0.055 | 229 | 0 | neg | 4 | | |
| 49 | 261 | 0.171 | 0 | 1 | 0 | neg | 4 | | |
| 53 | 265 | 0.206 | 0.094 | 392 | 0 | neg | 4 | | |
| 65 | 277 | 0.201 | 0.08 | 333 | 0 | neg | 4 | | |
| 72 | 284 | 0.18 | 0.021 | 88 | 0 | neg | 4 | | |
| 5 | 215 | 0.201 | 0.08 | 333 | 0 | neg | 5 | 0.8 + PRO | |
| 10 | 220 | 0.176 | 0.01 | 42 | 0 | neg | 5 | | |
| 16 | 226 | 0.192 | 0.055 | 229 | 0 | neg | 5 | | |
| 25 | 235 | 0.182 | 0.027 | 113 | 0 | neg | 5 | | |
| 52 | 264 | 0.193 | 0.058 | 242 | 0 | neg | 5 | | |
| 54 | 266 | 0.187 | 0.041 | 171 | 0 | neg | 5 | | |
| 56 | 268 | 0.201 | 0.08 | 333 | 0 | neg | 5 | | |
| 77 | 289 | 0.218 | 0.128 | 534 | 0 | neg | 5 | | |
| 78 | 290 | 0.197 | 0.069 | 288 | 0 | neg | 5 | | |
| 81 | 293 | 0.186 | 0.038 | 158 | 0 | neg | 5 | | |
| 2 | 212 | 0.302 | 0.364 | 1517 | 1 | pos | 6 | 3.8 | 0.80 |
| 11 | 221 | 0.295 | 0.344 | 1434 | 1 | pos | 6 | | |
| 15 | 225 | 0.236 | 0.178 | 742 | 0 | neg | 6 | | |
| 26 | 236 | 0.284 | 0.313 | 1305 | 1 | pos | 6 | | |
| 29 | 239 | 0.443 | 0.76 | 3168 | 3 | pos | 6 | | |
| 30 | 240 | 0.317 | 0.406 | 1692 | 1 | pos | 6 | | |
| 41 | 252 | 0.304 | 0.369 | 1538 | 1 | pos | 6 | | |
| 55 | 267 | 0.287 | 0.322 | 1342 | 1 | pos | 6 | | |
| 62 | 274 | 0.206 | 0.094 | 392 | 0 | neg | 6 | | |
| 64 | 276 | 0.307 | 0.378 | 1576 | 1 | pos | 6 | | |
| 4 | 214 | 0.238 | 0.184 | 767 | 0 | neg | 7 | 2.8 | 0.50 |
| 18 | 228 | 0.212 | 0.111 | 463 | 0 | neg | 7 | | |
| 27 | 237 | 0.397 | 0.631 | 2630 | 2 | pos | 7 | | |
| 37 | 248 | 0.206 | 0.094 | 392 | 0 | neg | 7 | | |
| 43 | 254 | 0.272 | 0.279 | 1163 | 1 | pos | 7 | | |
| 59 | 271 | 0.29 | 0.33 | 1376 | 1 | pos | 7 | | |
| 73 | 285 | 0.25 | 0.218 | 909 | 1 | pos | 7 | | |
| 76 | 288 | 0.323 | 0.423 | 1763 | 1 | pos | 7 | | |
| 83 | 297 | 0.204 | 0.088 | 367 | 0 | neg | 7 | | |
| 85 | 300 | 0.183 | 0.029 | 121 | 0 | neg | 7 | | |
| 1 | 211 | 0.172 | 0 | 1 | 0 | neg | 8 | 1.8 | |
| 17 | 227 | 0.182 | 0.027 | 113 | 0 | neg | 8 | | |
| 20 | 230 | 0.173 | 0.001 | 4 | 0 | neg | 8 | | |
| 21 | 231 | 0.222 | 0.139 | 579 | 0 | neg | 8 | | |
| 42 | 253 | 0.188 | 0.044 | 183 | 0 | neg | 8 | | |
| 58 | 270 | 0.179 | 0.018 | 75 | 0 | neg | 8 | | |
| 61 | 273 | 0.174 | 0.004 | 17 | 0 | neg | 8 | | |
| 67 | 279 | 0.187 | 0.041 | 171 | 0 | neg | 8 | | |
| 79 | 291 | 0.196 | 0.066 | 275 | 0 | neg | 8 | | |
| 84 | 298 | 0.187 | 0.041 | 171 | 0 | neg | 8 | | |
| 6 | 216 | 0.187 | 0.041 | 171 | 0 | neg | 9 | 0.8 | |
| 8 | 218 | 0.19 | 0.049 | 204 | 0 | neg | 9 | | |
| 12 | 222 | 0.181 | 0.024 | 100 | 0 | neg | 9 | | |
| 46 | 258 | 0.185 | 0.035 | 146 | 0 | neg | 9 | | |
| 68 | 280 | 0.19 | 0.049 | 204 | 0 | neg | 9 | | |
| 74 | 286 | 0.17 | 0 | 1 | 0 | neg | 9 | | |

Example 7

*Lactobacillus* Probiotic Strains Impact on Lung Health

The in vivo effect of administration of *Lactobacillus reuteri* strains 3632 and 3620 for coronavirus challenge was evaluated in poultry. The immunobiotic effect of two *Lactobacillus reuteri* strains, LR3632 and LR3630, was evaluated in an avian coronavirus/infectious bronchitis (IB) virus model. The *L retueri* strains were evaluated in comparison to a *Bacillus amyloliquefaciens* strain.

Figure 6:
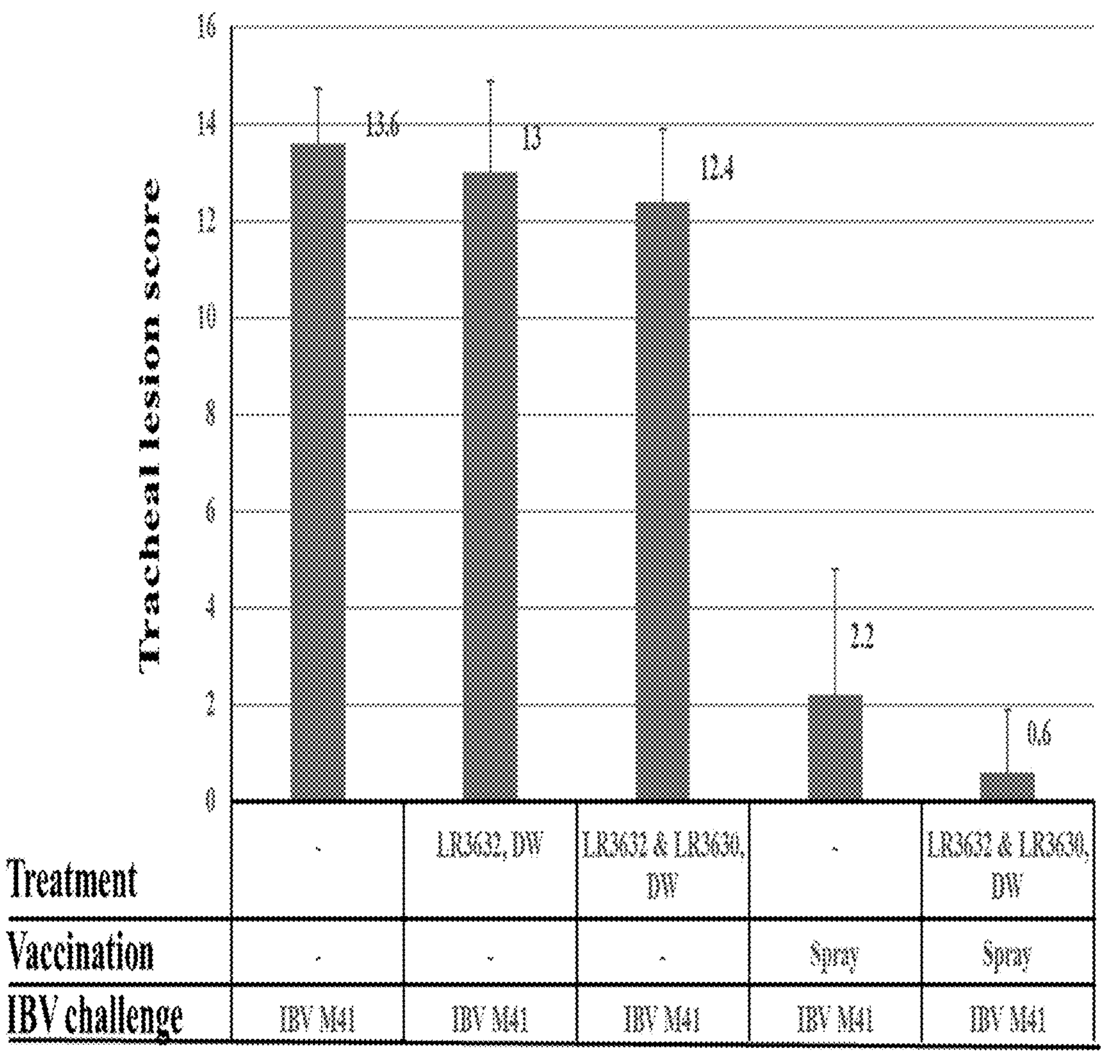
FIG. 6 depicts the effect of *L. reuteri* treatment on tracheal lesion score. Tracheal lesion score is measured and indicated on a scale of 0 to 16. Treatment (none (-), LR3632 in daily water (DW), LR3632 and LR3630 DW); Vaccination (none (-) or spray IBV); and IBV challenge (IBV M41 strain) is indicated below each tabulated result.

Day old IB vaccinated (IBV) birds+/−*Lactobacillus reuteri* (LR3632 and LR3630)+/−*Bacillus amyloliquefaciens* were challenged with IB virus on day 28. The tracheal lesion score was determined for animals treated with no administration or treated with LR3632 in daily water (DW) or LR3632 and LR3630 DW. The results are depicted in FIG. 6. Tracheal lesions were somewhat reduced with LR3632 alone and more significantly reduced with LR3632 and LR3630 in combination. LR3632 and LR3630 in combination provided reduced lesion scores even with IBV challenge versus no probiotic administration.

Figure 7:
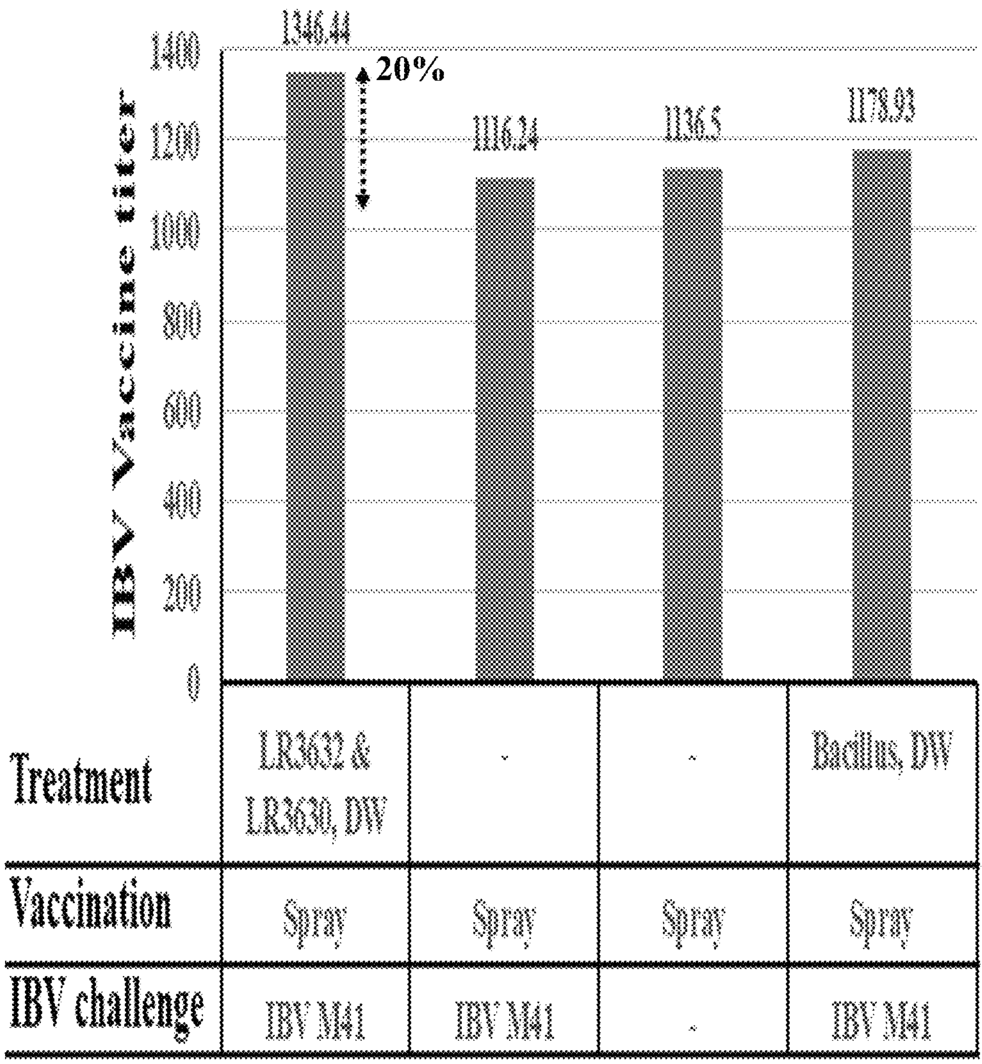
FIG. 7 depicts the effect of *L. reuteri* treatment on infectious bronchitis vaccine serology. IBV vaccine titer is measured on a scale of 0 to 1400. Treatment (none (-), LR3632 and LR3630 in daily water (DW), *Bacillus amyloliquefaciens* DW; Vaccination spray IBV; and IBV challenge (none (-) or IBV M41 strain) is indicated below each tabulated result. A 20% increase in titer with treatment LR3632 and LR3630, DW versus None (-) is indicated.

Immune response to vaccine was measured serologically using an IB specific ELISA at day 33. The effect of *L. reuteri* treatment is depicted in FIG. 7. IBV vaccine titer is measured on a scale of 0 to 1400. A 20% increase in titer was observed when animals were treated with/administered LR3632 and LR3630 DW versus controls (no treatment or administration or administered a *Bacillus amyloliquefaciens* strain.

Figure 8:
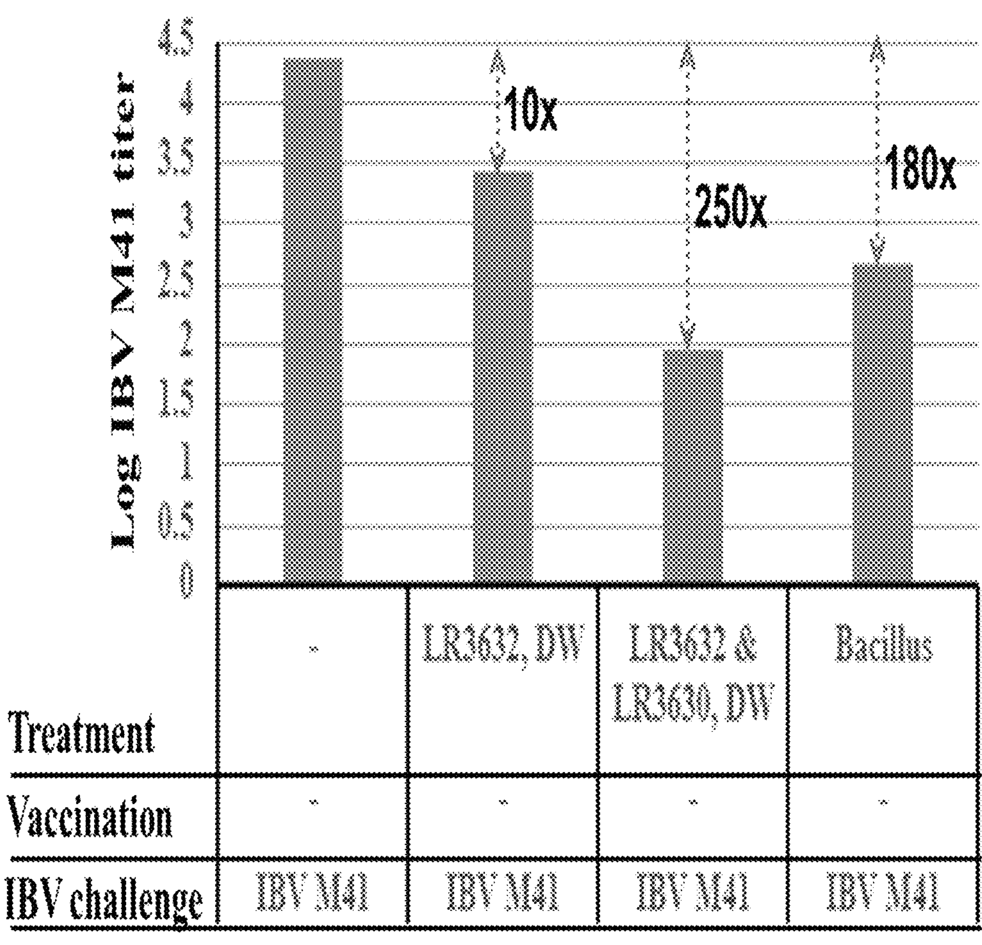
FIG. 8 depicts effect of *L. reuteri* treatment on IBV fecal viral shedding. Log IBV M41 titer is indicated on a scale of 0 to 4.5. Treatment (none (-), LR3632 in daily water (DW), LR3632 and LR3630 DW, *Bacillus amyloliquefaciens* DW; Vaccination spray IBV all None (-); and IBV challenge with IBV M41 strain is indicated below each tabulated result. Titer reductions of 10×, 250× and 180× are indicated. The combination of LR3632 and LR3630 DW provides a 250× decrease in IBV fecal viral shedding as assessed by IBV viral titer in feces.

Fecal infectious viral load was measured using quantitative PCR (qPCR). The results and Log IBV M41 titer are shown in FIG. 8. The combination of LR3632 and LR3630

DW provides a 250× decrease in IBV fecal viral shedding as assessed by IBV viral titer in feces. LR3632 reduced fecal viral shedding 10×. *Bacillus amyloliquefaciens* strain also reduced fecal virus shedding significantly.

Figure 9:
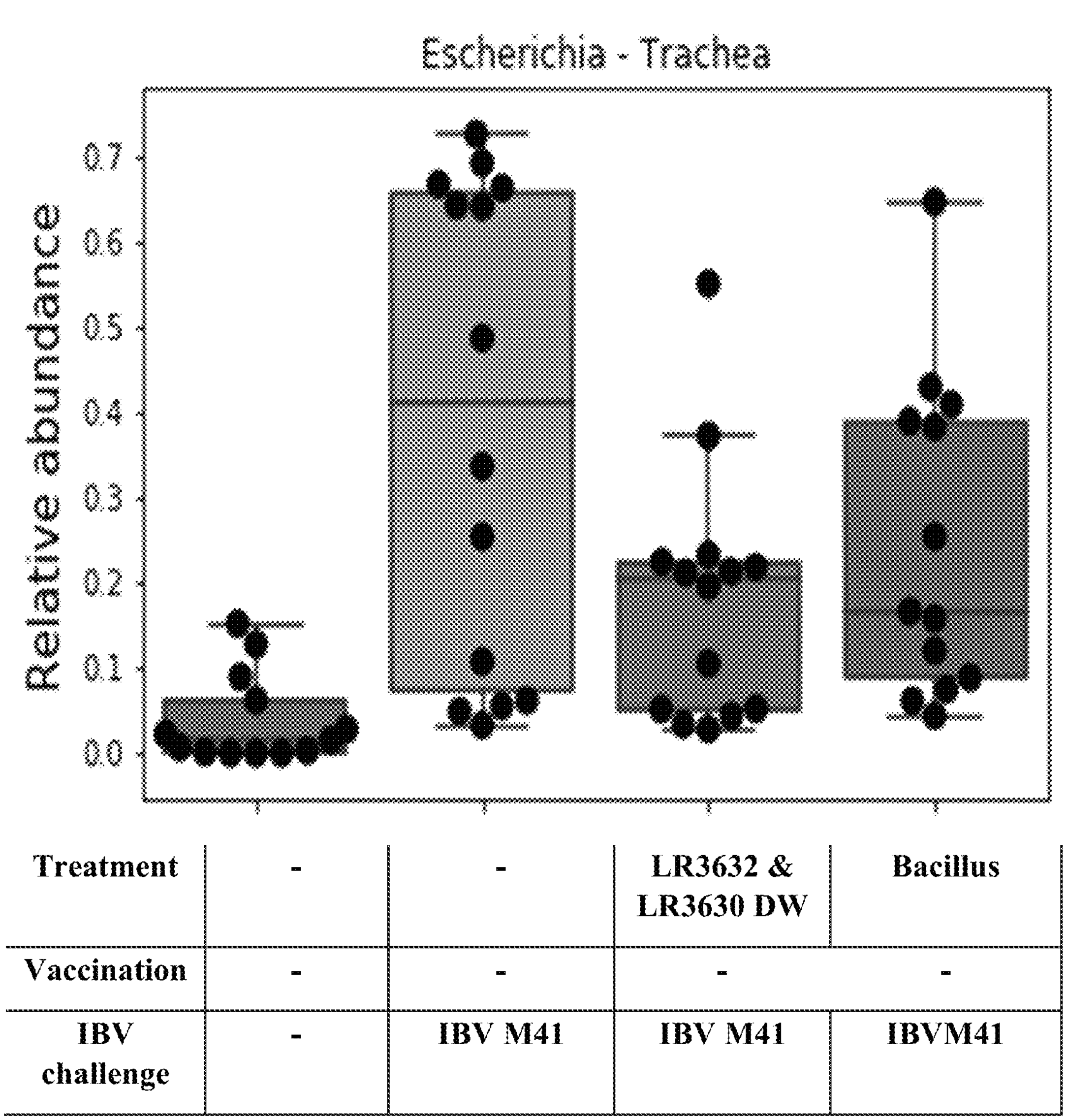
FIG. 9 depicts effect of *L. reuteri* treatment on tracheal microbiome. Relative abundance of *Escherichia* bacteria in trachea is indicated on a scale of 0.0 to 0.7. Treatment (none (-), LR3632 and LR3630 DW, *Bacillus amyloliquefaciens* DW; Vaccination spray IBV all None (-); and IBV challenge (None (-) or with IBV M41 strain) is indicated below each tabulated result.

Tracheal lesion and microbiome were evaluated. Relative abundance of *Escherichia* bacteria in trachea is depicted in FIG. 9 with no treatment or administration, a combination of LR strains 3632 and 3630, or *Bacillus amyloliquefaciens* strain. Upon challenge with IBV M41, the untreated animals had a significant increase in relative abundance of *Escherichia* in trachea, showing an altered microbiome. This is significantly reduced and controlled in poultry treated with or administered a combination of LR3632 and LR3630. *Bacillus* administered animals also showed a reduced microbiome alteration but not as significant as in the animals administered a combination of the LR3632 and LR3630 strains.

Figure 10:
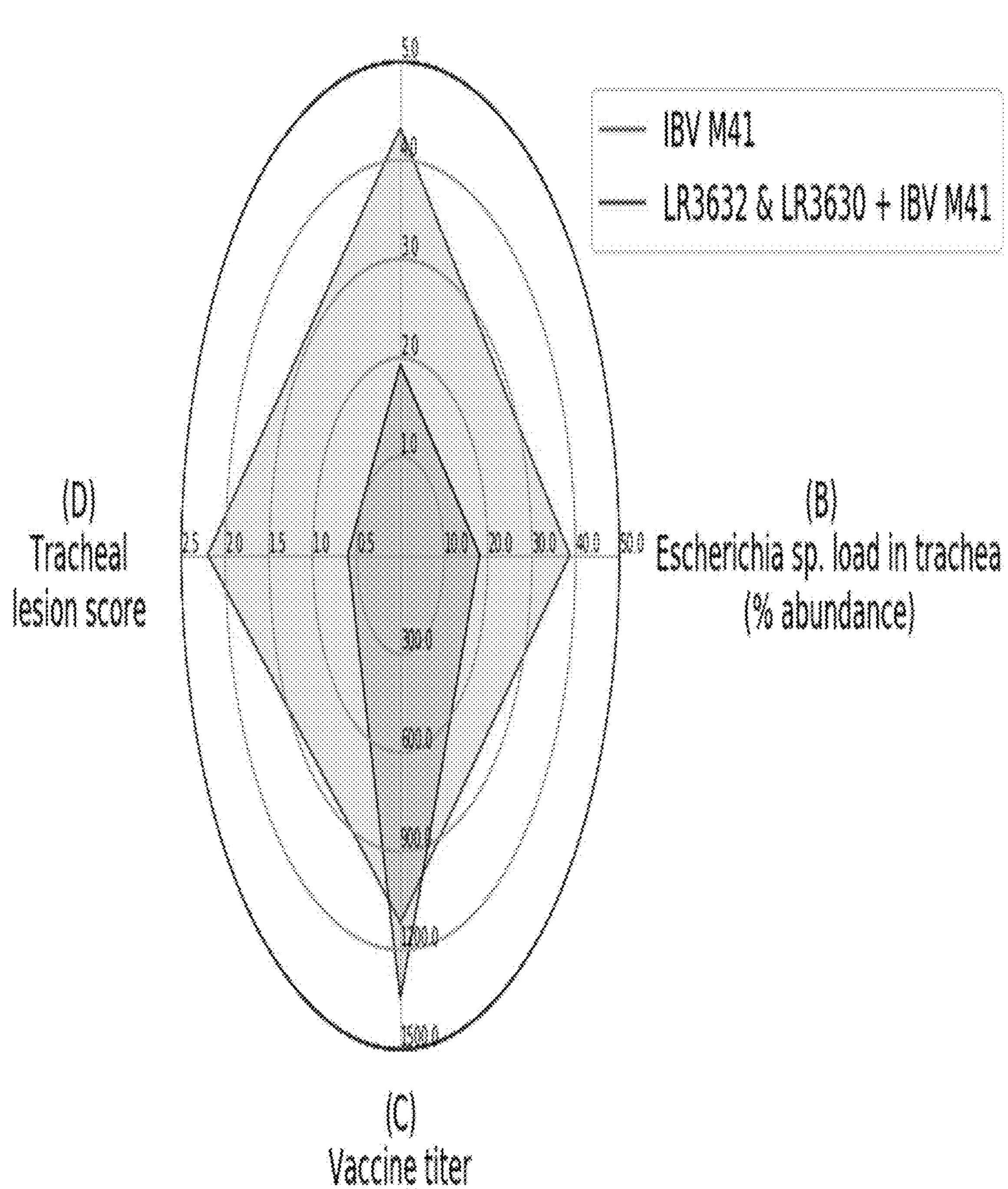
FIG. 10 depicts a graphical presentation of *Lactobacillus* impact on lung health and in vivo effect of probiotic strains LR3632 and LR3630 with coronavirus (IB) challenge in poultry. The Log 10 fecal viral shedding (A), the *Escherichia* sp. Load in trachea (B), the vaccine titre (C) and tracheal lesion score (D) are each depicted in a noted section of the graphical presentation. Scores or values with IBV M41 challenge alone and no treatment/administration of strains are indicated in red. Scores or values with IBV M41 challenge alone and prior treatment/administration of LR3632 and LR3630 strains are indicated in blue.

Overall, these studies demonstrate a reduction in viral load, positive impact on the respiratory tract microbiome, improvement in antibody titer and significant reduction of tracheal lesions in animals (poultry) administered a combination of *L. reuteri* strains LR3632 and LR3630. The overall results are depicted in a combined graphical presentation in FIG. 10. The combination of probiotic strains LR3632 and LR3630 administered along with a coronavirus vaccine in this in vivo poultry study showed improved outcomes across key metrics. The strains also had a material standalone impact on improving immunity in animals across all the metrics measured in the study.

Specific Embodiments

1. A method of stimulating an immune response in a subject, said method comprising: administering an effective amount of an immunogenic probiotic composition comprising at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO: 1-55, and optionally, an infectious respiratory disease vaccine to a subject.
2. The method according to embodiment 1, said method comprising administering an infectious respiratory disease vaccine.
3. The method according to any one of embodiments 1-2, wherein the at least one *Lactobacillus reuteri* strain comprises at least one sequence selected from SEQ ID NO: 1-24, 26, and 49-55; and sequences having at least 98%, at least 98.5%, at least 99%, or at least 99.5% sequence identity with at least one of SEQ ID NO: 1-24, 26, and 49-55.
4. The method according to any one of embodiments 1-3, wherein the at least one *Lactobacillus reuteri* strain comprises at least one sequence selected from SEQ ID NO: 25, 27-43, and 44-48; and sequences having at least 98%, at least 98.5%, at least 99%, or at least 99.5% sequence identity with at least one of SEQ ID NO: 25, 27-43, and 44-48.
5. The method according to any one of embodiments 1-4, wherein the at least one *Lactobacillus reuteri* strain comprises an isolated first *Lactobacillus reuteri* strain comprising at least one sequence selected from SEQ ID NO: 1-24, 26, and 49-55, and an isolated second *Lactobacillus reuteri* strain comprising at least one sequence selected from SEQ ID NO: 25, 27-43, and 44-48.
6. The method according to any one of embodiments 1-5, wherein the at least one *Lactobacillus reuteri* strain comprises an isolated first *Lactobacillus reuteri* strain comprising SEQ ID NO: 49 and an isolated second *Lactobacillus reuteri* strain comprising SEQ ID NO: 44.
7. The method according to any one of embodiments 1-6, wherein the at least one *Lactobacillus reuteri* strain comprises an isolated first *Lactobacillus reuteri* strain comprising a genomic sequence as set out in any of SEQ ID NOs: 49-55 or a sequence having at least 98% or 99% or 99.5% identity to a sequence of SEQ ID NOs: 49-55 and an isolated second *Lactobacillus reuteri* strain comprising a genomic sequence as set out in any of SEQ ID NOs: 44-48 or a sequence having at least 98% or 99% or 99.5% identity to a sequence of SEQ ID NOs: 44-48.
8. The method according to any one of embodiments 1-7, wherein the at least one *Lactobacillus reuteri* strain is selected from *Lactobacillus reuteri* 3630 and *Lactobacillus reuteri* 3632.
9. The method according to any one of embodiments 1-8, wherein the at least one *Lactobacillus reuteri* strain comprises at least one of strain 3630 deposited with ATCC under patent deposit number PTA-126787 and strain 3632 deposited with ATCC under patent deposit number PTA-126788.
10. The method according to any one of embodiments 1-9, wherein the at least one *Lactobacillus reuteri* strain comprises an isolated first *Lactobacillus reuteri* strain 3632 deposited with ATCC under patent deposit number PTA-126788 comprising a genomic sequence as set out in strain PTA-126788 or a sequence having at least 98% or 99% or 99.5% identity to the genomic sequence of strain PTA-126788 and an isolated second *Lactobacillus reuteri* strain 3630 deposited with ATCC under patent deposit number PTA-126787 comprising a genomic sequence as set out in strain PTA-126787 or a sequence having at least 98% or 99% or 99.5% identity to the genomic sequence of strain PTA-126787.
11. The method according to any one of embodiments 1-10, wherein the composition comprises two *Lactobacillus reuteri* strains; and the ratio of strains is approximately 0.75-1.5:1.
12. The method according to any one of embodiments 1-11, wherein the composition comprises two *Lactobacillus reuteri* strains; and the strains are present in about equal amounts in the composition.
13. The method according to any one of embodiments 1-12, wherein said composition does not comprise a *bacillus* strain.
14. The method according to any one of embodiments 1-13, wherein said composition does not comprise *Lactobacillus buchneri, Lactobacillus plantarum, Lactobacillus gasseri, Lactobacillus johnsonii, Lactobacillus acidophilus, Lactobacillus rhamnosus, Lactobacillus paracasei*, or *Lactobacillus animalis.*
15. The method according to any one of embodiments 1-14, wherein said composition does not comprise recombinant bacteria.
16. The method according to any one of embodiments 1-15, wherein the immunogenic probiotic composition is formulated as animal feed, feed additive, food ingredient, water additive, water-mixed additive, consumable solution, consumable spray additive, consumable solid, consumable gel, injection, or combinations thereof.

17. The method according to any one of embodiments 1-16, wherein the immunogenic probiotic composition is formulated as an animal feed.

18. The method according to any one of embodiments 1-17, wherein the infectious respiratory disease vaccine is a viral vaccine.

19. The method according to any one of embodiments 1-18, wherein the infectious respiratory disease vaccine is a coronavirus vaccine, an influenza virus vaccine, an adenovirus vaccine, a parainfluenza virus vaccine, a herpesvirus vaccine, a cytomegalovirus vaccine, a respiratory syncytial vaccine, or a pneumovirus vaccine.

20. The method according to any one of embodiments 1-19, wherein the infectious respiratory disease vaccine is a coronavirus vaccine.

21. The method according to embodiment 20, wherein the coronavirus is a human coronavirus or a non-human coronavirus.

22. The method according to embodiment 21, wherein the coronavirus is a human coronavirus selected from SARS COV-2, SARS COV, MERS COV, 229E, NL63, OC43, and HKU1.

23. The method according to embodiment 21, wherein the coronavirus is a non-human coronavirus selected from infectious bronchitis virus (IBV), canine coronavirus, and feline coronavirus.

24. The method according to embodiment 23, wherein the infectious respiratory disease vaccine comprises infectious bronchitis virus (IBV) vaccine.

25. The method according to any one of embodiments 1-19, wherein the infectious respiratory disease vaccine is a Porcine Reproductive and Respiratory Syndrome (PRRS) vaccine.

26. The method according to any one of embodiments 1-19, wherein the infectious respiratory disease vaccine comprises a live attenuated vaccine, inactivated vaccine, or subunit vaccine.

27. The method according to any one of embodiments 1-19, wherein the infectious respiratory disease vaccine comprises an mRNA vaccine.

28. The method according to any one of embodiments 1-27, wherein the immunogenic probiotic composition is formulated as an animal feed, animal feed additive, water additive, or consumable spray additive.

29. The method according to any one of embodiments 1-28, wherein the immunogenic probiotic composition is administered orally and the vaccine is administered by inhalation route.

30. The method according to any one of embodiments 1-29, wherein the immunogenic probiotic composition is administered orally and the vaccine is administered by parenteral route.

31. The method according to any one of embodiments 1-30, further comprising increasing antibody titer.

32. The method according to embodiment 31, wherein the antibody titer is increased by at least 5%, at least 10%, at least 25%, at least 50%, at least 75%, or at least 100%, as compared to a subject not administered the immunogenic probiotic composition.

33. A method of vaccinating a subject for an infectious respiratory disease, said method comprising administering an effective amount of an immunogenic probiotic composition comprising at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO:1-55, and an infectious respiratory disease vaccine to a subject.

34. The method according to embodiment 33, wherein the at least one *Lactobacillus reuteri* strain comprises an isolated first *Lactobacillus reuteri* strain comprising SEQ ID NO: 44, and an isolated second *Lactobacillus reuteri* strain comprising SEQ ID NO: 49.

35. The method according to any one of embodiments 33-34, wherein the at least one *Lactobacillus reuteri* strain comprises an isolated first *Lactobacillus reuteri* strain comprising a genomic sequence as set out in any of SEQ ID NOs: 49-55 or a sequence having at least 98% or 99% or 99.5% identity to a sequence of SEQ ID NOs: 49-55 and an isolated second *Lactobacillus reuteri* strain comprising a genomic sequence as set out in any of SEQ ID NOs: 44-48 or a sequence having at least 98% or 99% or 99.5% identity to a sequence of SEQ ID NOs: 44-48.

36. The method according to any one of embodiments 33-35, wherein the at least one *Lactobacillus reuteri* strain is selected from *Lactobacillus reuteri* 3630 and *Lactobacillus reuteri* 3632.

37. The method according to any one of embodiments 33-36, wherein the at least one *Lactobacillus reuteri* strain comprises at least one of strain 3630 deposited with ATCC under patent deposit number PTA-126787 and strain 3632 deposited with ATCC under patent deposit number PTA-126788.

38. The method according to any one of embodiments 33-37, wherein the at least one *Lactobacillus reuteri* strain comprises an isolated first *Lactobacillus reuteri* strain 3632 deposited with ATCC under patent deposit number PTA-126788 comprising a genomic sequence as set out in strain PTA-126788 or a sequence having at least 98% or 99% or 99.5% identity to the genomic sequence of strain PTA-126788 and an isolated second *Lactobacillus reuteri* strain 3630 deposited with ATCC under patent deposit number PTA-126787 comprising a genomic sequence as set out in strain PTA-126787 or a sequence having at least 98% or 99% or 99.5% identity to the genomic sequence of strain PTA-126787.

39. The method according to any one of embodiments 33-38, wherein the at least one *Lactobacillus reuteri* strain is selected from *Lactobacillus reuteri* 3630, and *Lactobacillus reuteri* 3632.

40. The method according to any one of embodiments 33-39, wherein the composition comprises two *Lactobacillus reuteri* strains; and the ratio of strains is approximately 0.75-1.5:1.

41. The method of vaccinating a subject according any one of embodiments 33-39, wherein the disease is a coronavirus associated disease.

42. The method of vaccinating a subject according to embodiment 41, wherein the disease is a feline coronavirus or canine coronavirus associated disease.

43. The method of vaccinating a subject according to any one of embodiments 33-39, wherein said infectious respiratory disease is selected from PRRS and IBV.

44. A method of increasing antibody titer in a subject, said method comprising administering an effective amount of an immunogenic probiotic composition comprising at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO:1-55, and
an infectious respiratory disease vaccine to a subject.
45. The method according to embodiment 34, wherein the at least one *Lactobacillus reuteri* strain comprises an isolated first *Lactobacillus reuteri* strain comprising SEQ ID NO: 44, and an isolated second *Lactobacillus reuteri* strain comprising SEQ ID NO: 49.
36. The method according to any one of embodiments 34-35, wherein the antibody titer is increased by at least 5%, at least 10%, at least 25%, at least 50%, at least 75%, or at least 100%, as compared to a subject not administered the composition.
37. The method according to any one of embodiments 34-36, wherein the subject is poultry, and the immunogenic probiotic composition is administered to the subject by oral administration and the infectious respiratory disease vaccine is administered by spray/inhalation.
38. The method according to any one of embodiments 34-37, wherein the subject is poultry and is at least 1 day old, at least 7 days old, or at least 14 days old.
39. A method of decreasing viral load in a subject, said method comprising administering an effective amount of an immunogenic probiotic composition comprising at least one *Lactobacillus reuteri* strain and wherein the at least one *Lactobacillus reuteri* strain comprises at least one sequence selected from SEQ ID NO:1-55 and sequences having at least 98%, at least 98.5%, at least 99%, or at least 99.5% sequence identity with at least one of SEQ ID NO: 1-55, and optionally, an infectious respiratory disease vaccine to a subject.
40. The method according to embodiment 39, wherein the at least one *Lactobacillus reuteri* strain comprises an isolated first *Lactobacillus reuteri* strain comprising SEQ ID NO: 44, and an isolated second *Lactobacillus reuteri* strain comprising SEQ ID NO: 49.
41. The method according to any one of embodiments 39-40, wherein the subject is poultry and the infectious respiratory disease vaccine is an IBV vaccine.
42. A method of stimulating an immune response in a subject, said method comprising administering an effective amount of an immunogenic probiotic composition comprising at least one *Lactobacillus reuteri* strain and wherein the at least one *Lactobacillus reuteri* strain comprises at least one sequence selected from SEQ ID NO:1-55 and sequences having at least 98%, at least 98.5%, at least 99%, or at least 99.5% sequence identity thereto, and optionally, an infectious respiratory disease vaccine to a subject.
43. The method according to embodiment 42, wherein the at least one *Lactobacillus reuteri* strain comprises
an isolated first *Lactobacillus reuteri* strain comprising at least one sequence selected from SEQ ID NO: 1-24, 26, and 49-55; and sequences having at least 98%, at least 98.5%, at least 99%, or at least 99.5% sequence identity with at least one of SEQ ID NO: 1-24, 26, and 49-55; and
an isolated second *Lactobacillus reuteri* strain comprising at least one sequence selected from SEQ ID NO: 25, 27-43, and 44-48; and sequences having at least 98%, at least 98.5%, at least 99%, or at least 99.5% sequence identity with at least one of SEQ ID NO: 25, 27-43, and 44-48.
44. The method according to any one of embodiments 42-43, wherein the at least one *Lactobacillus reuteri* strain comprises an isolated first *Lactobacillus reuteri* strain comprising a nucleic acid sequence having at least 99% identity to SEQ ID NO: 44, and an isolated second *Lactobacillus reuteri* strain comprising a nucleic acid sequence having at least 99% identity to SEQ ID NO: 49.
45. The method according to any one of embodiments 42-44, wherein the at least one *Lactobacillus reuteri* strain comprises an isolated first *Lactobacillus reuteri* strain comprising a genomic sequence as set out in any of SEQ ID NOs: 49-55 or a sequence having at least 98% or 99% or 99.5% identity to a sequence of SEQ ID NOs: 49-55 and an isolated second *Lactobacillus reuteri* strain comprising a genomic sequence as set out in any of SEQ ID NOs: 44-48 or a sequence having at least 98% or 99% or 99.5% identity to a sequence of SEQ ID NOs: 44-48.
46. The method according to any one of embodiments 42-45, wherein the at least one *Lactobacillus reuteri* strain is selected from *Lactobacillus reuteri* 3630 and *Lactobacillus reuteri* 3632.
47. The method according to any one of embodiments 42-46, wherein the at least one *Lactobacillus reuteri* strain comprises at least one of strain 3630 deposited with ATCC under patent deposit number PTA-126787 and strain 3632 deposited with ATCC under patent deposit number PTA-126788.
48. The method according to any one of embodiments 42-47, wherein the at least one *Lactobacillus reuteri* strain comprises an isolated first *Lactobacillus reuteri* strain 3632 deposited with ATCC under patent deposit number PTA-126788 comprising a genomic sequence as set out in strain PTA-126788 or a sequence having at least 98% or 99% or 99.5% identity to the genomic sequence of strain PTA-126788 and an isolated second *Lactobacillus reuteri* strain 3630 deposited with ATCC under patent deposit number PTA-126787 comprising a genomic sequence as set out in strain PTA-126787 or a sequence having at least 98% or 99% or 99.5% identity to the genomic sequence of strain PTA-126787.
49. The method according to any one of embodiments 42-48, wherein the at least one *Lactobacillus reuteri* strain is selected from *Lactobacillus reuteri* 3630, and *Lactobacillus reuteri* 3632.
50. An immunogenic probiotic composition, said composition comprising:
at least one *Lactobacillus reuteri* strain and wherein the at least one *Lactobacillus reuteri* strain comprises at least one sequence selected from SEQ ID NO: 1-55 and sequences having at least 98%, at least 98.5%, at least 99%, or at least 99.5% sequence identity with at least one of SEQ ID NO:1-55, and
a pharmaceutically acceptable carrier.
51. The composition according to embodiment 50, wherein the at least one *Lactobacillus reuteri* strain comprises at least one sequence selected from SEQ ID NO: 1-24, 26, and 49-55; and sequences having at least 98%, at least 98.5%, at least 99%, or at least 99.5% sequence identity with at least one of SEQ ID NO: 1-24, 26, and 49-55.
52. The composition according to any one of embodiments 50-51, wherein the at least one *Lactobacillus*

*reuteri* strain comprises at least one sequence selected from SEQ ID NO: 25, 27-43, and 44-48; and sequences having at least 98%, at least 98.5%, at least 99%, or at least 99.5% sequence identity with at least one of SEQ ID NO: 25, 27-43, and 44-48.

53. The composition according to any one of embodiments 50-52, wherein the at least one *Lactobacillus reuteri* strain comprises two *Lactobacillus reuteri* strains; wherein the strains comprise SEQ ID NO: 44 and SEQ ID NO: 49.

54. The composition according to any one of embodiments 50-53, wherein the at least one *Lactobacillus reuteri* strain comprises an isolated first *Lactobacillus reuteri* strain comprising a genomic sequence as set out in any of SEQ ID NOs: 49-55 or a sequence having at least 98% or 99% or 99.5% identity to a sequence of SEQ ID NOs: 49-55 and an isolated second *Lactobacillus reuteri* strain comprising a genomic sequence as set out in any of SEQ ID NOs: 44-48 or a sequence having at least 98% or 99% or 99.5% identity to a sequence of SEQ ID NOs: 44-48.

55. The composition according to any one of embodiments 50-54, wherein the at least one *Lactobacillus reuteri* strain is selected from *Lactobacillus reuteri* 3630 and *Lactobacillus reuteri* 3632.

56. The composition according to any one of embodiments 50-55, wherein the at least one *Lactobacillus reuteri* strain comprises at least one of strain 3630 deposited with ATCC under patent deposit number PTA-126787 and strain 3632 deposited with ATCC under patent deposit number PTA-126788.

57. The composition according to any one of embodiments 50-56, wherein the at least one *Lactobacillus reuteri* strain comprises an isolated first *Lactobacillus reuteri* strain 3632 deposited with ATCC under patent deposit number PTA-126788 comprising a genomic sequence as set out in strain PTA-126788 or a sequence having at least 98% or 99% or 99.5% identity to the genomic sequence of strain PTA-126788 and an isolated second *Lactobacillus reuteri* strain 3630 deposited with ATCC under patent deposit number PTA-126787 comprising a genomic sequence as set out in strain PTA-126787 or a sequence having at least 98% or 99% or 99.5% identity to the genomic sequence of strain PTA-126787.

58. The composition according to any one of embodiments 50-57, wherein the at least one *Lactobacillus reuteri* strain is selected from *Lactobacillus reuteri* 3630, and *Lactobacillus reuteri* 3632.

59. The composition according to any one of embodiments 50-58, wherein the composition comprises two *Lactobacillus reuteri* strains; and the ratio of strains is approximately 0.75-1.5:1.

60. The composition according to any one of embodiments 50-59, wherein the at least one *Lactobacillus reuteri* strain is selected from *Lactobacillus reuteri* 3630, and *Lactobacillus reuteri* 3632.

61. The composition according to any one of embodiments 50-60, wherein the *Lactobacillus reuteri* strain comprises at least one of strain 3630 deposited with ATCC under patent deposit number PTA-126787 and strain 3632 deposited with ATCC under patent deposit number PTA-126788.

62. The composition according to any one of embodiments 50-61, wherein the composition further comprises an infectious respiratory disease vaccine.

This invention may be embodied in other forms or carried out in other ways without departing from the spirit or essential characteristics thereof. The present disclosure is therefore to be considered as in all aspects illustrated and not restrictive, the scope of the invention being indicated by the appended Claims, and all changes which come within the meaning and range of equivalency are intended to be embraced therein.

Various references are cited throughout this Specification, each of which is incorporated herein by reference in its entirety.

---

SEQUENCE LISTING (55 sequences)

SEQ ID NO: 1 - DNA, 231 bp, Artificial Sequence
  Based on Lactobacillus reuteri sequence
atggacaaagaagaattagaaaaaattgtaggtaataactttgaggaaatgagtttacaaaaaatgacagaaattcaaggtatgggtgaataccaagtggattcaacaccagcagcttctgcgatttcacgggcaacaattcaagtatcacgtgcatcttctggaaaatgtctaagttggggtagtggtgcagcatttagtgcttattttactcataaaagatggtgctag

SEQ ID NO: 2 - protein, 76 aa, Artificial Sequence
  Based on Lactobacillus reuteri sequence
MDKEELEKIVGNNFEEMSLQKMTEIQGMGEYQVDSTPAASAISRATIQVSRASSGKCLSWGSGAAFSAYFTHKRWC

SEQ ID NO: 3 - DNA, 186 bp, Artificial Sequence
  Based on Lactobacillus reuteri sequence
atggaagaaaaagaattagaaggtgtaatagggaattcgtttgaaagtatgactgtagaggaaatgacaaaaattcaaggtatgggtgaatatcaagtagattcgacgcctggatattttatggaaagtgctgccttttcagctcttacagccaatataacaagacatgctatgcatcatcattaa

SEQ ID NO: 4 - protein, 61 aa, Artificial Sequence
  Based on Lactobacillus reuteri sequence
MEEKELEGVIGNSFESMTVEEMTKIQGMGEYQVDSTPGYFMESAAFSALTANITRHAMHHH

SEQ ID NO: 5 - protein, 373 aa, Artificial Sequence
  Based on Lactobacillus reuteri sequence
MVEIAHFGVEAWLNKWEKSATYDISQSTIASLSMHDLLNLDGNNGEEFYEMLDKQQMNYGWIEGSPEFKEEVAKLYHHVDPENILQTNGATGANILALYALINPGDHVIAEYPSYQQLYDIPKSLGADVDYWHIHEEDNWYPRIDDLKAMVKPNTKMICLNNANNPTGTVLDKEFLEQVVEIAKSVDAYVLVDEVYLPLDHPEKFAQIIDLYDKGISTNSLSKTYSVPGVRIGWTATNAEVADIFRKFRDYTMICGGVFNDQLATYVLRHRDQVLARNRKLVLGNLAIYKDWIDHEDRASVIMPQAVSTSFPKLDVPVDIHTFCENLLHDEGVLLVPGDAFDTPGHVRLGYCAPEATLKEGLKRLSKYMHQYD

SEQ ID NO: 6 - protein, 178 aa, Artificial Sequence
  Based on Lactobacillus reuteri sequence
MILTTFIILILMGCFINGHRRGLLTMTLMLGTYIVAWIVARQGAQLIGGWLKSLLPSIGTPATFSESLLANVNSNLFFYNGIAFMIIFTIVSILCHWGIRQLNWIKRIPVVGTVDKIAGGLISFLIGYLIIYVVLLIMQLFPAGWWQMQIANSELARFMINQTPGIAHLVIDTLVQGG

SEQ ID NO: 7 - protein, 332 aa, Artificial Sequence
  Based on Lactobacillus reuteri sequence
MNEYNAEMAKLNQGANAPVITTNSVNQALSLKPENNATVDIEALNPRITFKRVEEGTKYAGYQIFDKNNAYVNNIDGEFLRVTYTNLKNSTYKGSKISKIVVTYSDSTPTGNRITQSGLNAVTEGANDNFLVVFEDPVRGDMHSTTVTATYQYYDANGNLIDFSGTNNAWLSVGSLNFDQGNDYQGGKNEGNPTSGISEGVKLISGAQIKQLAGSSISVHDDGWAYAGFNNYSGTGMNNGINTDNGGSGWDMDGSPNAYYGAIVFQLTGSSVSLRQGLVSWGGADIASQYNNQFLNNAWFTAGTTLPETQIKQPIRKTSETHYHYNPSVIRL

SEQ ID NO: 8 - protein, 2059 aa, Artificial Sequence
  Based on Lactobacillus reuteri sequence
MAQKLMSANSTDKNFKMYKSKKSWVFAYSTTLALAAVAGITLSTTNVHADTTNGGDNQVNATAVTQNTTSNTVDQIAANTAQTDNTSTSINIRSLMDDLASGDDTSSSQNGQEQSQNYASSNQNSQTQQENGTTGQSTASQNGTTSDQTNSDQSDKNYYVISTRDLDKNGNVNYLTQKNYTSIKGQEVADGTVVTWPLSVSALPANRAQDLKSHVISETLDPHLEYLHYRAYLTNTDGTVTDVTNHVNLNRSGQTLIFTDDNYLLSIYNNNRYRVQNLPVIKLVTKANGNGYIIPNAFKSSYVFNDGSHDVSFTTTSNNVQIKTFNPGNSKDVEIGGNVQGDPSGTINGQVVADGSVVTWPMSVGDLPANRAQDVLSHIETDTLYNGLNYEGYHAYLPQADGSFQDVSSHINVQQNGQDLTFIADDYLIGLYNQDKSTAFKMPIIDLITSVHGTSIIAPNKFNSQLAFKDGNGQTVINNTSNQVQISTYHPTNTKDVELGGNVQGDTPNSINDKVVANGAIVTWPMASSELPANRVQDLQSRVISETLDSHLQYQGYKAWLQNADGKYTDVTSHVKLTQDGQNLTFADDEYLLNLYNSNKGTAYKLPIIDLVTKVNGAGITAPNSYTTKYVYSDGDGNTTINVTSNTVKISTFNPTTNKDVELGDNIHGDTESSIAGKLVSEGTIVTWPLSTSDLPANRAQDVVSHTAVDALEPTLQYISYTAWLPDSNGQLQDVTSHVKMTRDGQKLTFTDDDYLIGLYNQNKDIALKMPIIDLVTKATGNTKLLPNSFDSQFVYNDVDGNTIINVSSNKPTVETFDPTVHKDVELGGNNVQGDTPNSIDGKIVAQGTVVTWPMSTSDLPANRTQDVVSHSTSETLNQNLQYVGYHAYMPDANGKLQDVTSHVQLQQNGQNLVFTDDSYLINLYNQDKSIAFKMPIIDLMTKAISDSATIPNTFESQYVFNDGNGNTTFKSTSNTVQIITYKPKTTKDVELGDNIHGDTNASIAGQMITDGTVVTWPMSTSDLPANRTQDLQQHVVTDNLNDNLIFQGYTAWLPTANGLVDVTNHIELTRDGQNLTFTDDAYLLNLYNQNKDTAYKLPIIDLVTKANGNTKLIPNNFDSMFVYNDGDQQTTVNVTSNTVNISTYDPTATKDVELGDDIEGDTADTINNLMVQIGTKMTYPLTVSDLPANRADEITAHQSVDTLSDYLEYQGYKAYLPDADGKLQDITEHVNLKREGQKLSFNDDDYLINLYNNSKATKQALPVIDLVAKVTGSNDGKKVHIIPNHFDSTITTKDGKINTTSNTVVINSNDPEAVKDVELGDNVVGDTPNSVTGTTVADGTIVTWPMSVGSLGANRAQNVIKHTETENLDSGLTYLSFKAYLPDADGKMQDITEHINIQQDGQKLVFTDDDYLISLYNKDKSQRFALPVIDLVTRVNGDNKIIPNTFVSQFTFNDGKGNTITSVTSNQVNVSTFKSNPEKHVTLGTDIEGDDAENADGTVVAQGSEVTWPLSDKSPLPANRSQDVKSHTLVDKLDDNLQYNSYKAYLKGTDGKLQDVTDHIKLTRDGQNLTFIDDDYLLDLYNKDKSTAFNLPIIDLVTTVVGNDKLIPNKFDSNFVFSDGNKDTSMKTTSNEVSISTYTPVTNKDAELGDNVVGDTSDSIANETVPDGTIVTWPLSVSSLPANRSQDVFKHVIEDILDGNLTYNSFKAYLKDAAGNLQEVTDHVKLAQEGQHLTFTDDDYLINLYNSSKNKEQSLPIIDLVTTVHGDSKLIPNEFDNVFVFKDGKGQTTVKTTSNKVTIKTASLPTPTKEETDDQGNNINGNEVKAGEHVNYTLNWDLSNDKDVKATPEMIKKGFFFIDPIDSRALSVDDLSKAKVVDQNGNKVDGISFHLYNSLSEVPEFIQEQVKANNLQDKITGPFVVAQADDLQAFFDKYVKTGAKLKVTIPTIVKSGFTGEFSNTAYQFGFGKATPTNTVTNYVKPMHKPASPETPAAIAPQVISATAQPMTSDAPVTPSEKTAKLPQTGNADEGALLGLAAVSLVGSLGLAALGLKQNRNDD

SEQ ID NO: 9 - DNA, 300 bp, Artificial Sequence
  Based on Lactobacillus reuteri sequence
ttaaagtattaaaatagatgtaaaatttatttttttcaaaagaaattttaattgtacactgttggtattgaacggggttaaacaaaggtaaattagcatttctgcggattaagataaatagaaaaatgttaaagaacaccttaaaaagattaattttttataattggaccgtatcaatttgtaaaaaggttgactttttgaaaaaaaagtttatcattaacattgtaaatttaatgatttacgttatgttgttatagagcacaggacgtattgatttatatagaaggagtgtttattaga

SEQ ID NO: 10 - DNA, 300 bp, Artificial Sequence
  Based on Lactobacillus reuteri sequence
atgaatggacagatgttttaatcgctagaatagaaggaaagaaagtcgcaacaaatacggtttctagtacgtggcaggaacgactaggtaagcagattgacgaattaatagaaaaacattagtcaaatacatttacaaatgaacagatagttgatattatatttaagaattcttcttcagagcctaagattaaagctttcaattggcgaaaagaagttgtacaatatgtataaaggtatgtcagtcaccgaatcagatgatctggcattatacttgtaaattatcaggaggttttcatta

SEQ ID NO: 11 - DNA, 300 bp, Artificial Sequence
  Based on Lactobacillus reuteri sequence
atctcacgtgcgatccattacactaagggcgcgtcaacaaatattatactatcttaaataagaatgaattgcaagcattatttgaaaattttaattaaaataacgcttacatcagaaaaatgttgtgattgaatagacaatttttttgaagatggtatcataagtatcgtaggagttgtattattgcttagaccttaccactgcgtcacttacaatggttgagagttgcgatgctgatgtaatgtgataaactaagcaagtacactaattatgttttttcctaaaggaggaatttgcagt

SEQ ID NO: 12 - DNA, 300 bp, Artificial Sequence
  Based on Lactobacillus reuteri sequence
ttgtttaagatatctttcaaagctgcggaatttttcccagcttttttagttagttttgttttcataagctataattttaaccgattccaaatttcttttaaaagtttttttgatctagaccattaattgataaacgcttaccaaagactaatcaacaagccatttagcggtagtggtccattttaactttctaagacatcttctcagaaaacgtttcctttgatagtgcagattgtgctttaagagtatataattgtcacggtataagaattttctgaaatttcagaaggagtgaacatt

SEQ ID NO: 13 - DNA, 449 bp, Artificial Sequence
  Based on Lactobacillus reuteri sequence
ctcctctattattattcctgatcaattttaaattaatctccctagataggtatattttagcacaggtcaccaacgttccaaagtttaatctatgtttaaactttaattttcaaaaaaatgctatactatgttcacgatactttaaggaaaggtgattacaatagtgagtctcttaattgctattcttatctgctggttgctatggaagattgggggtttaacggttaagttcattggtctaatccttcttattctattaatcgggacattaattcatgttttactttggccagcgatccttttagcagttattatcttaggagcaggtttattcactaactaatttatctataaaatcttatagtaatttttctgcggaatgttataatcattactgtgagagaaatctcaaataatgtatacataagatgaaagggagactgtttatt

SEQ ID NO: 14 - DNA, 250 bp, Artificial Sequence
  Based on Lactobacillus reuteri sequence
acaaatacggtttctagtacgtggcaggaacgactaggtaagcagattgacgaattaatagaaaaacattagtcaaatacatttacaaatgaacagatagttgatattatatttaagaattcttcttcagagcctaagattaaagctttcaattggcgaaaagaagttgtacaatatgtataaaggtatgtcagtcaccgaatcagatgatctggcattatacttgtaaattatcaggaggttttcatta

SEQ ID NO: 15 - protein, 3017 aa, Artificial Sequence
  Based on Lactobacillus reuteri sequence
MVSKNNHQFYQQKHAERKQRWGIRKLSVGVASVLLGTTFMLYGNHAVLADTVTSPSDDVTRSTTTQGGNKDKVTEGTTEGTTSTPQTSGDSTDKQANGQNVNQQVPTTDTEEATNHQDTPQGQDTTQNTTNVDKKDTEVTPANDATTPTTQKITAKFTTAKFTTAKFTAAKFKVLAARPVMKVAGTASLPISNQDIKLDSQPMLTEIINKPTDNWVYNNLKWYQDTSTEKIKEILQNHTANDESGRYYFAGVANYNEHYHAIYLLARSNNLNDNSLYVTILHTGLGKNIQEAVVAPGESKKVEYSGTTHTPIFTNYDGTSASIDLDGIEKGDNIYGMVVGFAYGHNTGIKGDPASMGNGFVMTPIPTKMTTTIHYIDQATGDEIAVPKSFEGVAYQKYTITGEAPTIDGYTLKKSPETTGYISPYKVGESYDFRLDKHVVIKQTVIDAQGLVRVTAYYDGEVLNNTTRYLGNKLNVNDRMSFISHGKWYTYINQITSTNDGIVYYYAKDGSEDKSEVRVHYIDVTGSKNSIFVPGDGEEVATDKISGKLGENYNYDVNLPTDYNLATNQANTVNGTYTIDHHDEYVYVVKKTSAELDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDNPTSLTADEKKTIEDKIVEANKDKFPEGTGVTVANDGKATITYPDKSVDTIEGNQLVEEKTSAEKLDPTVPAKTKVDDPTKLTNDEKKEVEDNIRDHNTGLPEGTKIAVGDNGDTTITYPDKSVDTIEGNQLVEEKTSAEKLDPTVPAKTKVDDPTKLTNDEKKEVEDNIRDHNTGLPEGTKIAVGDNGDTTITYPDNSVDTIPGDKVVEGKSDAAKNEPKVPGDKVKVDDPNKLTEDEKSEVVKAVEDANKDENGKSTLPEGSKVTVGDNGDVTVTYPDGSKDTIPGDKVVEGKGTEGQTDADKNEPKVPGDKVKVDDPNKLTEDEKSEVVKAVEDANKDENGKSTLPEGSKVTVGDNGDVTVTYPDGSKDTIPGDKVVEGKGTEGQTDADKNEPKVPGDKVKVDDPNKLTEDEKSEVVKAVEDANKDENGKSTLPEGSKVTVGDNGDVTVTYPDGSKDTIPGDKVVEGRGTEGQTDADKNEPKVPGDKVKVDDPTKLTEDEKSDVEQAIKDANKDENGKSTLPEGSKVTVGDNDDVTVTYPDGSKDTIPGDKVVEGKGTEGQTDADKNEPKVPGDKVKVDDPNKLMEDEKSDVEQAIKDANKDENGKSTLPEGSKVTVSDNGDVTITYPDGSKDTIPGDQVIEGKSDADKNTPNVPGGDKVKVDDPTKLTDNEKNAVKDKVDEANSNLPDGTKVTVGDDGTTTITYPDGSTNTISGHDLVTGKTDADKYPLNPGQAVNVVDPNHLTQAEQDQVKEAIQTTNPTAPIATITVDTAGNVQVTFADGSTTTLQANLHKHVTEATTGSAIKPGVGTNGGQTKGATSTNQTATKQQAQQHLPQTGDQPATWAMLSGLGVAFLGLLGLKKKRED

SEQ ID NO: 16 - protein, 1472 aa, Artificial Sequence
  Based on Lactobacillus reuteri sequence
MEIKKHFKLYKDGKKWCCAAIATTVLGIGLAIGSPSVLADADTITSTSDANNSLVKNDNTSDTDSNSESTFTDTNKNSTNEKEINENKNIDSSQQINQEQTKSNNSEEQTTPVNVKAENTDIKDSIPEKSTPNSFKEINGSTYYYGENGDLYRNQFYNNWGRTYYFQANGARLDNGFYNNWGRTYYFGSDGARWDNRFYNNWGRTYYFQNDGSRLDNSFYNNWGRTYYFGVDGARWDNRYMVKWGRAYYFGNDGALLQNQLKSINGINYWINNEGIIPLKNQFLTANENQLFYFDGNGSLVVNKFYHNWGHTYYFGSDGARYTDQFLNRDGKVYYFDNQGIMYQDQYYKNWGHTYYFGSDGARYTDQFLNRDGKVYYFDNQGIMYQDQYYKNWGHTYYFGSDGARYTDQFLNRDGKVYYFDNQGIMYQDQYYKNWGHTYYFGSDGARYTDQFLNRDGKVYYFDNQGIMVTNQVRVIDGKGYEFNDNGEATETSDMGQTRDTVAKEVAQALTNQGIKGVKYDWRNTNNDYQELALHDIAQEVAQGDTNPDKNVIEKKLQANNLLSGKVLVVYSTDFTNDDPQKITNTFMNSYDFTNADNSVLGVGADLNKNKLVIILFKPGEKAEQPQATSTISASISDIFKKAGVNVDVDNGLTKGSVVNSADLGNALTNGTAELLKGDKGTIISQEVLKAIFAAFAGNTSAVEGTKNYYNGNDAYHYEFWLEGQSADDKLNNFLALNKGAKYGDQLKVNYTATLVFGQETGTNSNESKVPASERTDEQLDLAYKTGTDTGLRYDSVKVEKIPGMTDDMVRGVDVSSYQALINAGVKFYDFNGQESNLFKILKDSGVNWVRLRVWNDPYNAQGQPYAGGDNNEENLIKMAKEASDNGLKLLIDFQYSDFWTDPAQQILPKAWRNLSHGEMSQEVYLYTSKILNDLQKAGASVKMVQIGNEITNGAFGLYTGRNGGGNWASLWETSDGDQVAKYIQAGSSAVRRIDPTIKVAIQLETPEINKYRGIMNVLKKNNVDYDYLGTSYYPFWSTTQGNGWYDNVDLGYGANTPVNLEAIEKMAWNEFGKRTVILESGWLNNTNDADGTHNSVGENNETTNIDRYSADPQGQVDEIEDMYNAIIAQKGLGAFYWEPAWIPVKAGWNNWQYNKLMSNIYGSGWASQYAKGYAPDSVLYYDGKEAWGGSSWDNISLFDDHGHPLQSLNVYNGMLNGYESPKNVKSSLSTQLVKIWNETDVIPNDGLTEGTKLSTDLFGTTQLSGNDGQSIGNAELTKLAGRLKDGISSKVYTAANGARYHYIYWLEGGNNKVNTFVSANKDAKYGQPLIANYSATVVVDSEPGTQVATSPLQIKISQVWNTVNNEEIKIDNPLKQGDLITDKSDNAFSGILNSKDIKEALTGEKGKDVSESTVNDVKSLLPKEVKGSKTYTTADGNQYYYDFWLASVETSNVNYGEPIIVNYTASLKWLG

SEQ ID NO: 17 - protein, 1063 aa, Artificial Sequence
  Based on Lactobacillus reuteri sequence
MEKTMKKKALVATTAVAGITLVGEVTTVHAADNVQQPVNEQNVNQSSQEEKQAAQNLQNAQSDVNTATEANSNAQDNLASANNNLSNAKKAVSDQAAKVADATKAQSDASTKVDNDNKVVADAQQKADQATPANIENAKQAIEGQNKVIDQDNENIKYSNTDQDKAQNTLNNAQSNEDKANATLSNKKSSQASAQNNVKQAEDALNGTHLVEAQNAFNQAQSNVENAQSKYDQANNQLSDAQKKVTTNQNDLTAKNKALDNINNQVDTDQNNVNSNQATADSASSATQVAQNAVDQTKQSLDKVIEELNGFSENTIKVPAGAQEAYEAFIDAVDNNADQSQLDSLAKKMYDTLHQGQGTNGINHFNSSKYDQNQLVDVDHLTTDQLNELTQFAADMINSARKAWGSDKNAGTLIPTQGVSEMAQQIAKGYVSDNWHISQGHDVKRVTAAAGLIGLNDAGQFYEDASEGYVHAWPWEKDSYTMDNLKEAVYDSILGMLFADDNSGNGHMTDLLGLHVNRKEDHQYFGLSTNMCPGSYMGQLHFIIVENDPAYIKDPQTFNAKGGTTKIEYIDPKVQLNQQKDILTTTLSTQQADLATKQDALNKANQNLANAKKQLSEDQDLQTVAQQNRDSAQKALNDATAKVSNLQATVNSLSQDLNSAKATLDQAKKTLESYTADHKAKLDNYNNAKAALDDANKAVAEAQSAVDTAVNETKIAQNNLDQKKQAVTDAQNKLANDQEYLATLKQNLADLQNAPQNLQKAKDQLAKDQIALDNANKDLQNQKDSLDELNKKLEDAQVKVNEAQSAANVTKATLDQAQAKLSDAEATWKELHNDAHRYGNVVKVTPITMEAGTSLPDPVIENGFTVNTGTNQLFVSLAAIDSSNNNIPQGTKASWANRSKALTDSQNAGSYSEDILITFPDNSTVTVPVDLTVTAKKITEDQKATEGGYHIVNGSVVDKQNNLVSGWTVKNGQMVDPEGNVIKTTMSTAQGVTIEKNNSKSGNTKTNMIQTSLTIANNKATTNKDNQLPQTGNYNNNTKVLGLAGIALASALTMFGYKKRQHN

SEQ ID NO: 18 - protein, 212 aa, Artificial Sequence
  Based on Lactobacillus reuteri sequence
MKSTTKKILASSLGVAGAMAMGTVTAKADTTVTVNAGDSLNGIAQKYNVSADDIATANHLQNKELIFVGQKLTIPTKDKNETPANNAEKKDQASKNSQSLQDSVNKAMSYLGTPYVWGGNKPGGFDCSGLVQYCYGIPQRTTYEQQALGPHIHDNVLNAPYGALVFYGSDDAPYHVAISLGDGRIIQAPNENETVKITDQQYFPGNYYVVMH

SEQ ID NO: 19 - DNA, 1107 bp, Artificial Sequence
  Based on Lactobacillus reuteri sequence
atgcgtaatcaattcatcgatgtttcaagttatcaaccagatactgttgcctttttccaagctgctaaagctcagggtgcattaggggtcgttgttaagttaacggaagggtccgaagatggttcggcttatgttaatccacgtgcggccgctcaaattcgtaatgccttagcggttggcttgcgcgtttcctgttaccactttgctcgttatacatcagtgactgatgcacaaaatgaagctcgattcttcgttaaaatcgctaagcaatttggtatgtatgacgatactttgatgattgatgatgcggaagttcattcaactgcagattatcaatcagtatccttagcctttcttcaagaagtagaagctcttggttacaagaatactgggatttactccatgaagtccttcttcactggcggtattcttaattcacatggctttgattcccggaagatttggattgctggctatggtgtgactgaactggggattgataatgcaagtgcttggcaatattctgatcatagcatcatgggaattgatactagttatgactttgacggtgcctttacgactggtttagtatcaggcaatgttccgcaagctgttattccagcaccacagccggttcaacatattggtcacccagctactggaacctacattgttcagccgggcgatacattgagtggaattgcagaaaaatacgggactacttatcagaacctagcagcaatcaatggtattggtaatccaaaccagatcaatgtcggccaagtcctcaaagtcaccggaaaagtatcaaacgaaaatacttactttgttcaatcaggcgatacgttatccggaattgccaccaaattcggcaccactgtctcagacctcgtaagccgtaatcacattactaacccgaatgtgatctacgttgggcaaaaactctacttagccggcaacggacaatccaatgcttatactgtccaagcaggggacacactaagcggaattgcggctaagtttggcaagacctggcaagcattagctcaaaagaatggcatcgcaaatcctaatatgattttcattggtcaaacaattcagatttaa

SEQ ID NO: 20 - DNA, 2439 bp, Artificial Sequence
  Based on Lactobacillus reuteri sequence
gtgtaccgaattattggttataatgaaccaacagataaagcaggatttattgtactggatccccgagttaatcgtcatattagttcgggaaaactcacgcttaaagaatctaatattgatgatttgactattacggttaatcaagcaagtccattatgggacaacgtaaggccttatcatactcatgttaacgtttatgatgataatgaacttatttttcgtggacgagctatcaaacctaaaaagtcgatggaagaaagcggacaattcattcgtgaatatgtttttgaagatattgaagcatatctcatggatagcacccaaagattttatgaaggtgttggtcaaacgcccaaagaatttttacaaactttaatcgatgttcataattcacaggttcctgactataaaaagtttcaagtccggaatgtaaatgtcactaataataaggatgaccaatatcgacaaattgattatcccaaaactagcgatgctattaatgataaattagttaaatctcttggtggttatattgtgactacttacaacgctaacggaataaactacattgactacttaacggatattggggttgatcataaagatgatactcctattcagttagctaaaaatatgaagtctgcaagtatgcaaattgatcctactaaggtgattacaagactgattccactgggaaagacactagaaccatcaaaagttgatgtaagtgatgatgatggagagggcggttctggatcattagatagccctgaagaattttgtaaatcagaaattaatgctacttggggtagtgatattaataatatgaaacaagattttgccgctcgttcttcgagagttcgggcttggggagtggacgttaatcgtttatatgatgtggtgaaaaatgctggagtaagtcctgaatggttctttgcttatgaacttcaagaacaaggaacttactatggatggcttaaccatacttatcgacacggtgatgcgtatagtgatgcgcaatctgtttgtgagtggattaaaaattgttcaaatagtaattccattaatccagcatggagcgcaccggaaggatcaatggcgccgaatcaagcattagcggataaatggaatcaagagtttggaaaaggtactattggccgcgtttatttacaagggactgccgctgctgtttgggatttagctggtcaaacgcctaatccagctattggaaagccaattagtggatgcatttcttgtattaaacgttggggtggtcattctaatgcagctggtggtacatggggatggccttttcctgatgttggggaaggtcatttttctcaagttcagagtttcggaaatgatggcggatatcgtcaaaatagttatcacgatggtgtggattttggatcaatagatcatcctggtagagaagtgcattgtattcatggtggaacggtaactatcaaatcagctatgggtggcttaggtaattttgtggttattcatacgccggaaggattcaatatcgtttatcaagaagcttttagttctccctctaatattattgttagtgttgggcaaaaagtaaaaactggtgatgtaattggatatcgtgatacagaccatgttcatattggcgtaactaagcaagatttttatcaagcagttcgaaattctttttctcctgcaggtggttggctagatccagtaaaactaattaaagaaggtggcgatgggtctaaaccacaagaaggaaagaaagatcaaactgttgataatagtaatgctgcacgtcctaaattaaccattactactgtcaataacggtagagactatattgatattcctgatttacaaaaagaattcggtattattgagggaactgttgaatttgataatgtagatgatccgaatgttttaatgcaacaagctcaaacatggataaaggctcaaagaatacctcaaagttgggaagttacagctttagaattacatatgacaaacttcaaatcttttaaggttgctgataggtacatgtttattaatccaaatgttgcaaaaccccaattattacgaattactcaaaaagaaattgatttactaaagccccatgcgtcttcattaacgattggtgataagacgatggggcttactgattatcagttagaaaatcaagtcaattttcaacaatttaaggaaattcgagtgatggttaatcaggttgtccaaacccaagagcaatctgctaataacaataataaggttatgcaaaattttgctagtagtgctgatcttgcacaaatgagacaggatctaagaaatcttcaagatgataacgatcgtgctcgcaaaggaatggtttccttagaagaattcaataaactaaaggaacaagtagaaaaactaacaacaggaggcgatgataatggcaagtga

SEQ ID NO: 21 - protein, 739 aa, Artificial Sequence
  Based on Lactobacillus reuteri sequence
MNKANQKVADDTTAVNNKQTDVNNAAEAKKNADEALKNANDAQTSAQKNKDAKQAIADEASVALADANTAVKDAQAKVDAINDKLANFNTITLPAGYKDDLIAYYNYFGNSNYNQDEANNLAQDLLKYRDQAMSQNKFKDNLSDDRVVDIDNLNSTDRAELSQFVASLINQVRTQMGTNLVISSPAADDYAEQVSQNYNKDNWNSADNGKHDQSALNNATDQLNISWNGENMGLDQSIFTTDYTVLTDGTKLPTGNKQTINDLKHLIYDDFISMMFDDADSAWGHATNFAGIDNFAAEKQAVGFSLDKFYNTHYDLVEANQKVEENSYTLPSINALTQKLADAKDDLSIKQTDQASKQKANDDAQNALSSANQVLVAAQNDVKDKTATAQEANDNLTTAQNDLATLQNQLSADQANQKQAQTTFDSFDADLATKQANLQKATDSLKAEQGRLAIAQADLDNANKALSDANNNLAQKKQVVENDNETLKVDNDKLVQLQNNLSDLQNAPKLLAAAKEQVATAQKALADAQEAYNVANDKLTSLKQTAAGTTTNVSKAQQALAEAKNNEDAAKEVLDQAQQALTELRQKEALAKQVAEEQAKLAAEKEAKDNGYHIENNQVVDAKGNSVNGWTVKGNQIVSPTNATVDPAVSVTTNVNVDSKGQVQPQTSVTANSVKTVAATESANPVATTTVQTREQYKQQLKSNNQLPQTGNNDSAVLSLAGVALAAMLSLFGIKKREY

SEQ ID NO: 22 - DNA, 185 bp, Artificial Sequence
  Based on Lactobacillus reuteri sequence
aaattaaaaggctggattttttcggcctttttttagtgcaaataattattttttacgtatttatattatagggctaatcactaaactaataattagtggttgaagcgctgaaaattttctgctattttattaatagtttgataataaaataatgatatttaatataaagagggataaacgaaata

SEQ ID NO: 23 - DNA, 275 bp, Artificial Sequence
  Based on Lactobacillus reuteri sequence
gaagtacaaagttactttaactataatgaaaaacaagacaatataaagaaaacaacatataaggttcagttcataactgattagatttataataaatattgtaaatcggacaaaaataaattaattttcaattaattcaaaaaaaccatatttttttcgttttggcatatttggatttgctacactaaagatgatcaagaaaggggaaaagataatcttcaatcttgtgtacttagtttgttaattaatttataaatttagggaggaaacctatc

SEQ ID NO: 24 - DNA, 313 bp, Artificial Sequence
  Based on Lactobacillus reuteri sequence
gcaatgcacaagatgctgaaacaaaggcacaacaaaatgcagatcaagcttcaccagctaatattcaaaaggcacaagatgctattgctaatcaagaaactcaaattagtaaagacaccgatgctattaatgacgctaacaaagccgttagcgatgcacaaagcacagttgatgcagcgcaaaaaaagttaatgatgcaactactgctcgtgacaatcaacaaaagaatgttgatactgctagtgatgcagttaagaatgctcaagctattcttgacaacagtgatcaggctaaaaaggaagcccaagatgct

SEQ ID NO: 25 - DNA, 527 bp, Artificial Sequence
  Based on Lactobacillus reuteri sequence
gccgcgggtgcctatacatgcagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgccccccaccagccccaa

SEQ ID NO: 26 - DNA, 531 bp, Artificial Sequence
  Based on Lactobacillus reuteri sequence
tgctggggtttgcctatacatgcagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacgactaactacgccccacaccccagccgcaa

SEQ ID NO: 27 - DNA, 165 bp, Artificial Sequence
  Based on Lactobacillus reuteri
atggatatgaaaataaaaaaagaaccaccacaacaagtaaaattagttgaagtaattcaggttataacctctcgtggagctggaacaaaggaggatccgataagaaagattattcagtattggagcaaagaaggcacattattagcagaaagttttggaaactaa

SEQ ID NO: 28 - DNA, 129 bp, Artificial Sequence
  Based on Lactobacillus reuteri
atggctggtatcaaaagtatcgcaaaagcggtaatgacccagaatcacttcgtgatcgccgaggcaaagctaagccagaagagaagtggacggaagttgaccgactcaaggcagaaaatcgcttattaa

SEQ ID NO: 29 - DNA, 117 bp, Artificial Sequence
  Based on Lactobacillus reuteri
atggctaaatacactgttgaattaagtgaagaagatatccaaatgatcaaggattgtcattcaaagaatccttctatcatgaaggcaatgaacgacgctaaaaaagttgaagattaa

SEQ ID NO: 30 - DNA, 6789 bp, Artificial Sequence
  Based on Lactobacillus reuteri
gtggatgcggattcgctggcactcgttgatgcactttcacttgcgctcgttgatgccgattcactggcactcgttgatgcactttcgctagcactagtagaagctgactcacttgcacttgtcgatgccgattcgcttgcacttgtcgatgctgattcgcttgcgctcgttgaggctgattcgctagcactagtagaagctgattcactggcactcgttgaggcactttcacttgcgcttgttgaagccgactcacttgcgctcgttgatgcactttcgctggcacttgtcgatgccgattcacttacgctcgttgaggccgattcgctgacactcgttgatgcactttcacttacgctcgttgaggccgattcgctgacactcgttgatgcactttcacttacgctcgttgaggccgattcgctgacactcgttgatgcactttcgctggcacttgtcgaggcactttcacttacgctcgttgaggccgattcacttacgctcgttgaggccgattcacttgcgcttgtggatgcggactcacttgcactcgttgaggcactttcacttgcacttgtcgatgcagattcgctggcactcgttgatgcactttcacttgcactcgttgatgcactttcacttgcacttgtcgatgcggattcacttgcacttgttgaagcggattcgctagcacttgtcgatgcggattcacttgcgcttgttgaagcggattcgctggcgcttgttgaagccgactcacttgcactcgttgaggctgattcacttgcactcgttgaggcactttcgctggcgctcgttgatgcagattcgctggcactcgttgaggccgattcgctggcgcttgttgaggccgattcgcttgcacttgtcgatgctgattcacttgcactggttgaagcagattcgctggcactcgttgaggcactttcgctggcactcgttgaggccgattcacttgcgcttgttgaagctgattcacttgcacttgtcgatgctgattcacttgcgctagtagatgccgattcgctggcactcgttgaagcagattcacttgcgcttgttgaagccgattcacttgcgcttgttgaagccgactcacttgcactcgttgaggcactttcgctggcgctcgttgaagcagattcgctggcactcgttgaagcagattcgctggcgcttgttgaggccgattcgcttgcacttgtcgatgctgattcacttgcactggttgaagcagattcgctggcactcgttgaggcactttcgctggcactcgttgaggccgattcacttgcgcttgttgaagctgattcacttgcacttgtcgatgctgattcacttgcgctagtagatgccgattcgctggcactagtagaagcagattcacttgcgcttgttgaagccgattcacttgcgcttgttgaagccgactcacttgcactcgttgatgccgattcacttgcacttgtggatgcggactcacttgcactcgttgatgcactttcacttgcacttgtggatgcggattcgctggcactcgttgatgcactttcacttgcgctcgttgatgccgattcactggcactcgttgatgcactttcgctagcactagtagaagctgactcacttgcacttgtcgatgccgattcgcttgcacttgtcgatgctgattcgcttgcgctcgttgaggctgattcgctagcactagtagaagctgattcactggcactcgttgaggcactttcacttgcgcttgttgaagccgactcacttgcgctcgttgatgccgattcactggcactcgttgaggcactttcacttgcgcttgttgaagccgactcacttgcgctcgttgatgcactttcgctggcacttgtcgatgccgattcacttgcgcttgtggatgcggactcacttgcactcgttgaagccgattggcttgcactagtagaagctgattcactggcgctcgttgaggctgattcgctggcgctcgttgaggctgattcactggcactcgttgaggccgattcgctggcgctcgttgatgcagattcgctggcactagtagaagctgattcactggcgctcgttgatgccgattcacttgcacttgtcgatgcggactcacttgcactcgttgatgcactttcgcttgcacttgtggatgcggattcgctggcactcgttgatgcactttcgctagcacttgtcgatgccgattcacttgcactcgttgatgcactttcgctagcactcgttgatgcactttcacttgcacttgtggatgcggattcgctggcacttgttgatgcggactcacttgcacttgttgaagccgattcactggcgctcgttgatgccgattcacttgcacttgtcgatgccgattcactggcgcttgttgatgcggactcacttgcactcgttgatgcactttcacttgcacttgtggatgcggattcgctggcactagtagaagctgactcacttgcacttgtcgatgccgattcactggcactcgttgaagcactttcacttgcgcttgttgatgcggactcacttgcactcgttgaagccgattcgctagcacttgtcgaagctgattcactggcgctcgttgatgctgattcactggcgcttgttgaagccgactcacttgcgctcgttgatgcactttcacttgcgctcgttgatgccgattcactagcactagtagaagctgattcactggcgcttgttgatgcagattcgctggcacttgtcgatgccgattcgctagcactagtagaagctgattcactggcgcttgttgatgcagattcgctggcacttgtcgatgccgattcgctagcactagtagaagctgattcacttgcacttgtcgatgccgattcactggcgctcgttgatgccgattcgctggcactagtagaagctgactcacttgcacttgtcgatgccgattcactggcactcgttgatgcactttcgctagcacttgtagatgcggattcacttgcactcgttgatgcactttcactggcactcgttgatgcactttcgctagcactcgttgaagcactttcacttgcgcttgttgatgcggattcgctggcactcgttgatgcactttcacttgcgctcgttgatgccgattcacttgcgcttgtggatgcggactcacttgcactcgttgatgcactttcgcttgcacttgtggatgcggattcgctggcactagtagaagcagattcacttgcgctcgttgatgccgattcacttgcgcttgtggatgcggactcacttgcactcgttgatgcactttcacttgcacttgtggatgcggattcgctggcactagtagaagctgactcacttgcactcgttgaagcactttcacttgcgcttgtggatgcggactcacttgcacttgtcgatgctgattcgctagcactagtagaagctgattcacttgcactcgttgatgcactttcacttgcgcttgttgaagccgactcacttgcgctcgttgatgccgattcacttgcactcgttgaggcactttcacttgcgcttgttgaagccgactcacttgcgctcgttgatgcactttcgctggcacttgtcgatgccgattcgctggcactagtagatgcggactcacttgcgctcgttgaagccgattggcttgcactagtagaagctgattcactggcgctcgttgaggctgattcactggtactcgttgatgcactttcgctagcactcgttgaagcactttcacttgcgcttgtggatgcggactcacttgcactagtagaagcagattcacttgcgctcgttgatgccgattcacttgcacttgtcgatgccgattcacttgcgcttgtggatgcggactcacttgcactcgttgatgcactttcgcttgcacttgtggatgcggattcgctggcactagtagaagcagattcactggcgctcgttgatgccgattcacttgcacttgtcgatgccgattcacttgcactcgttgatgcactttcactggcactcgttgatgcactttcgctagcactcgttgaagcactttcacttgcgcttgttgatgcggactcacttgcacttgttgaagccgattcactggcgctcgttgatgcactttcacttgtgcttgttgaagccgactcacttgcgctcgttgatgcactttcacttgcgctcgttgatgccgattcactagcactagtagaagctgattcactggcgcttgttgatgccgattcgctggcacttgtcgatgccgattcgctagcactagtagaagctgattcactggcacttgtcgatgccgattcactggcgctcgttgatgccgattcgctggcactagtagaagctgactcacttgcacttgtcgatgccgattcactggcactcgttgatgcactttcgctagcactcgttgatgcactttcgctagcactcgttgatgcactttcacttgcgctcgttgatgcagattcgctagcactagtagaagctgactcacttgcacttgtcgatgccgattcactggcactcgttgatgcactttcgctagcactcgttgatgcactttcacttgcgcttgttgaagccgactcacttgcgctcgttgatgcagattcgctagcactagtagaagcagattcacttgcgctcgttgatgccgattcacttgcgcttgtggatgcggactcacttgcactcgttgatgcactttcacttgcacttgtggatgcggattcgctggcactagtagaagctgactcacttgcactcgttgaagcactttcacttgcgcttgtggatgcggactcacttgcacttgtcgatgctgattcgctagcactagtagaagctgattcacttgcactcgttgatgcactttcacttgcgcttgttgaagccgactcacttgcgctcgttgatgccgattcacttgcactcgttgaggcactttcacttgcgcttgttgaagccgactcacttgcgctcgttgatgcactttcgctggcacttgtcgatgccgattcgctggcactagtagatgcggactcacttgcgctcgttgaagccgattggcttgcactagtagaagctgattcactggcgctcgttgaggctgattcactggtactcgttgatgcactttcgctagcactcgttgaagcactttcacttgcgcttgtggatgcggactcacttgcactagtagaagcagattcacttgcgctcgttgatgccgattcacttgcacttgtcgatgccgattcacttgcgcttgtggatgcggactcacttgcactcgttgatgcactttcgcttgcacttgtggatgcggattcgctggcactagtagaagcagattcacttgcgctcgttgatgccgattcacttgcacttgtcgatgccgattcacttgcacttgttgaagcagattcacttgcgctcgttgaggccgattcgctggcactcgttgatgccgattcgctagcactagtagaagctgattcacttgcgctcgttgatgccgattcacttgcacttgtcgatgccgattcactggcgcttgtggatgcggactcacttgcactcgttgatgcactttcacttgcacttgtggatgcggattcgctggcacttgtcgatgccgattcactggcgcttgttgatgcggactcacttgcactcgttgatgcactttcacttgcacttgtggatgcggattcgctggcactagtagaagctgactcacttgcacttgttgaagccgattcactggcgctcgttgatgcactttcacttgtgcttgttgaagccgactcacttgcgctcgttgatgcactttcacttgcgctcgttgatgccgattcactagcactagtagaagctgattcactggcgcttgttgatgcagattcgctggcacttgtcgatgccgattcgctagcactagtagaagctgattcacttgcgctcgttgatgccgattcgctagcacttgtcgaagctgattcactggcactcgttgatgcactttcacttgcactcgttgatgccgattcgctagcacttgtcgaagctgattcacttgcgctcgttgatgctgattcactggcgcttgttgaagccgactcacttgcgctcgttgatgcactttcacttgcgctcgttgatgccgattcactagcactagtagaagctgattcactggcgcttgtcgatgccgattcgctagcacttgtcgaagctgattcacttgcactcgttgatgctgattcacttgcacttgtcgatgctgattcacttgcgctcgttgatgctgattcgctggcacttgtcgatgccgattcacttgcgcttgttgaagctgattcacttgcgcttgttgatgcggattcgcttgcactcgttgatgcactttcacttgcgctcgttgatgccgattcgctggcgctcgttgatgcactttcacttacgctcgttgatgcactttcacttacgctcgttgatgcactttcacttacgctcgttgatgcactttcacttacgctcgttgatgcactttcacttacgctttttgatgccgattcgctggcactcctcgttgaagcggattcgctggcactcctcgttgaagcggattcacttacgctcgttgatgcgctagtcgaagtactcgtcgaggtggattcctgttcactcttactcgtcaattga

SEQ ID NO: 31 - DNA, 132 bp, Artificial Sequence
  Based on Lactobacillus reuteri
atggagatattggtaacgttatttgatttggtgttttttattacgtttatagtcgcaattgtctatggtattaggtggtttaaaggaagaaaagataaagaaaatgaatctcttaagaaacgccgtttgtaa

SEQ ID NO: 32 - DNA, 240 bp, Artificial Sequence
  Based on Lactobacillus reuteri
atgattaacttaaacttagcaggcttagattttgtaatgacggcactttttattgtgttgtttacagaacagttgaaaaatgcccgaactcagcgtgatgctctgattggtttagcatttgcaattatttgtttactattttgcaacaagaatgtttttctattagtgacattagtaacacttgtcgcactgttttcattaaattacttaatcacgaggagaaaaaatgacattaactga

SEQ ID NO: 33 - DNA, 123 bp, Artificial Sequence
  Based on Lactobacillus reuteri
atgtcagagatgaaaaatcgcgtaattaattttcggaatgataacttagccaaacttatagtcaattattatggaaatagtcaattaagtgtgcatattactaataatatgttttttgaatga

SEQ ID NO: 34 - DNA, 786 bp, Artificial Sequence
  Based on Lactobacillus reuteri
atgaaacgcaaaattgcattagctcaacttgatattcaattaggaaatcctgccgaaaattatcaaaaagctaaacaagcgattgaagaagctgctagtcaccatgcagatatcgttgtcttgccggagatgtggaatgctggctatgccttagatcaattagcagaattggcagatgaaaacggtcaaaagacacaaaaatttcttagtgagttagcgttagaaaatcaaattaacattgtcggtggttcagtagcggtgagatgtggacaatcttttttcaatacaacctatgtttatgatcaaaagggaaatctaattagcagttacgagaaggtgcatttatttggactaatgaatgaagaccgatatctaaaagccgggcaaaaagaaaatcactttgaattagctggggttccgagtgcaagttttatttgttatgatttgcgattccctgaatggattagaacagtcactcgttatggaactgatatcttatatttttcggcagaatggccaagcaaacggattaaacaatggaaaataatgcttcagtcacgggcaattgaaaatcaagcctttgtagtcgcggtcaatcgtgttgggacggatttagagaatagctttaatggtcattcgttagtaatagatccgcttgggcagattatccatgatgcaggagaagttgaacaagtaagttatgcagaaattgacttagcgcagttagcacaggttcgggggccgattccggtgtttaaggatcgccgaccaagtctttatcattaa

SEQ ID NO: 35 - DNA, 504 bp, Artificial Sequence
  Based on Lactobacillus reuteri
atgcaaaataaagatgcttgtacatcaattatggtcggtaaaaaggcttctctcgacggtgctaattatattgctcgtaatgaagatcgcgtaaaagcaattgaacccaagcgatttttagtaaaaccggcagtaaaaggacgccacgaaacctacgtatcaccttacaataaagtaactgtagctttgccggaagagagaatgcgttatacttctacgcctacccttgatcaaacagccggacctaatgaagaagatggaattaatgaagcaaatgtggcagcttcctttactgagagtgtttatgcaaatgatcgggtgttagcatatgatccatacgtaaaaaatggcctggcagaagactcactttgtactttagtattaccgtatattcattctgcccgtgaaggagttgaatatactggaaaattaattgctgaattgggctctgctgagggaaatggaatgcaatttgcagatgcagatgatatttggtatatgtaa

SEQ ID NO: 36 - DNA, 1533 bp, Artificial Sequence
  Based on Lactobacillus reuteri
atgaattattttatcggtgttgatgttggaactacttctacaaaggcagttctatatgaccaaaatgcaactgtgttagatcaatttagccaaggttattccctttaccgcgatgctagtggaatggctgaacaaaacccaactgcaattgtcgaagcagtcgaaaaagttattcatgatgcagcacaaaaagcagatttaacaaatggaaaattgttagcggtatcattttctagtgctaaccaaagtgtgattatgctcgacaagaatttcaatcccctttcacgggtcatcacttgggctgatacccgtgcacgtgatgtcgccaacgaattaaagaatagtcctgctggtcagcaaatctatgctaaaacaggtacacctattcatccaatgtccccattgaccaagattatgtggctcaataagacacaagcagataaggttgctcaaactgcatattttggcgatatcaaatcctacctcttccaccagtttttcaatacatttaaggttgatgtttccatcgcttcatgtaccggaatgatgaatgtcaatacgtgtgactgggacgatcaagcattggaactcgctaacgtcgactgttcccaattaccagaaatcgtgaacggaacaacccaagcgattggcctaacagcagcggcgcaagcaaaaatgggtatccccgctgacacgccatttgtctatggtgcctttgacggtgctttatctaatttaggtgtgggggcaattaagcaaaatactgttgccattacgattggaacttcggctggtgttcgggtagtaactgaccatccagtgatcgatcctcagcaacgactcttctgttacgccgtggataaaggtttatgggtcatcggcggtccgcttaataatggtggcgatgtctatcagtgggccgttgaacacttagttgacgctagtgcagttaaaaatgaaaatattgatccctacactcttgctaaccgagttattgaaggtgttcccgccggagctcacggtttgctcttccacccattccttggcggtgaacgggcaccattatgggacgctaatgcgcgcggtagtttctttggactttcccacattcatactcgtgccgatatgctgcgctcagtaatggaaggaatttgtatgaatattgcaactgttttccaagcggttcgtgatcttgttggtaatcctgcaagcgtaactgcaactggcggttttgcgcgagctgaagtttggcggcaaatgttagcagatgtcttgaactgtccggtcaatatcccgaactcatttgaatctggttgtctcggtgcaatcaccatggcaatgaagagtttaggaatgattgaaaactatgaaatcattaaaacattagttggtgatatcagttcttatcagccaaatcaagatgcggttaatgtttatcaaaattacttaccactttttaagcaggtcgaaggattattaacaccagcctattcgaccatcgctaaattacaacaacaatctactactcattag

SEQ ID NO: 37 - DNA, 195 bp, Artificial Sequence
  Based on Lactobacillus reuteri
atgacaacatcaatgatccacagtagaagtatgttggcgaaagtgattgcagaatcaccttcaccttttattataccaattttttgtcctaatgtaataaagattatctttttatctataaattattttatgaaaagagtggaaaaggcaagaagagcaatcaaaaagccaattttaacaattttattaagttga

SEQ ID NO: 38 - DNA, 570 bp, Artificial Sequence
  Based on Lactobacillus reuteri
atgagcaaactattacttgatgaaagaccgttacaagttcaggcatcgttagctggagcgttgaaaagcttagacgaagctgttattctccagcagcttcactattggcttcaacgttctaatacagtaagagacaatcacaaatgggtctataacagcatggctgattggaataaacagttcccttggctttctagaaaggctctatcgaaccactttaagaaattagaaaaacgaggactaattattacaggcaactataataaattatcttttgacaaaacaaagtggtatcgaattgactatgacgcattttcccatttggaacaacgattgggtagaaactacccaacgaatgggaagaatctacccaatggagacggtaaaaactgcccaatcggagaggaagaatctacccaaccaataccaatagactaccaagagactacacaaaagactactacaagagataaagggcaggcacagccagcccaaccttccattgctgcacagcggcgagaagttgttgaatatctcaatcaaaaaaactggcaagcacttcaagcctga

SEQ ID NO: 39 - DNA, 438 bp, Artificial Sequence
  Based on Lactobacillus reuteri
ttgaataattttcaaaaggcaattttcttgttgcagaatatcgacaagcttaaacagcttaatggtaaagcgatgactcttactgagttctctaaaataactgatgtttcacggccaacgttgtataaatacattcagcatccagaaacaatgagtagttcgtttgtaaataaagcggccatgctctacgacaaggttgttaaatttcaagatattcttgatacagttcagcgtgaagataaacaatttaagactaccaggcaggaattgattaagcttttagagtctaatgtagctaatattgaagttacagattatacaaaagcaatcgcgacagtaattattagtgacttaaaagaagaaaattcaagtctgctaaaagcgttaagtaagcaattaccatttaaaccaaatttaaatgataatttgtcaaaatag

SEQ ID NO: 40 - DNA, 333 bp, Artificial Sequence
  Based on Lactobacillus reuteri
gtgaagatgaatagtatgacaaacaaccaaaaagaaagttggaacgttggcaactataaaatcaatgtattaccagatgatgagttccagcaattgttaaagaaccaacgccaacttcaacagatcattgaaagtatgccactaccaaccgaccccaatgttgatctagttaaaaagattcattcccaactccctattacaaactgggcttgggaattaactaaacaacgagaacatgaggaaaagttaaagaaacaaaagcagcgaattgcacagcaatcgcttaactatccaacaaacctcaagaaaccggataatggcctttccctataa

SEQ ID NO: 41 - DNA, 153 bp, Artificial Sequence
  Based on Lactobacillus reuteri
atgaattctaatttgaaaaagaatttgattatcgcaaatggatttctactactaataataatattttatgttttattacatatgggtccattaaatatgaaagtcttattagtaggattggtattaatgaatctgacagtaatatttaaataa

SEQ ID NO: 42 - DNA, 1395 bp, Artificial Sequence
  Based on Lactobacillus reuteri
atggataaattaacattgaaaaaactaattattattacattaggcatgctaatggtatttcttttaggtatgcaccttcatcaaaagacacactttaacaaaaacgtgaagattaataatattccagtcggaggtcttactgttcaacaggcatataataaagtaagtaatactaaaagaaaatcaaaaatctacattaacaaaaagttagtttattcaggtaaaagtactgactcaggttttaagttatctgataaagaaagatttagtaaggcgttacattaccaatacactttttttccctcacgaaaacatgaaaatttgctagttgagccagctgatttagataagtcagcgttaaataatattgattcggcaatagtagctaggattcatcagctcaatataggcagaaaggccccacgtgatgcatacgccgtttaccagaataataaagtttcagttattccagcaattgatgggacacgatatagtgaacaaggactttgtaatattgctaataaggaatttgttaatgggacaattcatttaactcctaaggttattactcctttatcggcaaacagtaaagtagttcaagatgaaaagaaacacctgagtaaactacaaaatcgatcggttgtttatcaggttcagaaaacaaaatataattttaaagcgtctaatgtcatttctaaagcaacttatcagcatgggaaataccattttgaaactgacaacgttaaatccaagattgccaatataaataataagcaagcaacattaggaaagagctttaaatttagaactgattctggaaaagttatttctacatctaatcagggaacatatggttggaaaataagtagcaagcaggcaggacaaacactctctaaagcgttagctaataatgttaagagcgttaatgccgaaaatgatatttacggtaaaggctatagtcatcttggtactggatattcggctgtgaataatcatgggcttggtaatacttatgtggctgtatcattagctaaacagcatgcttggttttataaaaatggaaaatgtgtactgagtacagatattgttagtggatcagatgacgctaataataggactcctaaaggtgtttggtatatcatgtatcaacaaacgccatcagttttacgtgggactaatgatgatggttccaagtatagtagtcctgttcagtattggtctccgtttactttatcagggtgtggctttcatgatgctagttggaggcataattggtctaaaacagcttataaacagactcatggtggctcacatggctgtattaacatgcatccggaaaatgcaggagacggtttccatgcccttactaaaggagaaccggtaataatttattag

SEQ ID NO: 43 - DNA, 1932 bp, Artificial Sequence
  Based on Lactobacillus reuteri
atgcaattaaaccataaattaggagttttcttggcagcgccatttgctctactggttttatcagctacaaacgtgcatgccgataacattcaaagtaatagtaaccagacaatcagtaatatgagtttgcaaactaatgacacaaagactcaacaaaatgttgtaatgtcaaacgatgcaaaagctcaaattactgtaaatcctagttctaatgctaattctagttctgtagcaaagataaatgaaaagaataatgtaaaatcggatactgacaatactaatgtcgaatcaaatgctgataatattgggaacattgcttctagcgattccacggcagtggctaattctgctagttccgataatattcagtcatttaacgtaaatacgcaggaacagcctgcaataaatgtatctgaactaacaaccgaagagtatgttacgaattacactcaacaacagatcaataatgcgacgactattcatgattactttataaatcaaggatggacaccaaatgctattgctggaatgcttggtaactttgtttcagagtcaggtttaatcccagacttacatcaatatggtggtgggcctggttatgggttagctcaatggccatttaatagtgtagtaaattggtgtcgtaataatggatatgattatcgtactttgcaaggacaatgtgcatatattgaatatcaaatgactcatggacagcagtattatccatcagcttactctagaatgaccgctaatgaatatatgcatagttatgcttcagcatatactttaggtatgatttggcttaataactttgagcgacctgcaaataggaatcagccagctcgtggtcaacaggctcaatactggtatcagtatttccaaagtcatggttctacatcagcaccggtacaacaaaatcctagtacaccagcaacaactcctagctcaagtcgaatgagtcaacacgggacattcaaagttgcttatggattaaatgtacgccaagcaccaagtacatcggcagctattgtaacgtattacaatggtggtcaaagctttacatatgattcaaagattgaagctaacgggtatctttgggtatcatacatgagttatagtggcgtacgtcgttatgttgcaattaagaatttgaataatggaacgacttacggttatgattcgaataacttctcatacagtgctcctgcatcttcaacaccatctactaatgtgccaagtacgccagcaccaagtacatctacttcatcaactgagaagcaatatggaacattcaaagttgcttatggattaaatgtacgccaagcaccaagtacatcggcagctattgtaacgtattacaatggtggtcaaagctttacatatgattcaaagattgaagctaatgggtatctttgggtatcatacatgagttatagtggcgtacgtcgttatgttgcgattaagaatttgagtaatggaacaacttacggttacgattcaaataacttttcatttaatgggactccagtaacatcaaataataatccttctagtactccggcagttccgcaaggtaataagggccaacaagttgttgctcttgcacgtcaacaaataggtaaaccttatgtttggggagcaaccggtcctaattcgtttgattgttcaggactcgtgcagtatgtttatcgtcaagttggtgttaacttaccacggactacaactcaacaagaatattgtggacatgctgtaagctttaataatcttcaacctggagatctaatgttctggggaaagtatggtagtgcatatcacgttggaatctataccggaaacggtaatgttttatttgcaccgcaacctggtcaaacagttaaggaacaaccaatgcgctattacatgcctgcctttgcaagaagagtattgtaa

SEQ ID NO: 44 - DNA, 2297299 bp, Artificial Sequence
  Based on Lactobacillus reuteri
tctacttctactggcgtccctccagcaatcattacatcaggcgtgtagattgagaaagtaggcgttggaactaaaattatatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaactaaaattatatctcccggattagtaattgcagtaattgcaacagaaatcccttctgttactccttttgtaacaagaatctctgttgcaggatcgtactgaaggccatatttattagccaacgtatcggcaatcgcttgacgcaatcccactgttccacgttggggagcatagtgagttcgattgttttcaatgctctcaattccggcccttttaacatattctggtgtgtcaaaatcaggttcaccaattgtaaacttaataattcctgaaatttttgaaacgtattgggaaaaatcaaatacttttaacgttggaacatcatttaagatcttccgcatatgttcactcatttcaactattttacttaagatcccctttttactaactacatattttaattatatgacagtttaaaataaaaagcatagaacaacatcgattagctgttgtcctatgcttaactttataaaattagttttcaaatgctttgatcatccggtcaagcaattcaatatctgtatcacgtgaataaatatccataatttcatagatttgtggtgcagaagttgaaccagtaaaggcaaggtttaatgggaagtataaaccacgacccttaataccagtgtccttacccacttccttaatagcttgactgtaatcaaggtcatcgccaccgttttcaagtttagcctttaagcccttaagaacagctaaaacatcttcattagcgaagtcttcgttgtccttaagcaaatcatagttgaatgattggtcaagaaccgtgtagtatgaccatgcatattgaataacttcaagaagcttattaatatcccgttggtgaactttaattgtcttcttaagcaattcagtcaattgatcttctggaatactttgaaggcgcttagcttcttcagtttcgccttccttaattaattccattgtccgatcagttaatttatcgatcgacatactcttaatgtattgagcattcatccaatcaagtttcttttgatcgaagtatgctggtgcctttgacatccgttttggatcgtacaccttaatcaactcttctttagagtagatttcacgttcgccaactggagaccaacctaggaatgcaataaagttaaagattgcttcgtgaaggtaaccgtgcttcttgtattcactaatgaattgaagggtatctttatcacgcttacttaacttcttacgagtctttggattaaagatcaatggaatgtggcagaaagttgggtgatcccagcctaatgcttcataaatagcaatttgctttggcgtatttgaaatgtgatcagcgccacgcaaaacatgggtaatgtccatggtgtggtcatcaactactacggcaaagttatatgttggcattccatcactcttttcaatgatgaaatcaccaccaaggttgtcagagttaaatgaaacatgaccacgtgcaatatcgtcccattcgtaatcatggtctttagggaagtggaaacgaatagttggcttcaatccctttgcttcagcagccttttgttcttcttcactcttgccataccaacgaccatcataatgaggaggttcattgttagccttttgccgttcacgcatttcagctaattcttcctctgttgagtaatccttgtatgcaatgcccttgtctaataattcttgaatgtatttgtggtaaataccttctttattccgttcactttgacggtaaggggcatactttggatttggcttatttggaccttcatcccagtcaattcctaaccagtgaagattttcacgttggctagcttcaccatcttcaacgttccgcttggtatcggtatcttcaatccgtaataccatcgttccatcgaagtgacgtgcaaataaataattaaataatgctgattgagcatttccgatatgtaagaaacctgttgggctaggtgcatatcgaactctgaccttttgatccattatctaagactctcctttagtaactaatcgaaatataattccgatttaaaattggttgctagtttaactagcagtccttaaaaacgtactatccacattataataacacgcttttattgcaacaaatataattgtatatgaaacaacatatttgtcaattaactagttgatttcgcatgaaaaacacttagcaagtaatcctgcataagtgttttttcattgcttattaacttattgtcattaattagtattgttccatatagtgttgccgttcccagtcagaaacgtgttgacgatatgaagcatattcacgagtcttggcttccataaagctgttatagaggtgttcacccattgaactcttgataacctcatcgttagccaaagactttaatgcgttgtgtaaagtatctggtaaatcatgaatatctttttcagctcgttctgctttcgtcatcgtatagatgttttcatcaacgttatgaattggtggtaagttgttgcgtaaaccatctaaaccagcttcaagaacagcagcgattgcaagatatgggttagctgatggatctgctgaccgtaactcaagtcgtgttcccattccacgatcactcggaattcgcacaagtggtgaccgattagaagttgaccaagcaacataaaccggtgcttcataacctggaaccaatcgcttataagagttgacgattgggttgcaaattgcagtgtagcttcgtgcatgcttcatcaaaccgcccaagaaatggtaagcagttgcggaaagcttatctttatcattttcatcaaagaaggcgttagtgccatcttgactaaacaatgacatgttgaggtgcattcctgaaccattaataccagaaagcggcttaggcataaaggtggcatggaaaccatacttcttagcaattgttttaacaacgaacttaaatgtttggatgttatcagcggcttctaaagcatctgagtacttgaagtcaacttcatgctgaccaggagcaacttcatggtgagcagcttcaacatcaaagcccatcttttcaagagctaagacgatgtcacgacggcaatcttcaccaggatctgctggttccatgtcaaagtaattttccttatcgttaagattggtagttgggttacccttttcatcagtcttgaagaggaagaactctggctcaggtccaatgttaaagtctttgaagcccatcttccgcatatcttcaagaacccgctttaaattgttacgggggtcaccttcaaatggagtaccatcagtcttgtaaacactgcagattacccgcgcaaccttcccgtgttcagcaccccaagggaatgcaagccaagtggacatatctgggtaaagatacatgtcactttcttcaatccgaacaaatccatcaattgaagaaccatcaaacataattttgttatccatcaatttatctaactgactaactggtaagtcaacgctcttaatcgttcctaataagtcagtaaacataactcgtaagaaatgaatatcttcatcctttaccatttggcgaacttcatcttttgtaaatacgtgtttacccataaaatttcattccctttcatacaatctccacagaaataatagatgaccataccaatctatctaacatctgcttctctccttaacactgtgacttagaataacaatagacagggcataagtcaattctatttaagagctttattttaataaaaaaatctttccttccgtactttatttttttaaccaatcatttataaactgcttaatttgattaatatcatcgggatgacgcaaaatatcaaaccagtgagtatcagccttatttctaaaccacgttaactgtcgtttggcataatggcgagaatcctgcttaattttttcaatcgcttcgtcaagactaatctcgccatgaaaataaggaaataattcatggtacccaatccccttacctgccggcagatcttcccctccttgatcaaataaccattttgcttcttctaacaagccgttttgaatcatcaaatcaactcgcttattgatccggtcatataaaacagggcgttcagtagtcaggccaattaagagaaaatcatttgttgctttgaactggggttggttggaaaataattgacccgttttcttaattacctctaaagcccggataacccggcgagtattagacttggggatccgagtactagctactggatccaagtcgtttaattgctcccaaacgtactcggctcccttttcttcagcaacctctttccaatggttacgaatgtcgagcgtttgttgatcaaactggtcacttcccaatgctagattatctgttaaggtttgaagataaaatccagttccgcctgcaataatcggtaaatgattacgttgagctatttcgtctattttttggtcagcaagtttcttaaaacgggctgcagaaaaacgctcttcaatattgcagatatcaatgaggtggtgcggcacatcccccatttcttcgggagtaacttttgccgttccaatatcaaggcggcgataaacttgcatcgaatcaccagaaattacttccccatcaaattcatgtgccagttttattgatagtgcagtttttcctacagcggttggaccgacaattgcgattactttattcatcttaactctccaatttttataaattttatgctaaaacctgtccttctcactggtaaaacgccattaattcttgcataatggaggtaacctataaattcgaggaggttttatgttatgaaacaattagcaaaaggtattttagttggtagtttagcaacagttgctgccattgctagcggggttcttactttccataaaactgtcattaaaccagcggaagaagaagaagaaaagtttgatcaaaaccgtcgagctgctatccgtaagggccgctcagcacaccaactttaattttatttaagattcaaaacaagaagccatgtagcgacgcgaagctagtttcatattatcttgctattgttcgtgaaagcagttgaggctggaagaaaactttgttttcttccagcctcttttattggttaaattttacaagaggctaaattccaaacgttagcaaatgattgtttagaatcctcaaccatcctgataaaaagcatacaagatacttttttaatacttggacttcttagttttaccgtcccacgcacgataaccatcttttaagatataaaggtggttatactcatgcttacctaaaaatgcagcggcctgggtacttaatgtcattccttcatcatataagtaaaccggcaagtccttccgcaattcgccatattgttgacgaagatatggataaggcaagttacgtgcaccaagaatgtgaccttgtttaaagtcattttcttgtcgcaagtcaataacctgtgcttttcgcattccttgcttaaagtcatcttgactaaggacagttgcatatctctttcgacggtaagtctgaaatgcccagctaaaaatccatactaacaagatgattataatgactgcattaagaatcatcaagccagagctaactccaagtaccacgatcatttccccttacaaattaatctgcgtttacaaactgacgagctaatgaagcagcaccgataacaccagcatcattacctaattcagccaacttcaattgagttgaagtccgaactgttgggaaggcaaatttttcaaagttttgctttacccgcttcaaaaggaattcaccagctgcggaaactccaccaccgataacaaggtattcagggttcaatgcgttacttaagttggcagttgctaaaccgaggtagaagcaaacttcatcaacaacagtattagcaagataatcattttccttagcaaggtcaaaaacaatcttggctgtaatttcgtcaccgttatcaatcattgccttcaaacgactgttaccttcatattcttccgccttatcttgagcgatatgaacaattccagtagcggatgcgtattgttcaagacatccatggtttccacaagtacaaaggtatccatctggcttaacaatcatgtgaccaacttcaccaccagcaccaacgacaccgtggataagcttaccattggagataagtccaccaccaacaccggtacctaaagtaataaatgcaacatcgtcaccttcattaccagcgcccttccaacgttcaccaagtgcagcaacgttagcatcgttatcaagagcaaattgcatcccagtgccttgttcaatctcttctttaacattttgagttgtcttccagtttaagttgtaggcaccaataacggttcccttttcacggtcaattgttccgggagttcccattccgattccaataaattggtctcgagacattttatataaatcaaggtggtgattaattgagttaatgatgtctggcacaatgtgtgaaccatcatctaaaatgttagtccgcaaagaccacttttgttgaatctcaccgttctccgttaaaattgcaaacttgatagtagtaccaccaaggtcaacaccaattaatttcttagccataatgattcctttcctgggtaaggtttaatacaatttaccccttttaattctcgtttgttcttcacgatgttctttacgcaagacaatctttgcttttgtataagttgagttatctacaactcctgattgatagaggttatcgagctcaatagccattaactcaatatcatacagtcgtttacccacatatacaaacacgttgaattcttttaatagttgctgaacatcgtatagtgtgcggtagtttcttgaggcgattgccataaattatcacttcaattctagagtcaaaattaccaaacttaccgttaatacagctccacttaacaaccgtttcaggtaatcaacagttcctaacatgggagcaccaacaataaatacaatgaaaaagccaccaaataggccgccaatgtgtcctaccaagtcaactcctgacaggaaaaaatccatcacaatattaataataataaataacacaaaaaagtacgacttaagacgcgaacaataacattatggtgaaagcaaacacccaacattaaaaatgcgccaaataatccaaaaatagcagtactagcaccagctgaaactgtcgatggcatgaagaccgcgctggtaagattaccaaaaaacgcgctgacaaagtatataattaccattcgccaatgaccaaaaaactcttcaatgtaacggccaatatataaaagcgtaacgctattgactactaagtgtgataaaccaacatgaaggaacacaggtgatactaaacgccaccattcaccttccctgattaagggcgtactacgagcacccatattcaggaaggttactgtattagttgagccacctgcataaactaaccagcaataaactaatacctgaaaaattattaaggtaagcgtcacgggcgccaatcttagtccctgtgtccgcatcttctatatccccggtaaatacaacactttatctattcgctgatcgaattcttctggttcccattcgttttcttcagccagttgcgttgtcaatgccattgaaactttagggcccttatagttttttaggtaacgatcataataaccgccgccaaagcccaacctgttaccagatgcggtaaaggctactccaggaacaaccatcaaatcaatctcatctggagaataaactttgccatcatgtggctctaaaataccaaaagacgtctcgtcgaaatcggtatcctcatttaattcaacaaattccatttgacgatggggcaacgtccgtggaacaacaatctgttggcccttatgacgcgcatgaaggataataggttcagtatcaatttcaaaagattgacttaaagtaacagcaattgttttagcccctgtccattcaggttgatcatatagcaaagatgctaactttcgctcttcgtaaagacgggtgtttaaatctaattgttgaaggcgcgcaatatatgcttgtcgtaactctttctttgaataagccattatgttatgaccgctcctttatagtgaagtaacaaacggtatcagattttattatcaccgcttgagtgaatttatgcaagcgtttttttataaaaataaataaaaagagccggtctcccagctcctttatatggtcattacttagtttcccgatgtaatgtaaccttttgttcccgtggacagtacttgtttaattcaagacgatctgggttgtgacgacggttcttgctagttaagtaagtccgttcgtggcatgaagtacattcaagtgtaatgttgacacgcattattttgacctccaaactatttcttttatttaacgtggttatttatcgtaaccctaactcgtacaactatatcatttattcttctatttggctagtaatttatcaaagtttgttaaggaaatttccttgacagtttaattagtcaccgaaacccttgggactctgaacagtcttccagtaggcttcaaaaatttgttttgccattgtcaggttggcaccaccatcggaatttgaagctcctggaatagccaaagcaactacaacttgtggattatcagatggcgcaaatccagcaaaacttagcgtagttgttgagtgcgacttgtagtaggtttcggcagtccctgtcttaccagatactgatggtttaacagatgccaacgctttaccagtaacataacggttagaaccatgaaccacttgataaagcccttgtttaacgacatcaaagtcagctttagaagcaggaatggttaattgaacttggggctttgttgtatattcaacggcaccaagttgaccattggctttcgtaccacggatttctttaacaatgtatgggcgcatccggttaccaccgttagcaatagtagacatatattgggcaagttgaatcaaagtataaccatcatagttaccatatgacaagtcaagtgctgaaccgatatgcttttggtcagcaggtcctgtataaccgcttgtttcaccaggcaagtcgattccagttttaacccctagtccaaacatgttgaagtaaccccgcgctttagcaaaaatacttggcttcatcgtaatttgcgcatttggtgtatatttcattcctgcttctttcatgagtagttgcatcatataagagttggaagaaacttcgagcgccgttgctgcattaattgccatatttgctgatccaccatggttaaaccatgatcccttagatgaagttccggcaagcttaattggcatatcggttaaggtattatttgttggcgtaattacaccatccattaatgcccccatgaccatcgccggctttacaactgaacccatcgtaattgggtggttgatagcaccaatttcatcaggggtttctttacctgttgctgggtcacggtcaattcctgccatcgcataaattgcaccggtatttggattcattactactgcatataccccagtagaatactggtttccggcagctgagtaattgtttttcaaaatcgattgaacttgcttttggaattttgaattaatcgttaatacaaggttatcacccttcttaccagggtacttagtcttttctttagttacatcatttccgttagtagtaacttcagtttgtgacttcgaaccagctaaagttgattggaactgtttttccagataactttgtccaacgctatcatttcgagaatatccttgagcaagcaatgagttaacttcatcacttggtaaaccagtagttgagacagttcctgttaacgattgaatatctgtaccttgggggtaattacgagtccaagacgttccaatctttacccctggcatttcattcaagtgttctccaactgctgcaagctctttagcactaacacccgtttctttaatataagttgtcgaaagggaatatgctccactcattgccgcataaattcgggcattattcttttgctgatctgtaagttcccatgaatcaggatgcttgctcaaatattcgagagctttattatatttagtatcttcagaatcggcatctgaagtcttgacatgtttcaaaacactcttaagccgctctttatcagcaaggtaataatcctcttcatttcgatcagttaagcgcgaatttttattagaaacagacacatattttcctaaacgattagcaatctgatagagctgatcagtagttacattagcccctttagtataggtaatggcttgatgagtttgattaccaacaagaacattcccttgtgaatcataaaccatcccccgttgtacattattcgtctgcgttgttgtatctgatcgctttacttccgctttaaatgatgttccttgcagaacttgaagataaaacagtcgaatagttaacgctaataacaagataccaacaatccataatagcatgttcagccggaatggaataattgactgcgcattttgacgctttttggcacgtgaaccaaacaagttcattattcgatcaaagaatttcacagttttataattctccttcatcgtagtgaatctattttaacaaaaattacctgctttaacagatagttaccactactaacgtgaaaataatactctttattttataagaaatgaagaatttattccaatgatttaatgaaatttaatgaacaatagtaatgaatatcattttaaaaaaggatatgataatgtggatgtgtctatttaattgagagaaggagaattttgctgtgtttttatatcaacatcatcgtttatatcgacgcaaaattttgattgcaagtttcctattaccagttattttgatggcttgctattttgcataccgtcaaatgactccctttggcaaaagcagcttattaaccgttgatctcggtcaacaatatgtcgattttttcagttaccttcgaaatactattctccaccatcccagcagtttcttttattcgtttagcaaaggacttggtggcgaaatgtttggaactaatgcgtattacttgctaagtccattaaacttaattttgttattcttccctgctcaacaccttgcaactgggataaccatcgttacactcgttcgatacggtctagcgggattgagttttgcttggctaatgcaaaaaacggatctacaacaggggtggcgaattttagcattcagtacagtctactcaatgaatggctggatgattgccaaccaattaaatatgatttggcaagatgctttaatacttttgccgttaattatttggggactcctcaaacttatttatcaaaaccgtgttggaacttatatcgcttggctagccgtaatgctgattgataattattatatgggctggatgattgccatctttacttttctatttttcctctggcaaacaccagcgttagcctcatggcgacaacggggagtaatttttctccgctatctcggcagttcgctgcttgcggtgggtatttcagcagtcattttattgccaactttctatgccttaatgcaaagtaaagggatctacactgaaaccaagattcacagccgttttgagtactttgctcctaaaatgcttgggaaacttgtccccggatcatttaattttaatcaaatgccaagtggtcagcctaacatttatatcggaatgctattaatgctcggtgcttgtctctacttcttcaataatcactttgaccttcgtcgtcgtttgattggggcagccatttctattttctttattttctcattctgttacgaaccattagatcttttatggcatgccggccagtttccagtttggtacccttatcgtttttcctaccttttctctttctggtgcatctatcttgcagctaaagtgcttcaacctgatttcaaaataaaaaagcgcagtgcacttatcctgacgttgcttattatcgcaatttactggtatgttggtacgcttaacttatcgtatattaatagcaatcaacggaatatcggcttatgcttttcgctgatcgctgttagttgcctttgtattccccgaacaaattcaccgcgcttatacgacgcgcttcttgttctccttgctgtctgtgatatttctatgagtgggtacacggcgcttaataagatctcttacgtttcacagcctgaatttggcaactacactattgctcttgataaaagtgtaaaaaaactaaagaagcatgatccgagtttctaccgcgttgccaaaacttttatgcgaacaaaggatgatcccttccaagcagactttaattctggtgaccattttggttcgaccttagagccgccaattccagccttcatgggtgcaattgggcagccagatggggatggttttgttacgtatactaatggaactcaagtgagtgatgcgcttcttggttacaaatacactatgaatgctcggaacacgtcagccggacaggcattacccctatcaggtttccgtcctgattggtacagttacccattagtaggatcaacttcggcagtcaatctccgtgagaatccacatgctcttccgatcgcatttggagctaataccgccatccttcaccttcaacggacaacaatggatccgttaaactatcagtcacagattttccaaacgcttgccggtcgtccaacacttcattcattatttgccgttcaaaactttaattccgtcaaattcaataatgttcaaagtgctaagcaaattactggcacgatctttagaaagcaaaacctgcttaaaccagcatcagttcagctagaatttattccgccaaccaacgattcttactacttaacgctcggaccaaacgttgaggataatgccacaattacgatgaataacaaaaaattcacccaatatgacacctttcgtaatacggtagtaatcaacgttgctcatgatcaaaaggggcaaaaagtccttgtcaatttgcaactaaagaaagctacactttggatgcaaaacgttagtatctatcaactaaagcaacggccatttatggcaagcttaaagactctccaagaatctcccttaaagattagttcataccgtagtaatcggatcgttggtacagtcaatctccagcgaaatcagcgagtattaatgactactatccctgctgccaagggttggcacgttaaagtagatggtaagtctactactccacaaaccgtgcttaatacgtttatggctattccaatgagtcccggaaagcatcgggttgaattttattatcggccaccgtttctcattctcgggcttataattacagttataagtctcggtttaactggttggtgggttaagaaagaacatcaaataaggacaatgtttgattaacaataaagctctttagcatactatcattagaatagtttatgctaaagagctttttcactatataaaaaattaatgctgagatgctccagtagaggcgtcagccttattatcggaatggtcatcagcgtcattaacaaatccagctacgtcaggtgtatcaccatcttcatgttgaaaatgaaaaaccggtccgtcggcttgcggatcatagtcaacagtagttataagatccttaaagaaccactcatctagcgaatcaatgtgatagttaataccatcctttttaacctctaaaattggatcaactggtgtatcttcacgagtgaatccttgtgaaaaaccatgatggacttcggtttgaccataggttttaccgtaaaactttattccatttcctgattctaatcccatttcgtcacgaaaccattgacttgcagcatcagtaataatcaatttcatttttcttccctccaacgttcagtgatatcgctttcatacatcttactatagcatagtagaaaaataataccaataagaaaagcgagattgaggaattcaccacattcctcgacctcgcttttcttattttaattaatcaaccttgacaatctttagcttgattgtcccattaggaacttcaacttcaactacttcgccaactttgtgaccaagtaatccttttgccattggagattcattagaaatcttaccgttaaatggatcagattctgattcaccgacaatttggtattcttctggttcttcatctggcaattcttgaatagtaattgtccgacccatagatacttcatccttatcgacatcttcattatcgataatttcagcatattgaagcatgttttcaatttgagcaattcggctttcaaccattgcttgttcgtcttttgctgattcatattctgagttttcagataaatcaccataactacgagcaatctttatccgcttaataacttctggtcgacgcttcaagcgatattcttcaagttcatcttcaagctttttcttcccttcaagggtcattggaaaagttttttcttcagccattataaacactcctcataatttatccagtgcaacattaccatttctacttcagcttgtaaacacctattgtaattccgtatgtccacgttttaccaaaatatcacggatctttgtcgacaataggtcaattgcaacttgattttcgccaccttctggcacaataatgtcagcgtagcgtttagttggttcaacaaattgatggtacattggcttaaccgtagctaaatattgcgtaataattgaattaagagaccgtccacgctctaccatatcacgttgaatccggcgaataatccgaatgtcatcatctgtatcaacgtaaaccttaatatccattaaatcacgtaaacgctcatcatcaagaattaagattccttccaaaataataacatcggttggttctacatgaacggttttggctgaacgtgtatattgtgcatagtcatataccggcatctcaatagccttattacttcgcaaatccgttagttgcttaattaaaaaatcggtatcaaatgcaagtggatgatcataatttactgctttacgttcatccattgtcatatctgactgatcattatagtaagtatcttggttaataatctggatcgcttgcccatgcaattggtcatagattttattacttaccgttgtctttccactaccggaaccacctgtaacaccaataactactggacgcttattctgttgaatactcatcaatttgtctccctcataaaactttctaatctgaaatagtatatagcactcttttgtgatgcgcaagataattactaatttaaattattaaaggtgaggtgaaagggaatattaatgcatcacaacatagtaatttccagggaagtattgttggtcagtaattttaactgtttcattttcatttggtgcttgaataatccgaccatctccaagtgaaatggcaacgtgatatggcgcatcatcagaaccgtagaaaacaagggccccatatggcgcgtttaaaacattatcgtgaatatgtggtcctaaagcttgttgttcatacgtcgtccgttgtggaataccgtaacaatattggaccaacccagaacaatcaaatccacctggtttattaccaccccatacataaggggttcctaaataagacattgccttgttaacagaatcttgtagactttgactgttcttgctggcttgatcctttttctcagcattattagcaggtgtttcatttttatctttggttggaattgtcaacttttgtcccacaaaaatcaactctttattttgcaagtgattagcggttgcaatatcatccgcactaacattatacttttgagcaatcccattcaaactatcgccagcattgaccgtaacggtcgtatcagcctttgcagttaccgtgcccattgccattgcgccagctacccctaacgacgatgcaagaattttctttgttgttgatttcattatttcgtttatccctctttatattaaatatcattattttattatcaaactattaataaaatagcagaaaattttcagcgcttcaaccactaattattagtttagtgattagccctataatataaatacgtaaaaaataattatttgcactaaaaaaaggccgaaaaaatccagccttttaatttttaacgaatttctgcatcaaccttatcttgcaagtaagcagtaaccttatcaaaggccgtgtttacttggtcttcagttaacgttcctttatcatcttgataagttaaggtgtaagctaatgacttcttgccagcaggaaggtgagaaccagcataaacatcaaataggtgaatgtccttaaggtaagcaccacccttttgcttaattgcctctacaattgttgcattttcaacatcatcatcaaccaagagagcaatatcgcgagtgattgaaggatacttactaataggtgtatattcattttcaatctttggtgcagccagtaataattctagatttaattcaaatacatatgtttctggaatcttatattccttagcagtttgtggatgaacttgaccgatgaagccgactaattggtcatcaaccataatatcagctgttcgtcctgggtgcatttctggacgatcactagttggaacataagtaatcttcccagcaatccccatattcttaaggtaacgttcaacgatcccctttaattggaagaaatcaaccggttgatccttcttattccaactattagctaccatttggccagtaaccgcagctgcaaggtgttcttgttctactggacgttcatcccccattggcaggaatattcggccttcttcatataatgctacgttatcaacatttcgcgccacgttataagcaatatcattaagcaagccactaacaatattcatccgggtagctacatggtcagaactcattgggaagtcgagtttcatcggttcagcaagtggcttaatttggaactgcttagccttctcaacagttgttaaggaataactaattgcttgagttaagcccattccttcgagatcatgacgacttgcccgaataaaccgttgacgtggcgtaagtcctccccggttacgcgtcatcgttggtaaagtagacggtaagttatcataaccataaatccgtgcaatttcttcataaagatcagctgccaggctaatatcccaccgccgtgctggagcaatcactgttaattgatcgtcatcatcaacagtgtaagcaaatgccaagcgatcaaaaatatcagtaacttgttccatggttaatgaagtgcccaggacatgattaatcttcgcaagggatagtttgattggcgtatcaactgctggcgcttcactaccagtaacaattccagcagtaatcgttcccccagcaagttccttaatcatttcagctgcttcattcaatgccgtttcaactgttgctggattgattccacgttcaaaccgcattgaagattcactatgaagatctaagcgccgtgcttgcttccggaccattactggatcaaaaatggctgcttcaagggcaacagttgtcgtatcatcacttactgcagttccttctccacccattgttcccgcaagagcaactggttggtcatcgacagttacaacaatatcatttgcttttaaggtttgttcatccccatctaatgtaacaaacttttcaccttcattagcatgacgaaccccaaagttgttaccagataattgatcataatcataactgtggagtggctgaccatatttaagaaggatatagttagtcacatccacgacattatttacaggacgaataccactgttccagaggcgaatttgaagccatagtggactttcggcaattttaacacctttaattacccgtaatttataagttggtgcaatcttagtatcattaatttctgcttggagaaggtccgctgtcttttcagtgccttcttctttaatcgtaatttctttaaaatgtggctttaatccataaaaggcagcgatatcattaacatttccataaatactaagcatatctccacggttaggagttacgtctgtatcgatgatcgtatcgtccattcctaagtacttaaatacaggatcaccatttttagcatcatctggtaagaagtagataccatcttcgtaatctttaggcgcaatcttgtcgctaaagccaatttcttgaagagcacaaagcattccatttgactcaacaccgcggatcttgccacgcttaatcttttggttatcagcaattcgcgcaccgtgaagggcaacgattacctttttaccttcttggacgttcggggcaccacaaacaatttgaatcggttcttcttcgccaacatcaacttgacaaacatggagatggtctgagtcagggtgattttcacattttactacttccccaacaacaatcttttttaatccgtcgctcagtgagtaaacgtcattaatgtccacagaggtacgagcaatcttttcagctaaatcttgaggggcaacatctaaatcaaggtattcttgaagccattgatatgatactttcatttcacattatcctttctggtcaaattggttaaggaagcggacatcattttggtagaagttacggatatcatcaacaccgtacttcagcatggcaaaacgatctggtccaagtccaaaggcaaaaccgccgtattcttctggatcaacgcctgacatcttaagcacatttggatgaaccattccggcaccaagaacttcaatccaaccagtttgtttacaaattgcacaacccttgccaaggcagttgaaacaagtaatatctgcctcaactgatggttcagtaaatgggaagtaacttggtcgcaagcgaacctttaacttgtcaccgaaaaggttttgagcaacggcctcaagagttcccttcaaatcagccatggtaatatttttaccaacaaccatcccttcaatttggtggaattggtgactgtgggttgcatcatcagtatcacgccggtaaaccttacctggtgaaatcatctttagtgggccttgactaaaatcatgtttttcgagcatccgtgcttgcattggtgacgtttgggtccgcatcaaaacagatggcgtaacataaaatgtatcttgcatatcacgagctgggtgatcctttggcaagtttaacttttcaaagttataaacttcttgttcaacttcatccccaactgctacttcataccccattgatacaaacaagtccacaacttggtcaatgatttgttgaataacatggggttgcccttgtgctactggtgttccaggaagagtaacatcaattgtttgggctgctaacttagcattcatggcggcctgttctagctcagcacgcttttcttcaatcgcagctgataattcatcccgcaccttgttagcaaattgccctactttaggacgttcttcagcactaagatcacgcatgccccgaagaactgaagtaatcggtcccttctttcccagcatcttgacgcggatttcattaattcgctttaaatcctctgattgtttaatatcttgcaatccttcttcacgaagttcggctaatttctctcttagtcccatattttcactccttaattcaaaaaagcctcatcccaatatagggacgaggcttcgcggtaccaccctagtttgtaggaacaaatcctacacactcaaataatcaataacggtgattggccggaataccattacgtatcagctccgaaagtgaaattcgccttagatcgctgattgcaattctcagctcatggttgcaactctctaacaggatcgtctagctactagctctcatcatcgcttttaattcaattacatattctagacaatcatctgtaaggcgtcaagcgttattttaaatccacttgtcactccatgcatgaacagcttccatgactgggcgcaattcttgaccacgttcagtcaaagaataatctacccgactagaaccttcgtaagtgttacgaataacaatttgttcgtcttcgagttcttttaatcgttcacataaaactcgatcgctgcactttgcaatgctactggcaatatccttaaatcgcatgttgccatttttaagtagtacttcaatgattaatccgttccatttctttcccaagatcataaacgtacgtgtaaattttggacaaagtttacagtcttcatcaagtgccttttctgctactaattgttccataatttaactctccttctcctctaccaagttgtttgcattcgacgtttcttaatctttcgacgcatctttgcacgtagcgggccaaagaattcatgctctgcttcgaaatcatcaactagcgatacaattaaactctccggatagcgtggcactgccaacgttgcgccaaacatatgcttaaggataatatccttttcttttttatttaacggggttagcttttcagcattgcgtaatgcaactcggggatgaataaatgcatgggttcctaaattaaacttagtcgtccgccaatcataataaaagagatcatgcaagagacctgcccgcgcagtactgcgataatcaagatgcatttttttagcaattttgtagctatcatacgaaaccgcaatagaatgttgcaggcgggtagagtgatgatgctgagtatagttcgctagcttttggacagctggctgggctaaaagatcggcaacgattgaaacatactctttatcggtgcgccattcattttttgatttcatgtaataccccttttctatattattgcaattatcatacacgattttaacgagaaaataaattaatttaatctagattttgattaagctgaaacattaaaattcctgcagagatagcgacgttaagcgattcggcttcaccacgcattggaatatagagattatcagttgtttgtgaaagaagatcgtcgctcatcccctgcccttcattgcccataattaaggcaaaagtatcaccaggatcaacagtccggaagtttttggcttggggattcagttgcgttccatacaccggagcattgattgatttaaaatcatcaatccactttcttaagtcaccctcaaacatttgaaggtgaaattgacttccttgcattgaacgaacaactttgggaccaaataagtctgctgagcgttgtccaactactactccagtaaacccagcggcatctgctgtccgcaccattgtccccacgtttcctggatcttgaacccggtcgaggaaaagccatgccccatgcaatggccctgctggtaaatgatgagaatctggtaaagcaacaaccgcggcaatcccttgaggcgttaccgtatctgtaatatgcttcatgatctcttcagtaacttcataggttgcattagccattccttcaagctctggatgggcagctaattgttcagctgttccgattacttctaagagctcgattccagctttggatgcctcttgaactaagtgccagccgtctaacaggtaagtaccagtctgacgccgtgcttttttggtttgcagcttcttccaatctttaacgtgctgattatgaattgatgttaattgttccatatattttgcatgctccttcttgttaattaaattataccatgttcctgttgtacaattgttattaactaataataagttttcattaagtcatgtggtaataagtcaggatgtaattatcactgactagcttgtcttgaccagattttgggcgcacttaaataagccttgataccaaggtgttttaaaacttaagcgtcgagaatcattttatctttctataccaattacctcttttcttgatagatttggtgatttttgagtaggaagaaaatcaccctgactaatttacgtgcggtaagaacgagagctcgtttggatggagtacgtttcacttctttatattttcgttggtaatattcaccgaaaactggatcttggatcctaactcggttggcagcttcaaccaagtagtatctgagataagcattaccagttctcttaagtggtgtattatcgctagcgtaatttcccgactgcttttcttttcaggaaagcccagcatatctagctaacttagcttcattgtcaaatcgttcgatttgaccaatctcagctaggattctagctgcgtataccggtccgatgccgggaattgagcggagaatttgttcttcatcaattactttaacaatcttctcaattgccttgtcgagatccttaatcattttttgaaaggctttaatctcttcggcataaacagacaagaccgtatccactgaattagcgacaactttatctaaacgataagaagagagaacagccttctgaattgttttagctagggcttcagggttcgcgaagcgacctcgtccatgttcagttaaatacgcagttaagtcggaaagagaaatattgagcaggtcatcggtagtcatatcttcagtcaaaagactcatcatcgtcgaaccgaagactgaagtgtttagctcatcagaaatcactagttcattgagcttatagtataagttctcaataaagtgttgcttagcacgaactagactttgaaccagttcataacgtgaacgtgttaagcgttgaagagcaatgtaattgtcctgacggacaaatccaactgagtagtgaccaacacgtaaataatcggcgatgtaaaaagcatcgatctgatcgtttttgtcttcagcgaaaacatcatgatagcgtttagttttcttaggatcgatgacaacagactgagtattcagctttttcaagtctgaatcttcttgaaagaacatcgctgggtgaaaactataaatggaagtagcttccattccgataataatttggtctaaatgatttgaattcgccgtgttgataattacattttttaattcggttgcgcctttcaaatcattaacgaagttaccttggaaaacaacttcgtggtttccttcggaaatcatcgaggttacaagatcttttgagctaacgtcaataccgacaaatagtttcattggaatggcctcctttcattaaaatttactggtcttaatctgatcactgcatgatagcccctaattacaatcactaaagacatcctcgcaagtatcagtgttcattggttagagaatcaaagctgcacctaatcctactctgaattagtcgattctctaatcgatacagcatgtgagttcgaaaattagttgattgcctgggcggcagacttaataagtagttcaaactacaggaggtattaacctataccagttgaccaaagccaatgataattagaggttatcatgcggtgaccagaagacaagatgtaatgtagcaaaatccgtaaagatttatttatagaatacgaggagctttaattatggttaattatcatcttaccattactggacgcgttcaaggagttggattccgctggagcgtctatcagttggcacaacaagcagaaatagaagggatcgttatgaataagcatgatgggagcgtttattgcgaattgcagggtcccattgagattgttaaacaattaatctctaaaattaaagctggccccactccttatgctcgaattactaaggttaaaatcatcgaaggaagcctgcaaaactaccatcattcatttcaaatcacgcattagttcgcgattagcggtagaattcaattcctgaatagagtaaaatacgtactattaacgtaattaatatacaaagaaataagggagtttgattcattaatatgaaacgaaaacgaataacgatcgctggggggctctttaccctcctgctgcttcttagcggatgtgtacggactactaagagcggtcgaccatacgggtttgtctatgactatatggctaaaccaatgcagcacttgatggaatggttagccagccacatgggcaataactacggttgggcaattattgtcattgtggtagttgtgcgaacaattcttttaccggtgatgttctcacaaatgaaaaaatcaaccattatgcaagaaaagatgtccaaggttcaaccattgattaaagaactaacagaaaagcaaaaagcagccaagactcctgaagaacaggctgccgttagtcaacaaatgatggctctgtaccgggataacaacattagcttaactggcggaatcggctgtctcccattgttaattcagctgccaatttttgccgccttatatgctgctatccgttattctccagacctttaccatgcaactttctttgggattccacttggtaagccaagtattatcttagcggtcttatcttttattgcctatgctgctcagagttatcttgggcttgtcagtgttcctgaagcccagaagaagcaaatgaaggctgctatttggatgagtcctttcatgaccttcttcatttctatcacttcttctgccggattaggtctttacttcttcattggtggattatttgccatcttacaaaccttgatggtcaatgcttaccgtccgcggattcgtcgccaaattgaggaagagagcaagaagaatccaattaaaatgccagaagcaccagtaattaacacccctagttcttcaactaaaccgactgatgcaattgaccaattacgtaaaggcgatgccaagccaagcgatcaagcaaaccgtaatcgtcaacgtaatgctggcaaacagcaacatcataaaaaataattattaagaagctgggagaaagcaaaagttttttctcagctttattttttcggaggaagacacatgattaaaccaattattaaagaccaacaattacttgctaaaaaagcaaccctaactactaaagctgatttgccccttgcaaccgatcttagcgatacgcttaatgctcaccaagctgaatgtgttggaatggctgccaatatgattggtgtaaataagaatgcaattattgcgcgaatcgggccctttaatgtcgtaatgttcaatccgcaaattgtcgctaaaagtcacccttatcaaactgcagaaggatgcctttcattaagcggaacgcgtcctactaaacggtataagcaaattaccgttaaatttcgcaatcagagctggcaaacgcaaacattagaacttacagattttgctgctgagattgttcaacatgaaattgaccattgtaatggaattataatataagcaatgagaatatttgctaaaatatcaataaatgaaataaggaaagtagaatcgccgggttctgcaacaaattaagttatgcttctcaaacaggcgtccaactgggaggatgggagcaagttttgtggaggttttaatatggattcaccaatgtcaattaccaaagaagtacggcattatgttattcgtaatgttgtcgccaccctcgggatgtcaatgtatgttattattgacaccctttttatttcaatcgcggccggggctttaggcttaactacgcttaacctggtgctccccctgttcaacgtttttaatggaaccgggctattgctgggagtcggtggcgccacaatcttttcgttaaataaagttatgcatcctgagagaataaaatcattatttagtcaactgatgatttttgcttttacttttgggcttatcctagcaatcctattaaacatttttgcaactccagtagttaatttccttggggcagatgatgccactcgtcagatggcaatcatttatttacgaataatttcatggagcggacctctctatatggttaattacattgccattaatttcattcgtaacgatggcaatcccacgttaaccatggaggccaccttaactgaaacattatctgttattctcatcgactggttctttatctttggaatgggtcttaaattggaaggagcagcattggcagtgttattttcgccagcaattagcttgatggttttaagttttcatcggaagtttgccggacgacaattacaatggcactgggttgtccctcacctaagaaacatttggcgctcagcacgtttaggggttgcttcagcattaaacgaattaagtactggtgttagtatctatttctttaaccatgttttattgcaactagctaataactatgccgttgccgcatatggcgttatttccaacattgccatcgttgtgctagcaattgctaatggagtagcgctcggtgttcaaccgcttgctagtcgggaatttggtaaatacaaatacaagaatgtatcgatgacattaaaaaatgggattatcattaccctctttctagcaacaatcagctttattatcctaattacctttaagcatccaattattgaagtttttaacacttctcattctggtcaactcctcgcctatgctagtgttggcctcccgatttactttacaagtgtattcttcagcgcgttaaatctattgttcatccttttcttaacagcaattggatcagcgcgagcatcattctctttatcgattcttcgtggttatattatccttctccccgcaatctttattctggcaaaagttgccggaattaatggggtctgggcagcagttccttttactgaatttgttattacttgcatcggtggaattatcatttaccagcgacttaaaaaattgaataaagagtaagtggaaaataaccttctcgacaaggcggtgggctaaggatagaacggtgattagcacggcacgggctgattatcgttcgtacttagactcgagccttgtggcgacgcgaagctagttccacgttatcttactattattcataaaagtagttgaggctgagagaaaacaaaagttttctcccagcctcctcttttatctactttgtaatcttctttgatgcgtgattgtagaaaatcaaagcaacaatcccaaagaagaccggaccaaatgccgtccagaatgcagtttgaaaatcatgctcaataattggttggatgcatgtaaagatgattcctaggcaaacaattatctcaacaaagacaactaatacatttgtccaaaaatgattcttaaatactacaaaatcatgtgggatatccttcttttgaaagaatgggaatgcaccaacaaggaagatatacggggcacaggttgaaacattaaccatatctgtcaagatttggtaaaaactagcagctgctgaacccccaaatgcaactaagaaaataatacacgaaacaaaaattgcctgaatccacattgcatatgctggcatcccgtgtttgttcaatgtcacaatttttttaggccataactcaggattagctcccatgataaaggacttaatcggggagtaaactaacaggaacattgctcctaacatccccatcaggccagctaacgcaatcattcgcgtaaagagaacaccaagaaaaatattagtagcatgacttaaccctagtgacacacctagttggtatcctaattgattaaagacaacataagtaacattacctaagttaacgcttgattttgcaataacatgattgtaattaacactaaagccagtcattaaaatcattagcacataactgccaatcgttaagagcgaaccaataactaagcctcttggaaatgtcttcgctggattcttcatactatcagtaactccacctagattttccattccaccatatgcaaagattgcgtaaacaacgaatgaaataatcgcaattggcgtcttaaaagcaggattaggcgactcaataaaactgctaataccatgaataggctgggcagtaacccccttgttagcaataatcgctactaaacttgcaataataaaaattgcattcattccaatcataaacgctccaccaaatgagctgattttcgtaatcccattaattccctgggaactcagtaaggttacaagtaagacaaaaagaatggccaagataccaattaactgattagaattaaagatccaaaaatgccattgttgggtagtatcatggccaaataatagtgccgacaatgttatccaaagtcgagaagcacttgatactagccacagaacccaactcgctaaccaaataaaggttccgataaaggccagctgttcccctatcgaaccagctaaccaggaatagattccccctttggcgtccttaaatgccgaaccatattcagccatcatcaaacaacaggggaagaagaaacaaactccagcaaggatgtaccaaaacatccccgcatatgccatttgatcataggctattgaaacattaccaaacccatatattgtcgaaataatcattaacaccaatgttggcgttgtgattaattttttctgctctttcgcagccactcctattcaactcctcaataaaaatcctcatattttagtatccgttttcattataccgcccttagttgaaaacatcgcttattttgtcggccattgagaaaacaattaaataaaaatgttttgtaataaaaaagtgaggataggagcaaaagtttctcatcctgcttctattctcacatcttaaatatttatttttttgtctctggatcttcaataatcggtaaaatgattctaaacaatgatccagcaccgactgaactttctagggtaatcgaaccatggtaaccttcaattagtcgtttggcaattgaaagacctaatccattgccgcctttcttacgactacgagccttatctactcgatagaagcgatcaaagacccgttttacattttccggtgagatcccttcaccaaagtcttgaataccaatctcaacagtattcattccccgtgaaagaataatatggatctctttatgatcatcagtggaatatttgacagcattgtcacataaaatcacaaggacctgttcaagatgatcgcgataaatatcaaccatgattggttctttcagatcgtcgtccaaacggaaagtaaagtctggatatagcatcttaaagttattgtagacctggtgaaccacatcattaacaatcgtatgctggttgcgaaaattaatctctacttgctctgctcggctcaaatcaagcatttcttgaaccaagtttttcatccggcgcgtttcaattaatgttgccttaattgagtcatccagcacttttggatcatccttgccccatcgctgaagcatctctaagtgtccttgaataatcgcaacaggggttcggagttcatgactaacatcactgacaaattgtgactgctggtcgatataccgctgcattcgatcaagcatttcattaaacattgttatcaattctgctagttcatcgttacgattggtagtcggtacccggacatctttagtaggatctgcactaatctccttaactgtgtcatgaattccatccaatggtcgaaggagaaagagggaaagaaagtatcccaatagcccactcgcaatcaaaaccaggcagagagccaagatacatactaatgccaactgatgataactttgcatataagcgtcaaggttattttcaacttgtaagtacccaatcaactgccgattattctgaccataaattggcatctgcccgaccaacacatcatgatcaggcccagcagcaatatgaatattgcgattagtcgtaaactgcggctttttaatataacgaccagtactcaaaatattctttccatcaggattataaatattaataaccaagtgtccatcacttaactctttaattaccggtcgtttatattcctctccagaaataatattcgaccggtttctgtctggatcaataaggtgactaacattctttttagttaagggcttatcaacagtacttaattgtgtactaatattagtcatcccttgattcaataattgtctttcttgatgaaataaattttgcgtaaacgcgctaaacaatgccatcgcaacgatacaaaagatgattaatgaccctaatgccgttccagctgcccacttaatttttagtgaaacaaaccgtctttcatctttttgcttcataattgatcattcctaggagcgaatcacatatccagtaccacgaaccgtttggatgtagctcttttcaccaggacggtcaatcttattccgcaagtaccgaatataaacatcaacaacattggtttcaaccttggaatcataaccccataccttactcaaaaggtcttttcgtgacataacaacattgatattttccattaagatcaacagtaattcgtattcccgcttagtaaggttaattacttcatcgccgcgacgaacaacccggttctctttttcaatggtaagatccttgtaattgaccgttgtttgatgttccttattattaccatcttcaatactgattcgccgcaataacgcccggacccgtgcaaggagttcttcaatcgcaaatggcttaacaatataatcatctgccccatgatctaaaccagagacacggtcaataacagaatcacgagcggtcatgataataattggtgtatcttttatttcacgaacccgccgtgcaacttcaatcccatttaactctgggagcatcaagtctagcaaaatcacatcaaaatcttgatttaaagctgcttctaatccagcacgaccatcaagttcaacatctgtatcgtaaccttcatgctttaattcaagttctacaaaatttgctaaattttcctcatcctcaataatcaaaattcgactcattaataactcacctactataataatctttttttacttgttatacgtattaataaaacacaataattttatcacaattttttaataaaccccagtattctctatactaaaaatctcgatttatcaaggaattagattatatcatttttcacttgtaaattcttagaaaattttaaaataaaaaaactatcctaggtccggcgcctaaaggatagcttttatattaattagttgttagtgttaacaacttgcttgccgtcgtagtaaccacaacttgggcataccatgtgggacttgcgaagttcaccacagtttgggcaaggggtaaggccaggtacatttaacttgatgtgaccccgacgcatacgcttcttagtctttgaagtcttccgtgctggaacagccatgtttgacacctcctaagaaattagaattatccacaaatggtttttaaccgtccgctattttttgttatcctgatcaggaaaaaggttttgcaacttagcgagacgtggatcaactttgtcatctttctgctgctgggccttgtagtcatcttcagagataacactccaaccttttccatttggcattggtttgccagatttttcttcggcagaaagaacccgtagcggtacctgttcaacgatgttttccgctaatgcagtatcaaaatcaattgaatcaccctttttaataaggaaaacaacctcatcttcatcctcatagcgggcaaagtgtgaacgatcatcgatatacgtctctgagaacgtaaaatcgagcggtaattgaacgggtgttaacgagcgactagatggaacggttaacgtcgttgtaacatgagcgctaatcgttgcatcaccatcgtcataagtaacgtaaccatcaactttaactggttgaacagctaaaataatatctggaaacagcttcgttaatgatgcgttcagatcaaaagtactttgaatatgaagtggttcatcttggtaacgatgtaattcagctaacgaccatttcaacgtactaacctcctaatgcaacatgtgcaattatactagtccccttatacgttgtcaatgttttttccttgacaaccttttagggaaccaaatctacttagaatattttaccaaactttatcaaagacgttaattaataattatcggcgggtgctttaaatcttgttcagccggcgtaaataactgatatagttttcctgctcggtaatcaaggttaagcaattgatcccgcatttcttggtcgacttttgtaatcagcggtagatcaagctgtttttttacctcatgaaggtattcacggccttgcttattaaaggccaagacatgaagataaggatgtttactatgctcagctacttcctcttgggtaatctgcaagatagtgtataaacaaactcgcaataagtgggcataagtataccgtttagtcttggtgaatttcataaacgaattaaagtcaagactccgctgggcagcttccttcatccgatattctaatccttccgccattagataagttgactgaagggttgaaacaggcgcttgaataagctgattacgtaataaaggataaaggtctgtccatgaaggaatactctttattgccgccaatatatctcccatcacttgtggaacagcttgccggtaatcgcccttttcattgattgcctgacgaattgcactcgcactcgcaatctttcctttgatttgctggtcgtgatagttactcccttgtcgcttgataggcagcaattcaaaatgataaccctggttgattttagctttggtataagcaaaagctaaaatatcattgggatcaatcagggtgacaccagtttgttccttcaattgctcgttaaattgggtggcataggttgcattatacttattaaaactttcctggttaaaagcttcttcagccttcaccaaacgggcaaaatcccattctggatgctcgctcccaaagacaatcgagtcaacgccaagagcatttaagagactcagcgctcctccggcaaaccggtgtgctggttggacagcataaaaaaccggtagttcaattacaaggtccacgccattcatcactgcagccctagcccgcgaccatttatcaacgattgtcggttcaccacgctgggtaaaattaccactcattaccgctaccgttacatctgccccggaaatttttttcgcttgctgaaggtggtagcgatgcccattgtgaaatggattatattcaacaaccatccctactgctttcatgtgaactctccttatttatgacacttaaagaaccatcgtgttggtttttcttctttgatagaagtcgaaaaatttgatcccacttcaacagaattaaaaccagcttgagataacatctgctttaataaaggcaattcataagcacgttcataatgggtttctccaacacgatcataacgtccatcattatctcgagtgaaaaaagctaattcgtgaattacgccatgctcaacatcatcatctttgaaagactgccacatgaacgctcgctgatgatccttatcctcatagttgaacatataccccggataaatgacatcagtttgataaggagaaatgacatcaaataaaaagacaccattatctttcaaatgatcagcaatttcattgaaggtcttttgcacggccgctgcatcgtctaaataacaaaaagagtccgcataacaagtgatcgcatcatactgcggtaaagcactgaggtcccgcatatcagcttgcaagagattcatactaactcctgcttccgtggcatgttgatcggcaatactgagcatctcagcagaaaagtcagcaaccgttacatcaaatccacgagcagccagcattactcctaaccgtccactaccgccagctaaatctaaaatgctcttagtattagcaggaaggtttttaattgtgaacttttcccacttctggtacatttcaggatcaaaaagctggtcatataactgggcaaaactttgataaatcattaatcattaatccagtcgttaatattgacaaggggtgcgtcggcccataatttttcaaggttatagaattgacgggtttcttcacggaaaacatggacaaccacgtcaccaaggtcaaccaatacccattgagcatgatttttaccttcaacgctaccaattttgacattttcttcatgcgctttttcaacaatggcattcgtaatcgcctgtacttgacggtctgagcctcccgtcataataacgaaataatcagccattggactaatttcatcaactttaagagcgacgatatcttctgcgcgccgaccatcggcagccttgacaaccatttctaataattgtttactatccattaatctatctctccttcatattgcggaacccatgcattataggtatctattgtctttggatataccggctttccattttcaatcaaataagccagcgtatgttttgtttggtaagcaactcctgcttgaaggtttgctgctgtaattactcgtgccttttttacgccggcaaagtcacgacccggctcaatatagtcagccatgtaaataacctgctcgagcttcgtcattactggcgctccagtagtatggtggcgaactgcatttaggatatcttcatcccaaatccctaattcatccttaattagctctgcgccaaccactccatgccaaattgcattaccataatctaagagcagcggattaagcccttttttcttaatttcggcaataaaatcttcgtcaggacgctgtttagcataatcatgacacaggccagcgatacttgctttttcaatatcaacaccgtattgagcagctaactcaatcgctgttttctcaacacgtaatacatgctgaaatcgtttattctttaacgcctttttgagacggtcgataagttcagaccgtgtcattgggatataacttttattataaactaattcttcattcacgatataattgatgctcctcaataaacttgcttacggcatctgggaccatatacttgattgattggccacgttgcacccgttgtcgaatatcggttgaactaaaatcaactgttgggacatctacccaaatcactggatatcgtgtctcattcttcgctccttgacggtgaacaccgacaaaatggaaatggggtaagcggattaaatcattgatccgataccacttgtcaaggtaatcgaccatatccccaccaataataaagtaataatccacattagggtgcttatctaacaaatacttaatagtatcgtaagtatagctgactcctccccgctctaactcggtatactcaatccctaaaaaggggttatcagcaactgctaattcgagcatctgtaaccgcaattgcggatcaagcgaatctttatgatcaacatggggaggtttagcatctggtaaaaaatcaactcgatcaagacaaagggcatgaccaacctgatccgccataaataggtgagcattgtgaataggattaaatgttcccccatagaggccgatccgcttacggtgtccactaactttagtctccggttgcgcctgggtttgcaccttgtctactacactacagctttgcaaaaccgtcactcctacttttacttagatttcagctactcgtgatgataattcacgggcatccttatttgctgaaactttaaataaaactaatacccgaccaataacttgaactacctgaatagaagttttttcttcaattaattcgcgaacttcatcagttgtaacatctgagttttgcaaaatgctaaccttaattaattctcgacggtcaagtgcgccgtctaattgagcaagccaattgtccgtcagaccatctttacccacagaaaatagtggttgaagatggtttgcttgtgctcgtaaaaatcgtttttgttttcctcttaattgcataagtctttcctttcaaatactaattaaatcattgcgcgccgtacaagagccccgacacctttcggaacccatgcagcaacagtcgttttcgcaggaacagtaatccatcctagaccttcaaagacaatatcgcttttttcggtaatgtggaactcataacgttctaatggtgggaacccatccttttcatcgctagtcggtggggtaagcaaatctcctaagtgtttagcataaaaattatcagcattgcttagctttgtacggtgaattggtaaattattatcaaagtaagcaaccattcccgcacgttcaccatgaagataatcaaatcgcgcaacgccgcctaaaaataatgtttgaccatcatttaattggtaagtctttggtttaatctctttttgaggtgccacaatcttcaagtcttttggcgataagacatgggccatttgttcttgatggataattccaggagtatcaactaaaacatgcccatcatcaagcggaatttcaatcttatcaagagtagttcctgggaagcgtgaagtagtgatcaattcttttactcccgttcgttgcttgataatttggtttattaacgttgattttccaacatttgtaacacctacaacataaacatctcgattgtgccggtatttttcaatcacatcaagcaagtggtcaatctgatggttctttttagctgaaacaagaaccgtatcaattggacgcaatccggcaatatttgcctgttgacgaatccagtcagttaacttgggccgccgtagagaacgtggcaacaagtcttccttatttccaactaataatactggattatcaccaacaaaacgatgtaagcccggaattagacttccattaaagtcaaaaacatcaacaacatacacaattaaagcattggcatcccgaatctgatttaataggcgcaaaaagtcatcatccgttaatgataccggagcaatttcattgtagtgccgcaagcggaaacaacgctgacagtataattctcctgtctcctttcccttctcaagggctgacttaggcgtataacccaagccattaggatcttccgtttggataatactcccacaacctatacaacgtaattcttcagtttgttgttcttgttcagtcattcaaatcctcctgccattttaaatctggatattttttgtttaagctcttccaaacacggcgttcaaagaagcggttaatacgggtatcccacttatctgtatttaatagggggcgtactaaaatgcttcgaatgcccgcttggttagccgcagcaacatcagtcaataactggtcaccaaccataaccacttcatcttttgctaaattaagttttttccgtgcacgatcaatcccaaaacttaagggctttaatgatcgcgaaacaaatggaaggtcaaggctattaacagctttcccaactcgttccttactattattagaaataacaattagcggaatatgggcttctcgtaaagaatccatccattcctttaattctggagttccatctggattgttccaagcaatcaaggtattatccaggtcactaaaaacagctcgcactccctgctcttttaattgggcaggagaaacagaatatattgtattaaccatccatgttggtttaaatatctctaacaaagttgcacctcatcaaatttaatattccaatcggttaacccgattaaatgttctagtatttaattatatcgtgtgctttactcggaaagcaactaaatcgagtaggagataattgattagttcgattatcgacctctcacatcaccgtacgtacggttccgtatacggcgattcgacaacttaatcacattgaattgactggagcgtcttggacatattcataagtccaagttgttccagttttctattagttagagaatagctcaaggccttactatgtgcagttcgccagtagcccttgcgggtactagcgaagacatatgcatcacgctgggacagccccaacttctgtaagttagttaccttagttttaaactttttccattgcttccagatatactgccttattcggaccctcaactacttgtcgaggcgttgaataaagttagttagtttcccaattgagtagtactgaagccacccacgcatttttcgatgaatttcttcaaacattcttgtcagagatattccacgattacgtttagttaataacttcagcgctttctttactcgttgttgcgattgtttagctggacgggcgtaggccccattgtggtctacacccaacgaaaagccaataaacttcaaccgtagagggctaccgactttggttttatctgggttcaatttaactttcaagcgcttttctagaaactgggtaatgcttcgcattactcgttctccggctcgttgacttttaacatagatgttacaatcatccgcatagcgcacaaagtgatgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttgaagatacttaatcatcaagtcatgattaacgttatcaaaataggcttttaggtctaagttgacaactcttcgataaccttgattttaaagatctactacttttgcaatagcgtcatgggccccacggtggggacgaaagccaaagctattatcagagaaaacacgctcaaagataggcgtaagaatttgggctacagcttgttgaaccattcggtctaccaccgttggtattccaagtcttcttactccaccattaggcttcggaatttctacccgtttgactggggctggtttatacttgccctcacgcaaactagcgatcagttccgtcttattttctctgagatatggcagaaggtcattgactgtcatatcgtcaacgcctgctgctccttttatttctcttaactcgcaaataagcctgattaaggttattgcgatccaagactaagtcttggatcgtgacactcatgcctttaccttcaccataaccggtactacgcgcccttgtgtactttcggttttccaaacctatcctcgacaagcggtcagcttgttgttctgttttctgcgattgtcgcacctgattacacctccgatataagttacaagttattgtcgttcagtccttcatatgattattcaaactactatgacctcggctgacttctggcttactcaacactgcatcactgcaccgcttgtttctgcggaaattaaacttattcctcttgtcggaaacgtgtaggccagatctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtccttagctcatggttccgactactacggcccatagcggactttcaccacctagctaatacccatgccgggcgcactaaaaaaagccgcttatcatgcatacgcatcataagcgaccgaagattatttaggcttagttaagagctttcttagcttcgtcaacgagtgccttaaatgcatctgcatcgttaacagctaaatcagctaacatcttacggttaatatcaatgttagcaacctttaagccgtgcattaacttgctgtaactaatgtcgttcatacgtgcagcagcgttaatccgagcaatccaaagttcacggaacttacgcttgttgaccttacgatcacggaaagcgtaagtgtaactcttcattacttggtctttagcagtcttgaaaagacggtgctttgaaccacggtaaccctttgctaacttcataatgcgcttgcgacgtgcacgcgtaacagttccacctttaactcgcatgttgaaatcctcctacgtatattaaatagttatttttgtgaagtttacttaaatggtaataacttcttgtaacgctttacgttggtcttgtccatcatgctcaaaccacgtaattgacgacgttgcttcttagtcttaccgtggaaacggtgactagtgaatgagtttccactcttgaatccaccattagctgtacgcttgaaacgcttggcagcagcacggttactcttcatctttggcataactaattcctaccttcttaaattaattctttgctttatcagcagccggagcaagagttaagaaaatactccgcccttccatcttcggacgttgaacaacagtagcgatgtctgaagtttcttcagccattcgttcaatcatgtcacgaccgatatccttatgggtaatagcacgaccacggaaccgtaatgaaatccgtaccttatcgcccttttcaatgaacttacgaacacgctttaacttaacattaaagtcattagtatcaattgatggactaaggcgaatttccttaaccgttatcgtcttttgcttcttacgagcttcacgctctttcttttgcatctcgaaacggtacttcccgtaatccataatgcgggcaacagctgggcgtgcctttggtgcaactaatactagatctaagttagcttcttcagctaattgtagcgcttcacgcttagacttaatgcccaattgttcaccatcttgaccgattaaccgcacttcccgtgcacgaataccgttattgacaatcatatcttgtgctatggcaacgcacctccaatttttttagcgaaagatcaagcaaaaaagcgaggtacaaaagtaccccgcttcataacaacgaccttatcatagtggtcgattatcattcatctcgtcagcccggcgatcaatatcacctaggcgagaagcgggtgcttctgctttttctttcaacgtttattagcttactaaattcaaagtttaatgtcaagaactttatcccttatcacgcaaattctttccttccatttcaatctcacgtgataagtacttgattctttccataatgcgagccgctttgaggggctcattatcgccttgcgcattgatagcaaggtggttattttgcaactcatccattgaaaaattagaactaaagaaagttggtaattcttcttgcatccgatattctaaaattactcctaaaatatcatctcttacccatgttgtcattgcaccggccccaacatcatcaagcattaaaatcggcgcccgtttaatagcatccaatttttcgccagtattattttgcttaattgaattccgcatttcaacagcaaaactagggaaatgaaccatcgttgttgcaactcccttactcttagcgagttcattagcgattgctccaaggaggtatgtttttccgactccgaattttccatataggtaaagtcctggttgaaaattatctttttggtaattatctgtaaagtccatggctgcttgaattgcctttgtgcgtgtatcagtttgggtatcttcatttaaataataatcatcatatgacgcatttttaatgaacttaggcatattaatcgagttaactagtcgttgaatataacgttgtcgttggcgttctaataactgtttagttggaacgtaggttacgtcaatttggcctgcactgataaccaattgcggagaatatccaggggcaacagttggcacgcctttttcaattaattgcttttcatgaaaaaactcataaagctttgattgtccccgtttaattgcttctttactaagacggtcacgattttcgtttaagaatgcttgaacatctttatccgcataaacttgcttcatcgtttgttggatattgtttgctatattttgaccgcgcattaactcttgtaaagttttgtttagtgactgcatgctgccacctcctttagctgctacttcttcttacgattagcgatccgttcacgcagtttggcaatttcttgtgaggaagcctttttcatcaactcactcgtgtctttcttgctccatgctggcatcggttccttaatcgttttgcgccacttatttttctttggcgtctttgtttcctttttcttttcttgcgactgcttgttaaaagtctttaattggacaatggcttgttccccattaattactccatgttggagccagttattggcaattgcatcgacaaaattagctgtcaaagtagaatttccccggtcactaatcacataccaagttaagatattaatggcatcttgggtaagtttttcttgcgctactaaacctgtcagaatatgacgttcacctgaagttacgtagccacccgtttgacctttaagaacctgaagaaattcgactggggagtaatccttagctgtcgccaataactcctgatctttactagtcagttcactatttctatttgtcaccggcgcttctttttccgctacttttgtcgttgaagaatagacaatattataggtagacgcaacaatttgcttaaattttttcggattgaaatgattggtttgcagatcaatcgaccgcaaaaccaatgtcttcatcgttggcgcatcaatcccatataattgatgttctaataatattaggtctcgattattttcaaggtctgcactgacaatcggctgattagccagcaagtgaatgagggttgaccaatcaaagtcatcgcttatccccgcagttaactggggttgcttttctactggtgcctgttttcgcgccgttaaaatcgcttgtggtgtttcagtaattgactgcgagttaatatgaaattcttcaaaaaagttgtgactcacattagttagtgaagtattagaagaagcaagcttgtattgcctactttgcttagtcaaacgtccaaacgcatcttctcctacttcctctaaaagtaaaatactcagcaagttatcagctaaaaatttttctggagtaagggtcggctgcaattcataaacgtatacgtccccgatctcatcgtgctggaaataagtttgcactaagccaactgcctctaaacgatgaagagcctccagtacttgtcggcccccagcatttacttgggctaacaggtcactttgcaaggtccggttagcaatcgtaggattaggcagcaagcgcgcttttaacgcataaaaaaagctaaacgcaactggtcctaaaattggctgataaaatgttgcaaaagtctggtcattaaaactaataaatgcagtgctggccgtaacaacataaccggcttgcgggtcaaaagctgctgcagtcattttacagccctcctaagttattttttatgttctgccttcatcatggtttcaagttcgctcataaaggcatcaacgtccttaaattggcggtaaacacttgcaaaccgaatataagcaatctcatcgacgccttttaattcgttcatcacaaatttaccaataatttgactggagacttcgctttcaccaatactccggatttgtttttccactttatctgcaatcttggtcaatcgctccatactaaccggtcgtttttctgccgagcgcacaatcccattgaggatcttttggcgactgaattcttggcgcgtgccatcttttttaattactagtagtggcgtttcctcgtaccgttcaaaggttgtaaaacgaaagccacaatgaatgcactcacgacgacgacgaataaagcttccgtcttcgcttggccgactatcgacaacccgtgatccatttttgtgacaatgtggacagcgcaatgtgtccccctcctttatagtataagtactttattttaccacatttactctgcttttagctgatttattagggatgcgactcgtttttgcagggcagcctggtcaccattattatttattttaaaatccgcccgcgcttctttatctgataatggcatttgggcaacaattcgcgcttgcgcttcctctttagaacaatgatcacgagccattaaccgcttaagctgcgtttgtggatcagtataaacaactaccacataatcacaatcttcatcataatgttgctcgaataataatggtacatctaacaccacgagcggaataccctgtttttttaaagtattaacctgcgcaaagatagcatcgtaaattaatggctgaagaatctcattgagttttttcaacgcttctttatcattaaagacaatttttgctaaggtttgccgattgagctccccagttggcaaaagtactttcggaccaaatactttgacaatccgtgttaacccaaccgagtctggtgtctggacttgccgcgctacttggtcagcatcaatcaccggaatcccagcctggcgcaaaatagtgcttaccgttgtcttgccggttgcgattccacctgttaatccaactatttttgtcatttcttattccttcaatacttgacagtgtggacaaaatgtcgttccacgttcagcaaccttaattttaaccattttcgtgccacaacgcggacattcatcccccgcatgaccataagcttttaagcgatcttggaaagcgccggcatcaccaaatgcattcgtaaaactatgcacagtggttcccttgtacttaatcgctgtcgccaattctttgataatatttttccgtaattcagtaatctggctagccgttaaagtattggctggttgctccggatttatccccgtcatccatagtacctcatcaacgtaaatgttacccagaccggcgacatgacgctgattaagcaagaatggcttaatctttccccgactcttttttaattcagctgtaaagtatggcaacgtaaaggcgtcttccgtcggttcagggccaatcgtcttcaatccgccgacattcatctcatcaccggtttttaccagtgtcatccgaccaaatttacgggtatcttgataacataattccgtgccgtccgtaaattcaaagacaacatgggtatgtttatcaattggtccgccaatcggttggttgtaatattttccttccatgcgaaggtgtgaaatcatcgtcaaatcattagtaaaacgaaaaagaagatatttccctcgccgatcaacattttcaatcgtctgtccaatcaacgcctgccgaaaatcttcaacgtcattggtaatcgttttaccataataaacatcgatcgcgttaattttacgcttagcggcaatcttcagcaaaccgtggcgaacagtttcaacttctggtaattcaggcatttaattcctccgatctattttttaaggtcataccaggtatccccatacttactatctactttaagtggcacatccaacttaacggccgaatccattacttttggcaccaattccgatagaatcgggatttcttcctttggagcctcaaagactaactcatcatgaatctgcaagagcatttttgcctttagatggcgtttctcaagctcatcttgcatccggatcatcgcaatcttaatgatatcagcagcgctcccctgaattggcgtattcattgcagtccgctctgcaaatgatcgcttgctaaaacttttggcatgaatatctggtaagtaacgacgacggtgagtaatcgtctcaacataaccattttctttagcaaacgcaattgtgtcattgatgtatttctttacaccggggaattcatggaaataattttgaataaattcatgagcttctgcacgactaacatgaatccgttgtgccagtccgtaatcactaatcccgtaaacaattccaaaattaactgcttttgcccgacgccgcatattacggtcaatctcggcatcaggggctagatggaaaattcggcgagctgtactagcatgaatatcttcaccattcttaaagtcttcctgaaggttcttgtcaccagtgatgtgagcaagaacccgtaattcaacttgcgaataatctgaagagaagatttgccaaccttcatgactaggaacaaatgcctttctgattaagcgcccttccggcaaccgtactggaatattttgcaggttaggatcaacagaagacaagcgaccagtttgcgttaatgtctgtaagtagcgcgtatggatcttctggtcatttgaatggataactttcagcaaaccagtgatataggtagattgaagcttagcaatttgacgatattccaaaatttgctcaacaatcggtgacttatcagctaacttttccagcacatcaactgcagtggaataaccggtcttggtctttttgatcactggcaatttcaatttttcgaacagaatatggcctagttgcttagtggagttaatgttaaattcctcgccagcttcttgatagatctgactttcaatttctgatagccgttcagttaatttactacccatatctttcaaagtttgtgcatctacatggacacccgcgatttccatttttgcaagaacccgggttagcggtaattcaatatcggtatatagcggcgtttgcttattttcatctaatttggcaaaaaaatccttacgcagatgttcaattgcccgcgctttcgtagccaggtgactaaagaaggtctcgtcatcatcaggcacagcacgcttagcacctttaccataaacttcctcatctgttcgtacatcatcataaccgtgttcctgagctacttgtcccaggtcgttactattgtcattagtatttagaaggtaagatgccaaaagcagatcaaaattaatattttcaagcggaataccgaggcgatgaagtccaacgatttgtgccttggcattaaagacattcttcttaacactatcactctggagtaaatccttgagaggcgcctctttaagcaggtccacatctcgactcgtaaaccagtgtccttcattgccgatcacaaaaccagcgaatggtgacgtgtggtaattttctgctggcatttcaaggtaaaaacttacttcacccgttaattgtcctagttcatctaagttatctttagttaaaactgtgtagtcaattggagcaatctcagcttcgtcttcctctccagccccatcgatatccatctttttcaagaaagatttaaagcccatctctttgtaaaacttaatcaagtcatccgtttgtggaccttggtattgcaaatcatctaggccaatcttgagcggagcatcccgaagaattgtcgctaacgtcttacattggcgagcaatctcttcatcctcaatcaaatgttctttcatcttactctttttgaggtcatcaatatggtcataaagctcttcaaccgaaccaaactgtttcacaagtttgatcgccgtcttttctccaattttagttacaccaggataattatcggaagaatcacccatcaatgccttcatatcaattatttggcgtggggtaattcctaatttttcttcgacatgcgctggcgtatagtgttccgtgtcagtaactcccttgtgggtaacggcaacggttgtattttcacttgctaactgggtaaggtcccgatctccagttacgatcaacgtcttgtagccagcatcatccgcctgcttagccaaagtaccgataatatcgtcagcctcatagttagctaattcataactatgtaacccagagtctttgatcaattcacgcacataagggatttgctcggtcaattcattaggcgtcttgtttcgaccacccttatagtcatcatacattttcgtccggaaggttaccttccctgcatcaaaggctactaaagccgtatccggtttaaagttttgcaacacatggtcaagcatcaacttaaagccataaattgcagccgtatgcaagccgtccttatttgtaaacttgtccatttggttatgcatggcaaaaaatgcccggaaaacaatactatttccgtcaattaacaataattgttttgtcatttaattcccgcccttctatcgctaatagtaattgtaccagagaatatagcaatggtttagtttcttgaccaaagatttaagttataattaaaatgaaaaacattagatgcgagatgaaattcatggataaactcattaactatcaaaagccagcagaagcacggctctttgccctccttctcacctttagtggtggtttcatcgacgcttttacatatatcaaatgtgggcgaacaatggcggcggcccaaaccggtaatatcatttttcttagcgctgcgctcgcaaaccacaatttccttggcgtggttgatcggctaggttcattgatcgcatttattgttggattagcaatggttagtattctccatgctcatttaaaaactgattattggcgagtagtttgtttattgccaattttattagtaggagcaattatcggttttcttcctgacagctttcctgattatctaatggtaccagctgtttcatttgggcttgcaatgcaaagtgccgctttcagcaaaatcgaggggcttgggtataacagtgtctttacaagtggcagtgttaaaaaagctgcggttgcctggagcgaatattattttcatcacgatcgctcgcaacgctcagtggcctttagttatttaatgatcgtgatctgttttacgctcggcgcgatcatttccgctcagttgcttccctttttccgaatgaaaactatctggatcgcaacgttcttgattctcgtaactgatagttcttattatttaactaaaaggaaaaacgttaataagtagtttttaaatatagtaaagaggctgagaaaaacttttgtttttcaacagcctcttactattttgcaatataataacaagataacgtgcaaaacactcacttttaattaatttcggtcactcattccaaaaatttggagaagtgagataaagaggtttacaaagtctaagtacaattgaagggcacctagaacagctaaaccatttgttgatacttcgccaccatagttgatgtagatttgcttcatcttttgtgcatcccaagctgttaaaacagtaaagataataacagcgataaaggagaagatgtaagcaatggcaggactttgtaagaacatgttgataaggtaagcaatcattaaagcaatcaaggcagccatcgcgtgagcaccaaacttacttaagtcgcgtttagtaatggtcccatacaaagccatcgtgacaaaaacggctgcggatgatacgaaagctgaggcaatgcttgctcccgaataaacaccagcaataattgcaaactcgacaccatagattattgccgtcagcatcagcataataaatgccccaactgggttccgggtagcactaaagcttacccccattgacaaagcaatcggtagcaataagataacccaaaccattccagggtgagcactaaagaaaccgaaaaccgcactccggaatacccccatggtcaagtaagcactgaatgcagaaacaagaactgccagcgtcatgtttccatacattcgggtcaagaaactattcaagccagctgcgtcagtgacaacccgacgccctggttcttgagaaaagttattcatcaaaactccctctttctatttaatttgactttatttgactaattataaaaatggtagcagaggccaccatttcgttcaagtaaatctttaattattttaacaattctttgtacttttcttcgtacttttcaacatcaccggcacccatgaaaacaactactgcattatggtattgcaaaagtttatccatggtatccatgtcaatgccttcactaccgtcaatccgttgctccaaatcagcactagaaacatttccagcattttcacgaattgaaccaaagattggggtaacaaaagtcttatctgcccggctaagcgattctgcaaagccatcgatgtaagcagccaaccgtgagtatgtgtgtggttgaaaaacagcgataacttcacgatctggatacttttgccgtgccgcatcaattgttgctttaatttcgcttggatggtgagcatagtcatcaataatggttatatccgcaatgtcagtctcgctgaaacggcgctttaccccactaaagttggctaattcctgttgaatctcatccatgttcatgtgttccatgtatgcaactgctagtactgctaagctattaagaacactgtgttcaccgtataagtggatagtgaatgtgccgagtttttggtcgcggaagtaagcatcatatgttgagccttctggtgtccgttgaatattttctgcccggaaatcatcatctggattagttccatagtagtaaaccggaacatcaacgtttaagttacgaagactaggatcatctccccaagcaaaaattgcccgttgaacctgcttaccgtacgtttcaaatgaatcacggacatctgccaaatcattgaagtaatcagggtgatcaaagtcaacgttcgtcataattgcatagtctgggtggtaggcaaggaagtgatcacggtattcatcggcttcaaaaacaaagaagcgtgcatccgcatttcctttacctaccccatcaccgatcaagtagctggttggttcaaccgctgctaatacgtgtgataacaatgcagtcgtactggtcttaccgtgtgctccggcaatcccaatactagtatgattcttaacctcattttcaacagcctcagggtagcttaaaattttaaggcctaattcatgtgctcgtttaatctctgggtgatcatcatcaaaagcgtttccttggataacaatcatccctggtttcaaattggctggatcaaatggcaaaattttaattcccgccgctaataatggcgcttgtgtaaatgtttccttttcaatatctgaacctagtacttggtgtcctttgtcatgaaggatacgtgctaaagaggccatcccggtccctttaataccaacaaagtaatatgtattttgttccatcaatccaattcctttcaacaattcaatttaaaataaatgcgaggggtagatcagtaactatgatccatccctcactaaataataaagcattataaaattttggcaatagtaatcagctgttttttgttagttttctgggtaaaacgtatcggccttagcaaaatcaaccggttcaccgacttcttgccagtcatcagggataatgaataggcccttttcatcgggagcattcttaatccgtagttcacggaaaccacagagcattccgtcactatcgacacccatcaattgaccaggccaaatgatcttaccgtctggcatcatcgcaccaggacgagcgactaccactttaataccttccgcaacattaggagatccgcacacgatttggacagtcttatcatcagcaatccgcgtttgcgttacttttaagtggtcagacttaggatggtcagtgatcttttcaacataaccaaccacaaacttaggatcttcgtcagccgttaagagcttatcaaagcccgcttcttgtaactttgcatttaatttttcaacttgggctgcatctaaaaatacttgcccgttttcacttgttaattctggtaagatcttgctggcgttcataaagttatagccaagtaatgcaccatctttttcagcggtgatctgagctacatcatcagcaatcttagtaatttggtcatccgcatctggagcggtaataacgactaaaatgtcgcctaattcattgggattgtaacttgaaattaacatcaaatattcctctctctaatataatctaccattttatattattacataaaaagaagactatgaaaatctaatttaaaactaaagaaggctgaataattcagtctctttattttcacagccttcttattttacttcaaattgtttaaaaaatcttcaacttgttgcttagttttacgatctttattgacaaatcgaccaatttctttaccattatcatatacaatgaagcttggaattccaaatacatttaattcagcagctaggtcgatgttttcatcgcgatcaacttcatagaaagtataatcactgaagtcttgttcgatctcaggcattgctggcttaatgaaacggcaatctgggcaccaatcagctgtaaagaaaaggacgaccttgccattgccaatagtttcaattaattgatcttcttttaattgtggtaatcttttcataatcctcatccctatatcattttagcaatattataccatgcttcttatctattgtaagtactctgcttgcaaggactagatatttggattttaataattaaaaatgatagaataaatgagaagttaagaacggattaaatttaaatagtgaaggaagcaatcatatgaatgcaaacaataactccctcaacccctggctgattccagtcacattaggtgcatctggaatcgccggttttatcgctggtaaactttttggtaaccgccaaatatctgctgatcggatcttaaaattagtcaaaaacgattttgcaagtgaaggttctttaaccggtagctggatcaatgataaagcaataccttttcaacgatttgcggttaaaacccatgcttatgaaggcggcgtttctcgtctagaagatggcgaagaagtagattacgagtttattgctgatgcatatactggtagtctattagaattaaaacggattgagaataactaaagtaaaggctggggacaaattttcccagcttttttaattaaaggagaactatcatgaatcttaatgacgcaattcaagaatgttggagcaaaattggcgaaggacaggtagcgacatatattcccgctttagcaaaagttgatccttattaacttggcgtttacctttttgacgtcacaaatgataaaaaattagaagcaggcgcggtactgtgccctgtcaagtttacacattaaataataaaaaaattgacgtgtacccttaaagttggaacctgtatgttcttgctttaaaattgaataaatatttttctaggcaactagattctgctcatattgaagtggagtttggttgcctagttttgtctgaatacggcgttcgttgtaaaagtgaatccattcattaattgcttggcttaattcttcttgattgcgataactggtatcaggaccaatttctgctttcagtttactaaagactgtttcacaggcagcgttgtccagacaggttgctcgatgcgacatgctttgcctaatgtttccctgacgaagtagtttgcgccaagcacgatgttgatagtgccagccttgatcagtatgtaaaattaattggtatcctgtatgaggtaactgcttaagtaattgctggagtggatctaatgcgaattgaagatttggatgttgactgattgaccaagtaagaatctggttagttgccaagtccttaataatttctaagtacacttttcgcccatcatgagcctttaattctgtaatgtcacaaaccattttctgatatttacggttactcataaaacgccgatttagcttattcttagctttcttgccatttggtcccttagaggaatcatacttacggactcgccgattatatttgatacatttaagtcccatttcatgcattaagcgctgaatgcgcttatgattaggtgtctttttaccaattaagcgatagtagtctcgaatttgagtgcttaaacggcgtacgccgtattcagcttggtagtagttaaagaggcctttaataacggctttaagttcttcttcatcctcatccggatgttcaaaccgattttgccaatactgataggttgacatggaaatgggaagtgcatcgatcaaatcctttaataagtatttagccttgaggtcataaattacttgtgcgagttcttttttggatgctttctcaaggctgtcaattttttggaggcatcgagttgtatctttaacaataagttttctctttgtaaggtttggttctgtttttggagctgaagaagcttgtcttgattcttgtcgtgtcgtttgaccatttttaggtttccttccccgacgcaatctcagtaaagcctgtggcccttgcttgttatagagacattcccactgatacactgaacctggggaacgatatccaaagtgaatacaagtttctgagattgacgccaaattttcttgtttccactttaccagatttaaccgaaaatccccagttactttgggtggattgagtaatggtcctttaccaaatcttgcataaattcccacccaaatttggaaatcatgttcagcaatcccgtatttatgcctaactgatgctaaagcaacattaccgttagcatattcttcaacagctttaagtttagttttaacgctaattttggtcatataaaatacccccagagttgatttccaactctgggggtacacgtcatcatcgtaccgttatttattgtatgctttcggactaaccttatcgccaactttaccgtatgcataatgatgaccattatcttcgcttggcaaatattctgaataatctactatctttccgttatcgtcatcatcaacaaacgttaaatcaattcttgcattctgttcggtagcagattgagaaaccttactttcttcaactggagtattttgtgtattgacgttatttttgtttaaattagtaatcgattcatactcgttatcctttaccagttcttgattctttttattattcagttgatctgtgctctcatcacttgttttatttattaattgttgttctttttgtgaattactactagtattttcggctgcgttttgttcctcattagtttgtttatcagcttgtacaacagaagtagaaaccagctgcgtaatatcggtatttgctgttgttgcttcttccatagtaggtgtgctatcagcgtgtgctactgtacctccgaccataaaagtagttcctagtaacacagacgcaacaccaacactgagttttcttaacccaaatcgttgccgttgttgctccattttgcgtacatattcttgtgcattgttcttcgacattcaatatccccccatatatttgtacgtcataacttgttatttatatttcgaaaatattcgagcacatatttatcgaaccataaacacaaaattattatttcattaatggtgggattacttttaaatacactttttcacttggtgttgctataaagaaatcgattcctcaccccagcaaaaaagtaaaaaaatactagtcagcaagcattcgtctacttactgactagtattttacttaaaattagcaattagcttatagattggttggcctttcgccgcaaatttttgttcatattccgtctcaacattatgttcattttcttcgctgtggtgcaggtctaaccagacgccatcaaagatcatcccatagttattcatgctttccaaggagaattcaaagagacccatgttatcagtcttcagttcaattaccccttgatcttggaggatctgctgataggttgctaagaaggtcttgtaggtcaggcgccgcttagcatggcgtttcttcggccatggatcagagaagttaaggtacatcttcgcaacttccccatcttcaaagtattcttgcaagtcttctccatccccacaaatcaattgcaagtttggcaagtcttcctcaagtgcttttttgagggcaattgccgcaacagtccgctgaatctctaatccgataaagttgatttctggatgagccttcgccatgccaatgataaattgacctttccccatcccaacttctaagtggaggggttgttcttttgcaaaccgtgattgccacttacccttaaattgagtggcatcatcaatcattagttctggatgggcagcaattaatggatcagcccactttttatgtttcacacgcataaattaaaatcctcatttcattagttttttgactctgacattgaagtagaaacggcttaataagaccacttccactgccgcaataataagattaattaccatctggccgacattcaactgccaaccgatactagcaagggcgatcaatagtgcctcaagcgccgttaccttggccaacagctgcttaaagtctgcctgttgctgactagcagggattggatagatgtgagtaaagacatttgattcatactggtcatagagtggcatcagttgggtcgcgatcaagtaaataaagagcacgaccaccagagtacttaaccaacctgctggcagtaagaagacaatcaccattcctagtagggtcaaccgactgacaatcccgctcacttcggtactccggacaaatgcgcgagcgtataagtaagaccatggttgaccatctttgcttagccagcggatcaagccatctgcccacttccgccgtttggtatttccttgaacacttggcacatcagtaaagaggttaaagaaacggtagacactatacatccgatcttgttccgccttaacggcaatccgccaattaacggcaagatcacgataataaacaattaccgccaagtacaagatcactgccacgacaagaccgacatagggatttaccagccacattgcgattgaagcaaggagcggatttacccagtattctagccgggtccgccactgttgatcaccccagcgcaaactcagtgatttacgagctacatgcatccaatcagccttattgacaatggtgactaaaaagatggtcacaatctcggcactgctgagtttttccgttgttaaagcgaacggcaaggcgataaaggcccccactaccgtcattatttccgctaagatcagactataccaggtcgcctggttaaggtaacgatggattccttcaacttgcggcaagagaaagactgggtccggctttttgatcagcgttgcaagacgaccaatttgagcgatgaccgtaaaccagccgatcaagatcagccgggtccaccattcatgcgatcccaaggttggcagccattgagaatagccatatgccaaagctccgaacaggaaaaataaggcgataacaaagtggtcattgaagactagccgccagtaacgcaacaggagcataaagtgttgactgcgacgcttgctaaataacttattcatcacgatcaccctttgcaagatgcaagtaaatctcatccaaggattcgccggcatgatcaccagcggctcgtaattcatcgagggttccatgtgcccggactttcccatctgccaataggacaaagcggtcacaataccgttgcgccgtatcaaggacgtgggtcgacatcaaaaccgcgacgccctccttcttcttttgctcaatcaggtctagcaaatcatgcactgccaaggggtctagcccatagaatggttcatcaatgatcagcaacttggccttagtcataaaggcacagcagatcattaccttttgcttcatccccttagaaaagttagcggggaaccagtcaagtttattatcaagccgaaaaagttttaatagttttgttgcccgctgccatgctgcatcgtgatcaagctcgtatgccataatcgttaaatcgatatgctcacggagagtcaattcatcataaagaattggcgtttcgggaacataggcgatctgctttttatactcttccgggttggcctggatagtaagaccattaattttaatcgatcctgaaaatggtcgcagcaagccaataacgtggtttagcgttgttgactttccggcaccatttagtccaatcaaaccaactaattcacctggttggacatcaaagctgacatccttcaacacaggaatctgggaatatccaccaacaagtttatttatctctaaagccattattcatcccttcttaattattgcttagtcatatctttttattatatcataggttatttcttctactaaatcatgcacgaacgcgattttttcggtatacttaggataagtttaatcttcaaaaggagcgattaatatggacaataattgtattttctgcaaaatcattaacggtgagattcctagctacacagtctatgaagatgacgttgtaaaggccttccttgatatttcacagggaactcctggtcacaccctcgtcattcctaagaagcacgttcccgatttatttgcctacgatgctgatcttgctgcccaagtattttcccgtatccccaagattgcacgggcagtcaaggcttctaacccagctatcaagggaatgaacgtggttaacaataacggtgaagtcgcttatcaatctgtcttccattcccacttccacttgattccacggtacactagcgatgatgattttaagatgatttttaaggacaattctggtaactacaacgatgaaaagtacaaagaaatccaacaatcaatcatcgatcaaatgaaagaagactagttatgcaacggctaaaagaaattcaagaggaattcaaacggctcagcagcgaagtttcacagttgaagaacagcatcgatgaactacaagctgccatccctggtgtgcaaaaatttattaacgatgttgaacgtgatgttaagaagtggaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacataaaaaataaggttacgaaaattttccgtagccttatttttataccctattttacttatttgagctagtactgctgctgttattgctggagctgcttgtagtggcgcttgagttaaggtagtcatcaaggatattcttaacatcgttttccttgattgaaacgttacccttcttcaagacgtttgaaacaaccttccgcatgaagttttggttgttcatgttttcttgaacgatttggttcttcaagtcattgatgtgttgactcttcttacccttagctgggtgttcgatcatgtaaattacttggtagccgtcatcagtcttaactggggtcgtagtatattcacccgtcttcaacttaaaggcagccttcttgtaagctgaatcaagttggttatcagtattatcaaaggctggaagcttaccaccgttgttcttggtttgactatcagttgacttggacttagcaagcttcttgaaagtcttgtacttgttgctggagtcatttaattggttaatgatatcttcagcatcagacttactaccaacaaggatcgtcgcagtttgaactttaggttggtacttggtccattgcttattgatttgcttgttagtaatgtgggagtaatgacgagcagccgcagtcaagagtaagtttgaccgaatttgttgcttcaatgacttttcagttaagttttgactttgaagataagcattaaagtctgaaccgtactcgttcttgtaggtattatattgcgcgttaacttgcttatcactgacttctttaccgtattgcttctccaaaaccttatctaagatcatttgttgaagcacttgcttaccagcactggtttgcttcatgctgctgtagtattcgctctcagtgattttaccgccgctagtagtagcgactgctttatttccacaggcagcaagcggcatcatcaatgcggcccctgcaatgatagcaattaactttttggatttcatgtaagaaacacatccttaaacaaaatattttttcgataacttcactcatccaatataccacacttattttttcgtgccagtctcctaaataaatgtttatatcatcttcataatttattcacggtttaatgcttgcaggtcaagaattttaacgtcaaggtccttaatccgatcatcagcagtaaaatagataacctgattcttctcagcaattttttctagcaaggccagcattcgttgccgccgaacgttatcaaaattaacaaacccatcatcaataattaccgggaagttagcttgatcactcatcacggtgacaaagccaagccggagcgcaatatacaattgttcagccgttccctgcgacaattcttccactaaaaaaacttcttgatcccttcgtatcactttgactccatcggccgttaaacggatccgggaatagcgatgagcggttaacaaggcaaaatattgttctgcctggcgaatgattgcagggtaacgatcagctgaagctcctaccagggccttattaatccactgaattgccaattggtaccttaaccattcctgtacttcatgccaaatcttagcggctaggttagcccgttcttgttccagattgctgagggttccatctttaactaaactatcaatttcgactttatctttttgaatctcttcgtgggtatgagagattgttaggttgagctgatcaagctggtaccgagtcttcgctaaagccgtcattagctcatctctatttgcgtatgcagcaagcgcttggcggtcttctgcggtcaattgttgtccataggcatctgatgccaaggcttgtgattgtgctgcagaacgatttgctaagtactgggtaaactggttatcatcgttcacccctgcttgctgataaatcgccagtttttgctgatgaattttactgtagtcttgattgagctgggctaaattgttagcaatcgttgctttttctcgggtatttgcttggatatcctggcgcgcttgttgcccttgttccagtaaatcatccaatttattcctaacagccgccaaagttagattttgcaaagctggtggcaattgttggttaaagatagcaagttggtggtcatatctttgctgatcttgtttggcagtttggagctgggcagctaattcggcatttcgttgtaaatctccctggattaatagccattgatcaagtggaaaatcctgtaagccatgtttttggccaaacgccgtgattgcttgggaatctgtcgttactggagcagaatgacttccttggcgttgataataaagatacatcactgtcgcaaaggccgcaattgctccgatagcggtaataaaagtggcattcgctaataatccaatgataaaaaggacaaagccgccgatgattccgatcattgcggcgcgagaaggatcgccatttgactggttcgtatttgcccgagaaagcggttggacattaagaaggcgggcaagttctgctttttcctgtgaggttaatggcgctggcaagggatggtggtagcgagttttaattgcagttaattcctgttgccactgattagcttgcgtttgttgacggtgctgcaaagcctcttccgcttgtaattcaactacctgctccttaagtcgttgaagttccggcatactttgtggtgaatgcttaggcgcttgtggagactgatgatcgatccttgccaagcgctgttgataaacctgttgttggcggcgaagttccttttctctcacttgtagttcttgagccatcgtaacctgctgatcagttaaataatcagcaagcggccgagtttggtggctactttgccattcatagtaaaccggccacaattgctgtaaatgtgctaatttttgcaaaagtggctgttgtttttgcaattctgcctgtgcttgccgtaattttgctttgtttgtcttcaaatctgcttgtaggtcctgataacagtgaaatttaccacgcgcttggttaattttatctgtcaaatttgcatattgatgaaggtcttgattgagcggccatttccgtccgcgcggtttatagagatggtcagcttgtttctggtactgattgatcaactggtcccactgtgcactaccaactgcccctaattgctgcagatgttgttgccattcatcccgattaagctcgtccacagctgttaggtctcgttgaccaaaactaaaaagggcttgatagagcgaccgatccattgggccaagcagttgctttagttcttgttcaccaccttgacgtccttgtgaatcagtcacactaaccttaccgccattccgcccgcgttgccgtttaatcacgtaatcatggccgttgatctcaactaataaacttccaccataattagaagtagtcttcggaatatactgggcaaaccgattctttccccgcccatccgcaaagccaaataaaatactaacaagaaaggccatcagagttgtcttcccggcttcattagggccataaattatttgggggttagctgtaaagtcaaaatcttggtcatgccatttgccaaagccatcgatacggacttcctttattttcatatgctaatcctcccgccgcaataattgagtcgctgcttgctttaattgcttaagatcaagggttgtcaacttagctgctaaatcggcatcccgtgctaaactttttgttaattctgcaatattagcaggggtaaatacttcttgggcggcttgttgccaatactgttcatctaggtcagtcattgatggcaacgaattttgctggtggagcaagagatcatagacccaccatttaccattatctgcattttgatcctgcaggtgttcaaggacatccccatttgcaagcaggtgccgaatcgttggggaaagttgttcaatgttagcaatcgtcagctctaccagttggaaaggtgcgtttttaagtttgtcatcaattgcttgcgccagggattgctccacttcaacaagactactagttgataaagcattgatagttagacttgtccattcaatttccgcaactggtttaaattggggcacaagtttattgccctgactttccaccaaataatagccgtgctgtccggcctcatttttatgccgtccctgcggattaccgctgtaaataattggcggcttctcattcaagaattggtgcttgtgaatatgaccaagtgcccaataatcataatttttagcgattaattcatcggtcgtaaacggagcatagtggttattttgactttgccggactgctccatgaagcatcccgatgtgccaggtttcgtttctttttgatggatatttttgcacttgatcttcttgaatccagcgctgatcataactaaagcctgagatagcaacactgtcatgatttgccaaagtaagagtggtggtcattacgcgattgccaaaaacatgaacatttgctggcagctctcccgtgtcttggacaatttggtaatcatggttaccataaagtagataaacggggatgtgggcttgattaagtcgttcacattgcttaatgaaaaaatcagtagcggcaatgctttgctgatcacggtcataaatatccccgctaattaaaacaaaatcaacttttaaggcaatcgcatcgtcaacaatcttttgaaaagcagtaaacgtcgatgagtggacgcgtttccataacggcttgggcatcgaagtcaaccctaaaaaaggactatcaaggtgtaaatcggctgtatgaataaatctcataatttttcctcttaacaataaaggagctgagaaaaattttgctttctcccagcccctcacttggatcgtaataaattaattattcttgtcctggcatctttggcattacttcactgtaaagatcttgaattggacttgtaattgtcttattcaattgttgaagcatgctatcaacttgccgttcttggttcatcaagtcttgaacaaccttcttgccacttacttccttggcaaggttttggatgtttttaatttcatcatcagttggttgttgaccagtcatttgcttgtgttgagcatctgcttgagcttgttggaacttcttgaaagtgtcaaaggtgtcactgtcagcctttaatgcttcaaaagccttttgtaatccttgatattcttgagtttcgcgcaattggcgactaagttcatttgcagtatcataaatatttacaaccatgtaaaagtctcctttatctcattcttagattaattgtatcatattatcctagaaaagcgatcgaacattgctccaccattgacttgccttattaccaaagttatttactgattggttgaagttatttacaaagtcgccctcatctttgaggaatgatccccatcctttagaggaaccctttgtcttttcttttgcccgtgtttgagcatcttcaaccgtgaatttggttccagcagtatttggcaaaatcgcactcatttcattcttgtaaaggtagttaatgctccgttcagaaatatcgtttagggtgtggctttggtttgtatcatcatagccttcccatgttgcaaccactacatcgggcgtataacctacgatccacttatcacgatcattggaatcatcgccttttacccctgagtttgtggtccctgttttaccggcaagcgtatatccacttggtttggccgtttcaccagttccgtgatcaaatacgccaattagcatactagtcatttctttggctgtcttaccagaaatgatccgcttattcttgctaccatcatttttggcgatcacctttccagaggcatcttcaatcttggtaatgtagtgcggtgatggcatcaacccatcattggcaaagactgcataggcacgagccatttgttgcggtgatactccgcgggtcataccaccgagggccaaggcaaggttcttatcacccttttcaactggcaaaccaaacttctttgccatatcataaccacgattgaccccgatcttatttaataaccagactgctggagcgttaagactctcataaagggccttatacatcggtaccgtcccgctataggtatcatcatagttctttggcgtgtaattattagttccatacgattgtttcttatcttgaagcgttgaatcatagaaatatccatgctctagggctggtgtatatacaacaatcggcttaatcgttgacccgggctgccgccgcatctgcgtagaacggttaaatccacggaagacatgttttccacgcccaccaacgaccgcggtaattcccccatttttcggattcatcgcaatcgaggctgattgaaccattgtgtcatcggctgagttctgcgggaagttatcgtcatcgtcataagtttgctgcattgaccgctgctgatcctgatccagggtagtataaatccgataaccgttattcataatatctttttctgaaatatgataacggctttcggcttcggcaatgaccgcatcaaaaaagtacggatacttataactatcatttggcacgtagccgttggtaatattcaacggtgtttgcttatattgatccgctgcactttgactcagcttatgattttcaaccatcagctgaagaaccatattccgtcgttgttttgtcgctgctggatgttctactgggtcgtacatccctggtgacgtcagcattccggccagggtagctgcttggggtaccgttagctgactggcgttttcattgaagtaacgcttggccgcatcttgaactccccataccccatgaccaaagtaggcattattgaggtacattgttaaaatctcatttttgctgtattggttttctacctcaaccgcaataaaaatttcccgggcctttcgggagaaggtctgttgttgagtcaaaaaggcattcttaaccagttgctgtgttaaagtactacccccaccagagatatagtcacggtgaagaagtttgtttttcactagtaagaagccagcacggcctaaccctttgactgaaaagccgtgttcatgatagaagttccggtcttcagtcgagaggaccgcgttaggaacgtttgatgaaatatcttttaattccacataagttcccttttgagcgtagaggctcccggccgattgattgctacgatcataaatcattgttggccgttgcaaccggttcttaagatttttaacatctgcagttttagcaacaaacgtcaaatggatactggtaattaagaaaattcctagaaaaataacaatgatccatcgcgttaattgataccgatgccagaactttttcagcatcgcaacaaagagctgccaatagtgtttaaaccaaactcggaacgatgcccaagtcttttttaaccactctatgattcgctctttcaaatctgaattagattgtggttcacgattcattaacaaatctccattttcatttcaaaaagctgacaattattttatcacattttggcaaatggtaagctattttctccgccagctttaccagaaattaaaagaagaggaagtgagtgggaattaaccttctcgacaaggcggtgggctaaggatagaacggtgattagcacggcacgggctgattatcgttcggacttagcctcgagccttgtggttaatttccacgatatcttaaataaagttcatataaataaagaggctgttgaaaaaacgacgtttttctcagcctctccctcttctattttcacgaataatagcaagataaagtggaactagcttcgtgtcactacaaggctattctccacacgctttttatttacatctcatctggtgccttgatatcaagtaagtcaagagcagatttgagcacatcactaactgcttgagtaagagctaaccgtgctggttgagcttcgtccttatcaagaatccgagtgtgagcgtagtattggttaaacttcttagccaattcaagagcatacttagcgattactgatggatcgtagtttaatgcagcccgcttgattgcttcgctgtattggccaaggaagctgattaattcccaagcttcagcaccggcctttgtcaagtcaacatcactaaagtcccggatgccacccttacgtaagatactctcagcacgagcacgagcatattgaacataaggaccagtttcaccttcaaacttaacaacatcttcaagcttgaagttaacagcattccgacggtagttctttaaatcgtggaagataacggcaccaacaccgacttctttagcaacttcatcagcgttttcaaggtcagggttcttttcggcaatttgcttccgtgctaaatcaatagaatcattcaatacgtcttcaagggaaacaacattacccttccgcgtagacatcttcttaccgtttaagttcattaaaccaaaggagatgtgttcaatttgatcccaccagttgaagcccatttcctttaaggccgcacgtaattgcttaaagtaagtttcttgttcggcaccgacaacgtaaagggacttagcatgaccatacatccgcttccggaaaagtgcagttgccaaatcacgagtgatgtaagttgtcgttccattactcttgatgatgagtaatggtggtaagttatattcatcaaggtcaacaatttctgcacctcgactaggcttcaataagttcttatcccgtaacaattggataggttcttccatcttttgagcagagaaagcttccccattgaatgagtcgaagttaacatctagcatcttgtaaacacgttggaaccgttcaagagaaacttcacggaaccagtgccaaagccgccatgcttcttcgtcaccatgttcgagcttagcaaaccagttacgacctgcttcagtgtattctggatgttcgtcagcttcattattgatccgcacatagtacttaagcaaagtattaattggatccttcttaacttccgcttcgtctccccacatctcataagcagccattaacttaccaaattgagtaccccaatcaccaaggtaatcaatccgaattaagttgtagttaactttttcaagaatccgggcaacagcttcaccaatcatggttgaacgaaggtgacccattcccataggcttagcaatgtttggtgatgaataatcaatcgtaacatttgattggtgaccaagatcaatctcaccataatgttcaggatccgctaagatagtttgcaaaatcttagcaccaacttgggctttgtcgaggaagaagttgatatatggaccagcaacaactaccttttcaaaaccgttttggtcaaccttttcaaccaactcacttgcaatcatttgcggtgccttatgtaaggtcttagctaagaagaatgtcgggaaagcataatccccattactagaatcctttggccgttcaatcttagcttcaatttctttaacatccatctctggcaatgcttgtgccaatgcagctgcaacttgttgcttatcgctcatatatattcctccttatacttataaaaaaacgcccctaataagcataatgcttactagagacgagatttacccgcggtaccactctaattgaattagaattccactcattcattgatttaattgaaatatctgaggcacgccttcacaaatcgaaaagcccctaactctcatcaacaaagggtcgctgtagatttcaaagtgctactactcctcaaatcctattttcacactcaattattataacaaatttagatttaaaaacaaggactaatctacaagggtgagttattacttttttcttacttattatatgttacaattattatcattaaataataatgaaaggttgatgagttatttatgacaaaccctacaattcaagctgtcacaattgcaggtcatgattcggacgggagtgctggaatgcccgctgaccttcatgccttttttgcggatggcgtatatggtcacggtattttaactgccgctgtttccggaaattcttacgggatcacctcttcccaagtaatgccgcaagaatttattgccgaacagtttaaggtattaagtgaagattttgacatcaaagcatccaaaactggaatgcttgctaatgacgatgtaattaatgtcgttgctgataactattcgcctgaacattttggcccgttagttgttgaccctgtgattattactaagcacggtgcaatgttgcttgaacaatccgcctatgaactatttcgtgaacgaattattccccttgcaactgttattactcctaatttctatgaagcacaaaaattaacaggaattgaaatgaccacagatgaagaacgggttaaagcagctcattatcttcaagacttaggggcaaaaaatgtggtgattaagggcgcgcataatgatgatagccaaacaactgttgatgactttgttcttcttgaagacggtgatagcttctggctcaaaaaaccttttgttaagactgatcggttgaatggaaccggggatagtttctccgcgatcattgctgccgagcttgcgaagggaaataatgttaaaatagcagtaacaaaggctaaagatgccgtttacgcagcaatcgcaaatccattaacggttggtcataaatttggcccaatcaatcattgggatgcgcaaaaggagctgcattaggaggaatttttgatgcttgatacgtataggcacaaagttgtattaataggtgacggggctgtcggctcatcatttgcattttcattattgcagtcaacaaatgaggtcgatgaattggtactggtggatcgtacaaggtcaaaagcagttggggatgcggctgatcttgctgatattacacccctgacaaacccagtaaagatttatgcgggaacctatgaagatgccgctgatgctgacgtggttgttattacagcggggattccccgtaaacctggtgaaacacgtttagacctagttaataaaaacactacgattcttaagtcaattattgaaccgattgtcaaaagtggattcactggtgttttcgttatctcaagcaatcctgttgatatccttacaacaattgcgcagcgaatcagcggttttcctaaagaacgggttatcgggaccggaacttctcttgattcaatgcggctacgggtcctcttaagcaagaaattacacctatccgtcaatgtcatcgatgccttaatgcttggcgaacatggtgatacttcttttgcggcctttaatgaaatcacaatcggtggaaaggccctcaatacaattactgccctttcaaatattgataaaagtgaaattgaaaaaacagttcacgaagctggcagtcaaataattgccaataaaggggctactttctacggaattgctaaatgcctctcgtatattacacgggcaatcatcgaaaaccggaaccttgtcctaccgatttcggctccgcttgatggacagtacggaattaagggcctgtacttaggaacgcctgccatcattaataatcaaggaatcggccaggtcgttgaatatccgttaacatcagatgaagttaaaaagatgcaacagtctgctgaagcaatgcatcaagttttagctaagattgagatctaaaaaagctgaagctaggagaaaactttctcttagcctcagcttttttataagagcgggtaacgagaatcgaactcgcgacgcaaccttgggaaggttgagttttaccactaaactatacccgcattaactaactaagttcaacacttagttagtatatacctcttctaattatttgtcatctttttttaagatttttttgaagatttagcatcttctactatttcttcgtcatccttttcttcttcacgaggaacagcctttaccatcttagcttctttttggcgaataacagcgcggccatttaattcgttaaccccgcttttatcagacggatcaaaatcttggatggataccataattgaattagtataaaccttttcaacaacaccagaaaattcatgttcgaggggaccgaatttctttccttttacaatatcgccaatttcaaaatctgccacttgatttcacctcaaatattatttatttttacgcaagcaatatacgtaccatacactttttttattatattttcaagtcaaaagcatatagtgtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggaagaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattcataagtatctaaaattattgttagctctgcttgatcatgatgacgaacggctttaattgctcgcatggctaactcgttgtgccggcctaaagtatgttcaattttctgtaaacaatgatagcggtcgagaaagtattcaccatgtgcaccttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtattgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattaattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaacgcatatagtcagtttctctcatcaatgctaaaatcaaagccgaaaggagtttacccatatgttaaaaataatagtggcggtcttaatcattattttgattctcatcactaccactggtctgcatgcaaaaattgaacggaaagtgactaactggcttgaactaagccgtttattctttttccttttattgaccgcttcgattgtccatacctttcttcatttcaagactcagcttctgagcaacctagtatggatcatctttttaattctaatctatatcttaatggaaactgctttccgccttaaacgggaaacatttggcaatccctatctaacagccttactttttattgcccttattattgccttggggattggctgctggtggatctaaaccaataactgttttcaatagtgtcaatcattttcactaactgactagtttcctcaacatcatgaactcgtaaaacacgaccgcctcgcaaatacattgctgtctcagcaatcaatgttacgccgagacggtcttcttttgctagattaaataatttttgaccaaaaccttttcgggagatcgcaaccataatcgggcgctggaggtaattaaggtggtcaatgtttcgcatcgtcgcataatcctggtaaccgtcagcaacctttgcatacccaattccttgatctaaaatcactcgttcaagatcaatgccagcagccgctattgtcccaagattgtgttcaaagaatttctgcatcgctacggtaaggttatcatagtcatgggttcggctgctatgcatcgttaccattccaacatttgccttagccatcaaaattagtttttgttttgaattaaatgcctgcacatcattgataatatctactccggccttaattgccgctgccattactgggagtttatacgtatcaactgcgatcgcaatctggggatagttttcgcgaagaagctgaatagccggcataattcgcgcaatttcttcttccggatcaacctctttaaagccacccggtttcgtagtttgcccaccgacttcaattacgtttgccccagctgccaccatcttagcaatttgactagcaatagcggaatgggattgaaatttacccccatcataaaatgagtcaggagttacatttaaaattccataaatcaccggttgctctgtcagatcaaaagtaaaccggcctgcacgccaaataatctggtgacgacggtaaacctgttcaagagaagcaattaattcttggtcgttctcccaccgctctttcacccgtgctattagttcttttagggaaaggagcgggaaagaaaattctacgcgcttttcaacacaagcgacaggggtatcaaaatgacggataaatcgctctaccattccagccgtctccacatctggacactcccacgtcaataaaagctgctgatggcgattaacttggtcggctaagatcgcggacactaacttcgaatagtctttagtaactaaattttcagtaactttcatttcattctcctaattgatctaataaatttttaacagctcgtgcacgatgtaaataagaaatgcgggtcggctggtccatttcggcgagcgtttgtgattcaccagctggaataaaaatccgatcaaaccccgtcgcattgactccgcgttcggcatgagcaattgtcccctttaattgaccatgaccaattttaaccacttgattatttatcgccagggcaattgttgttttcattataaattgtcgggatttaccatcaactaaatggatcaagtaatcatttaaatcaccattaggaacttcttgtgccaattcccgcgctgtctgcaccccgtaccttccaggaaaagccgggagttctaagccagaatcatcggtaattatttttgctgccggtagttgttgactgataaagaggacctttgcctttgcgttttcttcatagctcactattgattcaggaggaaaggtttgttgcggtaacttttttcgatacccctcaccgtgttggtggtaaaaatttagaatggtttcaatttctttaattttatgaatattatgggttgcaataataaaattatttttcatctaaactggcctcgatatctttaatcgtataaaaagaacccgttacaataattaaatcattcggctccgcaatcttttttgccaccactaacccttttcggggattatcggcaataatcgcttgaggcagagctgatttcaactcacttacatcaagggcgcgagttggatggtcaggagtagtaattattatcttatctgccatttgctgataaattttaaccatctgactaatatttttatcagcaagaaaaccaagaaccataattactttattacggggaaacttagagatagtttcggtaagttgtttggctgcatctggattatgagccccgtccaaaataatagaaggatgatcagcgattttctgcattcgaccagcaatcttcactgtcgcaagcgttgatagtaaaggctgccaagaagtaaccagtcttcgttgaaaaagaaaattaaatacactgacaacggtgcccaaattttcactttgaaatgtccctaataaattaaaaggaactttataaattttatgattaactttcaggattgcctttccatcaacaattgactgggcatctgcttgcgttaatcccactctttgctgatgagcctttgccttaataattgtgagagtgtctttttcttggtgcggcgctaaaaacacttgcttagtcccattcttgataatccctgctttagcttgggcaatttgggtaatcgttgggcctaagatccgcgtatggtcaagggcaacatgtgttatcacactaataaaaggcgcattgataatattggttgcatcatcttgaccgcctaaaccgcattcaatgactgcccaatccactttttgatccgcaaaatattgcagcattattaaggtccaccactcaaaaatggtaatatcatcaggcgaaagatcaattggtaagcgttcggtgatcttttggtaagtcatcgcaaaatcttttttactaatcaaatggtcattaaccttaatttgctcccgatcatctaccaaagcaggactgctaaaataaccgacccgatatccagcattttgcaaaccctgttctaacattgtcccagtcgagccttttccgtttgtccccgcaatatggataatcttaaatcgctggtcaggattttttaaacgagtaagaattcgtcgtaaaaattttacccgatcctgttgtcctcccaacatttggcggttaaagcccgcgttaatttgttcataggtctgcacgataattcctcgtttgatttagaaattcttgtttcaaatcactgtcagtcttaaattgacctgtaaacttatcagtatacgtaaattgaccggccttattaacacctcgcatttccatacaaaggtggcgggccgcaatggttactgcaatcccggctggatcaaggattcgttgcaactcggctactaaatctgttgtaacgcgttcttgcatccccggttttttcgttacaaaatctaacaaccgggggatcttacttaggccaataactttcttatctttaggaacataagccacattcgcgtatccgaagaatggcagcaaatggtgttcacacattgaataaaaaggaatgtgctgcactaataccatttctggcacatcatcaacatgaaagaccttatagttcgccacttcttctggttgatggttaagagaagaaaaaacttcttggtacattttggcaacgcgctggggtgtctctgccaatccttctcgttccggatcttcaccgattgcaattaataaatctttaacagcctttgctattttttgttggtccatgaaaatacctctcgtccatatatctttttaagccaattatggtctggagtcttatttaataaatgatccaattgttgataataaggatcattttgattagtaatttcgcgcattggtaataaaacaaactgccggttagccatttctggatgaggaattgttaacgttgaggttttaatatgttgatgaccaaaatcaataatatcaaggtcaattgtccgtggtccccaatgaatgagccggcgtcgatgtaactcctgttcgatattgtgaagatggtcaaggagttgctgagctgttaacccagttgcaactttaaccgcaatattgtaaaaagaatcttgtttgacacctcccaccggttctgtttcatacactgaggagatcgccgtaatatcaattttaggcggcacattcagcatctgaatagctttttgaaggtttgctaaccggttgcccatattactgccaatgcttaggtaaacttcagtcataattacttgctccctgctacttcaatttcgacattatcaaaaattccggcaattggcacactatacttacgaatacgaaggcgaataccattaagcattgggtatgttttgaaaagctcatgcaataaattattagcaaggctctcaatcaaattgtaattatggtgggcaacaaactccgcaattgtttcataaacatcagcgtaactgacagtttcctctaattcatcggttttaaccatcgtttcaattgggtagtccatttcacagtcaatttcaattttttgaccaagctttttctcttccgcaaacacaccattgtaagtattaaatgccatgttgttaattctaatctttccgataagctattgccccttcattttttattttctatcataacgcataagttagttggtgaaaatatcttaatagattaagggcgcaatcttttcctggtaccattgttccccagcttttgagaaaggattagtaaacggcgcaggtttaatcaagcggtcatcgacgttaaacaattttaactgtcccttaacttttaatggttcaatccaataagaaccaccttcctcaaagggtgcaatcacccatgcataatatttttgttcaccgtcatatcgttcctcaattccagtaatcttagcaacacataacgcatgactagctaccgccccatgtgtcttctttgcactattgcaaattaggaggtcaccacgatatttagttgtccatgtccggtattcctctgtttttgtgtcatttaagatttccattccatattcgggatgaattgataaaactttcattttggtcttcctttgcagttttatttcaatataaagaaaaaagcccagcaaatcaatgtttaccgagctatgatgatgcctcaggcaggaatattaaacattgatataacgggctttgagctttattttgtcgtgagtttgtcgtgaactctataattcagccagtttatcaatgattagcgtgtcatttttagccttgtactcatccaccagataagaataagtatttaaggttacagtgatgtttgaatgtcctagccgtttactgatggcgtatatatcgacaccttgacttaacaaataggcaacatgaacatggcgcaaggaatgaaagtgaaacccttgcttttcgatgccacagtcattcataatagagcgcaaacacttattcaatgcgttacttgttgggattgtccctaacacgttttgaaacaccataatactattattagctttcaattcagctaaacgatttaacagttgacggttaaccttaatcgttcgcttgctagattctgttttagttggtttgaaagtttttttcttttcgtcccacgacttagaaatactaattgttgaatgtaaaaaatctatatcattccacgtaagcgcctgtatctcactcttgcgcattccagtataaattgccgtgagtatcatgtaacggcttgtattatagtgattgagcttcttgttgacctcattttttagtgtcactaactcatcatgactaaggtattcaactttgcgctctcgctctttattagctaccaccttgacgttatgcgtgaagtctttgctgataatatcatcatcaatcgcatagccaacacatgaacggatagcattattgagcttgtttacgctgtccctagcatgattagcaccgtaccagttaataaaggcttgataatcagagcgcttgatgtcccgtagtcgtgtatctttccagtagctttcaatggctttccgtataaccttataacggtttttcgtaacatcagtaataccattttcctcatagagttcataccaccgccaataatacttagctagtgtcatatcttttaaatcaaggttcacttggtctaactctgcttctagtttattggcttcttgcagtgcttcacgctttaaattaaaacagccggctgatttctgatgccacttcccctcgttatcttggtagcttgcataaccgtagtatccttttttcgcttttcttacataactcataaaattacctctttcaatcgcacagcttgccaacgtggatattggaggtatgtatttgagttttcgtggcgcaattttgcgctgtcaaaaggggatgtactgagccaagttttcggctgagtgatattcactccgcaattttgccgggctcaattttgagccgagtaaagacgcacgcaattatgtgcagatgtacttaccccaaaattgaggtgagtaagatgtgtccgattttggacggatgtaatcagccgagttttcgaccgattgaacattggcttaattcttagcagatgtccccaaaactggggaaatatagcagtggtgctattagtggtgataacagtggcgctattagtgtgtatattggtttcgcagtatagaaccttacaaaacctaacattaaacggctatatattagctatatcagcaataaatcagcagaaagaagccaagcacagcaagggtttcaacgtaaaaagtgcagaaaaacagcagattaattactacaaaatatcacatcgaacaatgacactacctctgaaaacctctgataaattagctctatttagcctaaggaagtacgatacataaaacttcaacaacgatatttgatatgcaatcaaatgcgttaataataaagttttttatagtgtctctcctagtagcttttaactataaataccatgaagggtcatgatagttagggtcaacattatcaattcgactttctaaatctactagtttgtcttctgtactttctaggacgatagcaaaggcttcaaataattgttctcttatcttatcgtttttatctttatcatcggtaaaattaattttattaataattctgcctatactttcataaggatcagttctttcgtggctcaatcctttgatatagtctgtactaacatcaaagaaaacagcgagttttctccaaatttcatcgttaggatttcttttttcgttttcgtattggcttaacgtattatctcgcataccaactttctcgcctagctctttaagagttaggtttttttcttttctcaattctttgattctattgtgatgtttatagcgatgataggaatattcactcatatattatcaccttctttacttgattaaataatatcattatttcacataactgtgaacatttttattgacattcacagttatgtgaattaatatttactcacagttgtgtgaatagaggtgatattaaatgccaatgtttctaacagataagcaagtaatagctatcaaacgcaaacgtggtgaacttaatttatctactgtagcacttgggcgtgaactcggtttaagtcgatggacgctagacaatatctttaagcgtaaccatcgcaaggtaacgccagcaacttataagaagttgagtgattggcttattgacgagtacgccacagcagatattaaagacagcaccgcagtagcaacacaagacaagtagaggtgacaaggaatgacagaagttaaacgaaatatgaaagtagctccacaagaagaacgtgagacgattatttcttacgagtgtttaacagggatatggcacatttacacgaacgaacccaaacatgctaggaagtacgagaaatatgtaactcatccccagcgcaaagggtacaactcaacaggtcgattaatcatgctagagggtgatgtagacaacgggaaagttactattcggaaaaaatcaccgttaacaaaggcacaaaaaaatcacttgcaagaattaaataaaacgccagcatttttgagtaacgtacatacagatgtacaaagccagacatcaactaattaattcgataaattatccacatcaataaaagaattctcaaaaacgcaagacaaataaggggatgttttgaatgaataatctagttttcatgcacggcttgaatgaagagccgtataccacagataagatcatttcagaatgcagtaataatcaattggataatgttaagcacctaatccgtaatcataaaagagactttgaagagttcggagttttgggatttgaaatccgtaaattaaatggacgtggacgaccacaaaagacctaccaccttaacgaacaacaagccacgctcttaattacctacctagataacacaccagaggtaaatcaattcaagaaaaaccttgttcatgagttctaccgtatgagaaaagagcttaatcaacgacagatcaaccgagctattgaaaagccacagcgtaagtctttgatggacgctgtcaaggattggccacacgttactcaatggagttatcgcaatatgacacagcttttattaaagcgtgctactggtctaacagcacagcaaattaagaaacagcgacacgtcaaagttgcgttagatggtctaacactcaaagagcaagaacggtatcagcaattagagaatatcgctattggccttgttggcctcaataagacgtgggacgaagtaaaaggcgttttgctattagcttaatgattggagttgagaacatggaaagtttacaagtgcagttgccaaatgatttacaggaagcaaccaaagcaatgattggggatgcactcaataaagcgattaaggatgtgcaaaataaaaatagcttcccaccttatctgaataagggcgaagctagtgcctattgtggtgtatcacggggtgtcttcaatgcttggcttaaaaagtatgacatccccacaattaagattgagggcgttagtcgtttcagacgtaaagccctagatgagtttttgatccagcacgaaaaataaataatatcagcttgccagcgtggatattggaggatttattatcatgaagcttttaataactattgataaacacatattaagctactgggacacagcaccaagtgaaagagtttgggcttaccttgttaccttgcctgttgtactcgtagcaatgaatttactcgctcagttaatcaagtaaaggaatgaagccgatgaaacaactagacaaagaagagcaacaactattggacttgttgcctaaagggattgaacgccctcgaccactcaaagaattagtgaaacttactggatggagcaatcgcagagttagaggaattattaatcgcttaatcgtaattcaccatcagccaattggtgctaagtatgaacatcctaacaacggatatttcatcatcaccaatgacaaagaacgacaacaagccttagctcccctcacctcacaaataacaatgatgagtaagcgagcgcaggcaatcagtaacgcagatttagaaagtgaagaataatgtttcgacaaaataaaaaagccgtcaaatgctactcaccgaccaaagtagttagcatttaacagcaacaaaagaataagcgcaacggataaagcccgttgcttgcttattctaacatatttcagtatttaaaacggggaatatccccaacaaatggaggaataatcaatcatgaagaaatttaatatcgaccaagtagaggacactaacgttactttagatactgttaaaggactagcacaaacaataaacgaccttttagaggacaatgtttccttattcactgaatatccaagtacacataagggcgtgaagtggcaagctgatcgtttagtaaccaaactactagcattagcaaaagcaacaattacagcaacgacaaacgctcaaaatcaaattaaaaccgttgctgaagacttttataaaggtggtaacaagtaatgactgaaaaaatagatgagcttatagcagaccacgaaaccatgagcggattaatttcatccctaattgattatcacgaaaggctcaatgattatttagctccatgcttaaaggatgattacacccacaatgatttaactagcctagtcttaacggtcaattatcagcaagatattatcagcgctttacatgagtgcttagagcgcctaaatgataatgatttagaagcattgcaacaattagcaactcttgaactcaaaggcggtgatacagaatgcaactagttactcttacagcaccagacggacaccgtgaacgttgggacatgaaaactacttacctcgccctgctctcgtggtattcatatcttaaaaacaccgagaacagcaaagaaccaacggaactcgctacccgtattagtaagttcgttgggaatgatattaagcaagttcacaccttcttagtttacttagacggcttcaatggtgacttatattctaagttgtccttgctaacgaacaacgatgataaaaacaccactcgcctttatttcatcatgaagtcaattaacaatccaaattacttagcgcacaacaaaaagaaagagcgagaacgccaaaagattgttgaacgcattgaacaagtcacaaataacgatgttgaaatgcttaaacgccttatcgctttaacaaagctatttgttgatggtcaattaagctataagaatatggagggatgagtaatgaaattgcttcaagcaactaatcaagatggaaatttgatattaaatgactttgcgacaggaaatgaaattagcaagcggatatattggcgtgatagtaccccttattatctaagtaaagatgatgacttgctaattccttttaaggctatccgtgtaactaatgtttaccaagaggaggatcaaagtaatggcacaaagaagaatgattagtaagtcaatacaccaagacggacgctttttgactttatcgcctgtaagtaaaattctttacgatgatttagtgctatatgctgatgatgatggcttttgttctgatgtttctttaattaatttgatggataaagcaaccgctgaaaactatagcgaattagaacatgcgggtcttattgttaatgttgagggagtttacttgattgttgactggctaaatactcaattattaaatcactattctagaacttcttttctcgatttatccagtaaggtatttatcagaattgattttaaatacacaataaacgcagaagatagaaatattgccttgccattagatgattgggtagagagaaaaaatcgcaacagacagataaatcttaaagccttgcaacaacagcgtttgaaaggtgtggtaacccaaaaggtaacgaacggtaaatctaacgtaaacaaaaagattactaaagggtcacctagtatagataagaatagtatagataagagtagactagaacagtacagtacagctcagaacagcaaagaaaagatcaataaagaaaataactacaagtatataaatagttcttctaatgggggtatgggggaaattcttcttaacgacgacagctctacttcctctatagagaataatgctactacagagaatggaggaaacagtgcagtagatagtggagccaaccaagataacattaacagtctattcaactacttaaacggtatatcaactactgatatccccaaagataataaaagacttgctgatgtttttgatatgttaatccataatggctatgaaattgaggacatccaattaggaattgataacattatgaacgttgctaatcaaatgccacaatatcaaaacgaacaatcattagccaagctattaatacagcacctacccgagtacaccaagcaaacattggaacgatcctctagtaatgattaagacgcagaggtgatacattcatgaacctaacagaatttgagaaaagcctttctaacttttgcactggatatgaaacctatactaaattgatgagtgacattaaacgattagacaacctaatccaagccaacgaaaagcaattaaacgatagcttaatcaagataccatttacccacttgtattttgttgatggtctaggtattttcaaacatcaaacgcctaccctactcaaacaaaacaggcacttaataattaaatacaatcgaaagctaataaaagccaagaaactttctagttcgcttcaaaagcaattaaagaccattagaagcgattatctaagaagcaatggtgaggaaagcaaagcaaaagataaattagctaataaatatttgaagcagtttgggcagattaggcacccttaaaagtaatgacagattagtcggactataaaaagaggtaattactatgaaccgtgaagaaattgaagatcatctgtctagcgttgtactggggcttgatactaacaacatcaagctgacccagattaaggaactagacaaacaaattgcagagaatgaagcacaattgaataagagcctaatcaaaataccgttcgcccataaaaagatactggacgacatgggtataattaaacaccatgttcctaccctgctagagcaaaataagcagcttgttaccaagtacaataaaaagctcaaagaggcgcaacaactcgaggggcagatagttaatcaccttaaagccgttattgatgattactcacatagtacaggcaagaatagggaaactaagaagaagttaattgatagctatttcagtaactactcaattaatgaaaaattggacgaatgcgatcaactagagcgatgaaaataaacatcccccaattactgttatatcaacgataatcgggggatgatttaatttattcggcggaaaaggaaacaaaaagcgtgcaatgctttactagcccaaatgctgatatatcaatagctcaactgtaatttttcgttatcaattggacggaaaagctaaagatattggattggcggagaggttatgcttaaacacccgtttattttccagagatccacatcgtgaccgtcgctatttatcgttaattactttttagggtaaatcatcatcttttagttaaaacttcttaaaacgccttacagtacacgagaatattatctaaaatttggtggcttaaaattcagctatcaaaaattgacagcctaaaatctgaccgccaaaatatcactcgtaggatcatagcaataaacatactaatcagatttagaatagtgtttatttttaatttaaaggcggttttaaaagcgataattagttttaaatataatttatcatttgcaagttaaaacggctcagacggctttaaaactaaaattagcatatatagaaaaatggagttgatttaaatgttcgctgtatcgtgtctgttaattggagcaattgcatgtagtttggcaagcctttttgctgatattgcggttatatggctattcacccactacatgaaagaccagtacaaaggggatgattataaatgagttggtatcgtgggcattatgtatttagtaagcgatccttagcacagtggatggctgaaagtgagaaagattatcattttagagttaagaacaaagataaagcagacccaaccgtcgttaattttgtattttctgagaacgtcaataaagacaggcgtttatataccgcttgccgtacggcttacaattgctatttagattattgccaacaacaatccataactccattaagtaatcgccaatttaagcaaaacatggaattgttgggctttgtttatcaaaagcaccatcgcttttatgttggctattacggtaacaaggtaacaaccgcatataaaaacattggaattgtgaaacagtaaatgttccatgtaatgtgcaatttatcaattcatctaaaaggttgatataacagcaatcttaattaaaaaccattgccaaaaattgcacattttcggggatgtttgtagttaaaacaatatcggaaaaacttatactcgttagctaattcgtagttaattgttattgcttatgagtgattagctgtaatcgttgatataatcacatttaacgtcaaaactgaaagcaagaaagagcaatattcgcccctcttttgctatcaaaatagaccatactaaaaaagcccccgttctcttttaacgggggttggtttattgatactttgggaacgcacatcgacttttttgtgcaacaaattccaataaaaaaagacgctctactgtgagagcgccccttagatacaaacttaaagcaattcattatatcacatgattttatttaccctaaaaagggtatgaatttattctatcagttagcattcaatattagaagttcccctattgttgaatatgcttatgatagttatatataatataagcatgataagtaataggagtaattaacctagcacttatcaaggcggaaaagaagctagacaccaaccagccttttacaagcacagcaagaaacggaagtgttggttatgtgtttgtttcttgactgctagggaggttctggcggtgagcataacattaacatttacaagctataaaatgcttgtatttgtagttgttattgcaatcagcctactaaaaaagcattaatagctactaactactaatgctttgaagtaaacctgtctagcaagaaaacgtcgggcgttaggttctagcacaacctagcgcctttttacataaacaattataacatgtgcatataactatacaagatataactttacgctataagacactatattacactatatgcaatttaaggggatgttttcatggttacacttgcacaggcagaagctactaaacgatacaagaaacgacacccagagaaaaacaaactatatcaatatcgttcaaatgctaaaacgtttattaaacactatgcagataaagacgacctagacaaattaatatcactagcacaagagcaaaaagccaagcgattaagtgacgagggcgcaaaattgcgcttacccgtaaaaaaacaagttaactaactaaaggacgacctagacacctagaccgcccttttattttgcaccactcaataatctaatattatcactttggatatactgaatgttaaccaatgctaacctcaaaaaatcgcttaacccagtttaaaaatgatggcaaatgatggcacgatggtaggaaatggtaggataaaaaaagagtagccctcacaagctacccttgatattgtcgaaaaattaacaactttacttttcacgccccataggtattttagcatattatcttgagtataatttagtgcgcaccctcattaaaaagtatgcgtactttccaaaaaagtgtgcatacaaaaacgagaaaggttgcaccctattttgatagcccttgaaagcctctagctttactgttaaaacctagtaaatcctaggattttattagtgttaaaatgctcagaaatgctaggaaatgctaggaatttataaaagcatgatgctagcaaatgctaacattttctactagcagatgttgggaaatgttggagttaaattgcgcttaaaagtaaataaaaagcctagcaaaataaagattagattaaagctcaaaatctttatatcgctagacttaaaacttgaaatcaagtggtgattaatcaccgccctaagagttgcaagttggtagctcaactcttaggggcttttcatatgtatattatagcgtttaaaagcgttaaattgcgttaaaaaaggcgctctgctgtgagagcgcccttgagatataaataaaaccaaaaataattatatcatcccccgcccctatctttgaacaaaaaagagcgcacacatttcaatcgtcttgcgtgcaaacgataatttttaaaattttagggtagaggggctgtccttccctagcctttgatatatcaacaatcataaaaattaaattatctaaaacatcccctttttagcaattaatcagagacactttatcaataattccgacaattcagacaccctaaaaggaaaatggctgaattttccgcagatatttccacaagcaaaataaaaaaccacctaaaaacaggtggctcacgttggcaagaagatatattattttgtcgtgaaattgtcgtggatttgattaaaaatagtgttctatagtgtaaacctaaaattaaaaatgctgatatatcaacgatttagacactatcgaaaagtatttaaaatacaaaaaatgcctcaggcaggattcgaacctgtacatggataaccatacaacgacctgaacgttgcgcgtctgccagttccgccactgaggcactaactattttgtaacattattaagtataccgaactcatcaaaaattacaagtatttttatttacaatcctcaatttgcccttatttaacaaattgaatcattgttccatatgcggttaggaccaagaatttgggtgcaacctgcatattggcaacatccgtagtaaaacgaaccccaacaacaccatctgcacctttttcactggcccgccgctttaatttttcttgaacatcactaaataattggtccatggactcaaatgaatcaattgcttcggtaggcatcgctaaatgactggtggcattgacaatccctaaaatgcggtgggcttgaggaaatccctcagttgataaaaacatctattatcctccggtactgtaccctgtcaagtttacacactaaataataaaaattaattggctttgccgtaacgaaattccgttgcagtaaggtcatttcttttagctgaaataaatgtatttgtaaagtattcaattccttcagccactagtgtttgaagttcatcaagtgtttgtggcttagatgaatgcgctagccaaattgctttaaagtcggcccaccagtgctcgataactgcgttatctgctggtgtgccaggagctgaatagctatgttgactattattgctagttaaatattgattgaacgccttagaagtataagcagctccgcgatcagtatgaataagtggggctaatacaccttcttgtttctgagctttcttgaatacttgaattgctccctcactagtttctgttggggtaattagccagctaattggaaattgaccatataaatcaagaaccacatgtaaacgaactttataattatgaatattgtaggcgagttctgttgtatcagttacccaaacctgattagctgcttcctgtttaaattgacgattaagtatattttcagcttgataggtttgacgttccttgtcgcgttttcttttagcttgacgatagtcagctttaatctcatgttccttcataattctaataactcgttttttgttgaccaaatatccaagacctgcgcgcttaataagacgagtcattttcccatagccaatactttgcttattagttttctcaatttctttaatcaaattaaggatctcttgatcctggatatccttagtagttaattctcgttttagccacttatagtaggcttgccggcttactttagccgctttaactagttctgatactgtataaccgtctttaatcatttcttgaatcgcttgatatcgtccggtcgatgcacctcccgattgcgtatttcgactaatttttttgcgaacgcaatttgtacctccctttctcgtttctcagcttctaattcacgtactcgttttctcaaccgttcgagctcatttgtcggttctttatctttatttctgccacgattatcttttagtacttcccaattatgatcgtgcaaatatttacgtacccacgaataaacccgctgataactaatatcatacttactagctgcttctttatagttgttctggtggttaatcgtccactgcacaatctgctttttctcatcaaaggatactttccgacccattttcttaactcgctttcttgttgcgtaagcaacagttagtttgtcactattgtactggataatccattgttttagttgagaaatatggcgtattttgtacttaattaaaacctcacgactagccagtccgttaagctgataatctttcaccgcggcaatctttgtcttaagtgaatatttttggttatgtttaggacgaattaatcctgccagtcctgctaataaaaattgtttaatccatttagtcatgttcgctgttctcacttcgtgatagtcagcgaatattcctaatgagcaatctgaatcctgataattacttagtaatcttaatttttctgttgtggaataactagaaacgaaaaacaccccctagaattggcacttttattatttaaagtgtcaaccctaaagggtattgtacgtccctaaattctttaccatttaaaaataacaaagaggccggaacatttccagcctcttttgtttattgcggaaagaatctgctactttgctagggaactaattattaattcattttgattctaacttccgcaaagtcgcatttatatcatcaacctagtgcaccctggtgaccttattacataaatattcagtctaaaatttcatgtcacacttaggttgcttctagcctactattaatttcttcggtgctagattgatataggagatcttaccattctaatctttccacacttataatgtaccaccaattgtaagcgatttcaagaagcaactttagataacttgaaccaagagaacatacatcgcaatcgcattattaatcatatgaattgcaattgaatttcgaatgtcatccgttcgcaaataaacatatgctaagaccatccccatataagcatagatcaaaaagctaatggggttggtactcatatgaccggtagaaaagattacccccgagaagataactttcggccagatgttgccacgcttaaagaacatatttgtcaatgtaccacgaaaaataaattcttcagcaattggacttagaacaactgccgaaaaacaaaatacgatcgtaattacttcattatgaccaagcatgcttcctagtgctgcattgttcgctgtttcagtttgatgatagataagttgattaaggtagctaaggacatccattcccaaaataatcgctagataaccaccgataatccagccaacctttattcccgccggctgtcctaattggttataagtttcatatgtccggtgtgcccaccaaataatcgctagcattaaacagatgaataagaccatgaacccgtccacgataagctggttggtctttgaataacgtaaagcaaaattaactgcaatcgggggaatctcaattgcaattaacatcagcgcaattaaaatcaccctaaatatccacgattgtttaattacttttatcattatttttctcttcctttgcccgtttctcacgcattcgttgaatactccaccgggtagaaatttttgtcacaatgatgtttgcaaccacgaaaccaattacccagagaaggtacattacccagccagagatataatgttcggcagttagccatacgaggatcgcaaagatgataaatggtggaataaccaccttaagaataaattctgctttcacaaagaaaacctccattattatttgttcaacagtttactaaattggtacgttaagcgcaaggttactgaaaaaaataggagggctgagaaaagttttcgctttcctcagcctccccattgttaatttgtgtttaagtaaatctagttattctttgatgcagcaactacttcgtcataagtaggaattgatggtaatgcaccaagcttttgaacagctaatgaacttgcacgttgagcgtagacaattgccttttcaatgttactcatatcaggctttaattgggatgaaagcgcaccgatgaaggtatcaccagcggcagtggtatcaacagcattaaccttaaaagcaggaataaagttgtagccatcttgagtacagtagaaggcaccctttgcaccaacagtaataattaagtttcggacacccatttgagcaaactttgcagctgacataagcattgaagtttcgtctgtaacaataattcctgttaaagcagcactctctgtttcatttggaatgattaagtctgttaacttcaataaatcagggttaatttcatgagcaggagcaggatttaagattgtctttacaccattttcctttgcaatttggaatgcccgtagagtagcttcttgtggagtttcaaattgagcaatcacaaaatcagcagcggcaatttgatcacgagcatcttctacttccttaacgcttaattgttggttagctcctccgtacactaagatactgttttgaccactttcatcaagcaagatggctgcagatccagtacctgcttgatcgtcaacgtggatccctgttgtgtcgacgttgttgttcttgaggtcattgatcatcatcttaccaccagcgtcatcaccaacttgaccaacaaaagctgtttcagcgcctgaacgagcagcagcaacggcttggtttgctccctttcccccagcagcattagtcttacttaaagcggcaattgtttccccaggtaatggcatccgcttaactttcattgttgtatcaacatttaaactgcctacaattgttacatgatttgtcatttgtttatttcctccttaaacaattggcatctaattgataatatcatcataccatattattttggacgataggaacttgtactatctcgtttaattaattttactggaaagttttgaacgcgggcttccgcactactatgactaatctgttcaatgagcattttagtagctccagcgccaaggtcaaaaattggttgttgtactgtagttaatcgtggataaacatagtcgtcccagtagatattatcataaccaattacagaaatatcttcgggaactttaacgtctaattcatgtaatcctcgcaataatccaattgccatctcatcgttcgccgcaaaaacagcagaagcaccagttgctaaaacatcttttgctgctttatatccgccatccttcgtcaaaggtgcccgaataacatcgtgaataggatctaaacttaggttattttctttaataatatttttgaacccattcattcggtgatttaaattttcagtagggttgtcagaggtaagaacggcaatatgtttgtgaccaagttcaatgaggtgtttagccgcgatttgaccaccaaggtaatcattcgtttgaactcgatcaccctcctgcgtatgattttgatcaaacaagatgtaaggaatctcattaaaggagataacttctttaattgtctctgtagtcatcgttgcactagcaatcactaatccactaattgatcgttcaatcatctgggaaaggtaatatttttccaattttgggtcacggttggcactaaagacgagcggaataaattctgcttcacgagcaacactctgcactccctcgacaaaagtaccaaaaaatgggttagcaatattaggaactaataccccaattgtcttggcactctttaagattaaatttcgggcattgaagtcaggaacgtacttatatttgtcccgtaatgctaaaactcgttcctgagttgctgtgctgaatcgatcgcctttattatttaaaatttgcgaaacagtggttacagaaacaccagcttcttttgctaaatcacgaattgttattttctttttcatggctgttcaacctctttagtaaacagttttatctagttaataatatttaattaatttaaactatctcaactcatattgcaatcacatttcgttaaaaatatcattaaaaatctgtttcccggttgccatctgagtaccacgaacacggagatagtcaatctttgctcgcaaaatatcatattcccacaatgatgacaggtcatggtcattatagtaatgaattgttactttaatgggtgtgagatcagtaattattcctgtaaaatcatcacttcccttatacttttcagtgccaatcacaactggaagacggttctcataggaatcattgataagatttgataataggttcccctgggtaatttctggatggttatcaataaaattttgtacttgccaaatatcaaaatagttgtgatcatgggcaactttagttttttcagaaaccgtcattaagtagtcactatggcgttctgtataaagaatactcttaatccgaatagcaattaagccgttgattttaccatcccagtcaatactgatcatcaaacaaaatactggatcgagagcaacgacaaatccgacattaaaataatcatcatttggcaagttatgaacctcaatcaatgttccttgctgcttggccattgttaattgaacgcgattctcactttcactttcttttctcatctttacttccttaatattaatttttcacatgattagatttttaaaatttaatcatatctctacttttattataatcgctaacaatgtagatgtgataacttttaccacgataagttaaatctggtaaccaccaaatattgtaaaattaggtgtgtcattccacaatattttgtagtaagatattttttgtgacaaaaaagtaaagaggggccattatggtgattattacagcagggatgattggtgtcggtaaaacaactttaactgggaagattgccgaacacttacatacaaaagcattttttgaaccagtcggagaaaatccagttttaccactgtattataaaaatccaaaacagtacggctttttactccaaatttattttttaaacaagcgtttctcaatgattaaacaagcacttactgatgataacaacgtgcttgaccgttccatttacgaagatgccttgtttacgcgagaaaataacgccgagggtaacatcactgatactgaattagaagtatacttaaagcttctcgacaatatgatgagtgacctccaacagttacctaagcgcgcaccagacttaatggtttattctgaaactgattttgaaacaatcttataccggattaaaaagcgcgggcgagattacgagcaaattgatactaatccagagttaaaggattactattacaagatgtggagtgcctacaagcaatggtacaaggattacgatgctagtccaaaaatgaaaattgatttagagcgttatgaccttgaagatcctaagaacgttgatgcggtcttagcaatgattgatgaacggttgaagtcattacgctaaataattgataagagcatgattagaggtttgccttttaatcatgctctttccttttcttcaacaaacgacgaaacatttcaatcattcctgccgtccctaccccaccgagcaaaggaacatattgagggatattaacatcgttctttctcgcttgaacgggatgtttggcaacaattggcatcgcctcactctcctctttcctgtcagtcattggaacaggattagcccgttcattgctggtgttaacttgattatcatatttagtaagttggtaagtatcaatcagctggtttagcttccgatcatactcgggatctgttgcatatcgtccgcgaagtgcccgtgtagcttcacgataatttttggtattttgacggtgaactccttgataaagtgggtcttctaatgtttgcgcataatcccttaacgcttcgtattcacttgcatactgtcgaaaattactaataacctgaaacttatggccttgcttatcatattcagtcgtgggttgagcaactgtttgccgggcaaaataccccttaaccccaaaaagattattattaggcgccttccccaacgtactgcatccccaatcactctctaaggccgcttgcgcaataataattgatggatataaatcatgctcccgaccaatttgttgagcagctgaggctattcgattaataaattgtgcttggactgcggatggttgttgaggttgataaacctgctcatcttttttatcttcttctagcagctgcctttgttcagcagagttttcagttgaagattgaatagtttcatgctctggcgcttcctctgtacctgtcaaagcattattttgctcacttgcctttgcttgagcagcattttcatattctgttaaataagcatcaatatattcttcatcatgattaactaaggcctcttcgtcaatcggctttgcacgttttacatcttcatttgcatcaaattgtgcttgttggataacgtccgctttaaccggttgcccgctaaggcttgttaaaacaattaatgcactagtaataacacggcggtttaacacaataaaacactccttcataatgtcctatagtatatatacgcgaaaattatgaatttgcatttttaaaactaaaaaagactagaagaaaattccactagtctttatgttttacatttcaggatatgtcgtttccttgatatccaatttttgattctttaagtttgtcttaacaacggtaacgtcacatggtgcttcacgaatagtataagcagcagttgaaccgacaagtagccgtccgacaacatttaatccggttgcgccaataatgattaaatcaatatcattttctttaggataacgttccgcaagttcaaccttagcgttaccaacctttacatcagttttaacatcttttattccagcggcttctgcttttttcttgtagtcagctaacttcttttgcatcgtttcgattgctgaatcataaatactatgactaacaaagccgtatccaccaggaccagtacttggataacgttcaccgttgataatacttagtaaatacaacttggcatcattggtcttagcagtgtcaaccgctttttcaaaagccatatcagcttgcttggaaccatcgacaccaacaagaatattttgataactcattcttgacacctccatcttctgcctttattttagcacaaaattaatcagtaacgagattattaattgcttccatgtaaattgccatcgatgtaattaaatcattcacaggttgatattcattagcctgatgcattgtatttggcgtatgtggcattaaagcaccaaatgcaaccccccgcttcatcaaacgaccataagttcctccaccaacaacttctggttttgcgtctgtatctccagtttgatcaatataagcttgcattaatgtcttaacaattggatcatctggatcaacataatgtggagcttgagatgggccttgcgtaactttaatttgtaatttatcggcaatcgcctttacagtatcctctaacttatctggtgtcatgcctttagggaagcggaagttcatatcaatgtgaccacccttgtccgcatcgaagtttaagattccagcattcatagttaattcgcccattactggatcagtgtaagcaccattaaaaccatccattcgcgtatctaaatgaagatagtcagctaagaattcaatgaaattctttgcgcccccaccaaagtcatatcgatttaagaactttgcaaggtatgttgctgcattgattcccttttctggttccattccatgggcagcttttccgatgacagtaatcttaagacctttatctgttgattcaatattaccttcaaccggattttcttcaataaagtgaccaaaatcattcgtaacttcttgaggattatctgtccgaataagggcaactgcttcccgcggtaccatgttgaaacgcaaaccagattcaaaactaactagttgtgttgaagcatccccattgccagcagggacatcaagtaagagtgatacttgacctttttcaccattaattactggaaattccgcatctggtgaaaaaccaagtgtgggggctggttcgacttcaaagtaacggtgcattccagtccagttactttcttcatcagttccaacgataaaacgaactttcttgttaaactttacgccttgatctttcaaatacttcaaggcatagtaagcagccattccaggtcccttatcatcagaagcaccacgaccatataagttgccatccttgataactgggtcaaatggatccgtatcccaacccttaccagcaggcattacatcaagatgggctaaaatggcaagtgtctcatcaccttcaccccattcagcatatccaacaaggttatcgatgttctttactttaaaaccgtcttgttctgccatctctaaaaatgcttttagcgcttgagcaggacgaggaccaagcgggtattcatctgttgccgctgaatcatcacggacactggggatcttcattaatgctacgagatcatttaaataattttctttttgcgcctctgcggctttcatccaatcagtcaagattaatccctccaaaatattctactttgactaattttaatgataccattaaattgtctattaaataaaataataaggagtcttaactgtgaaaaaacttactgaccaaatcttaaaggatgttattactccccgtcctgaaaacagttttaaaggtacttttgggaaagttacccttatcggcggcaatcgtaattttggtggcgcaattatcatggcatcaaccgcagccgtctgtgctggagctgggcttgtaacaactgcaactgatgaaatcaacgctagtgccctccatgcgcagttgccagaagcgatgttcgctgattttactgatgatgccctagttgctgaccttactaaagctgctaccagtgtggtcgttgggccaggcctcggaaatgatgaaacaagtttacgaattttgaagaatgtttttgctcatacaaccgagaaacaaaatgtgatcattgatgggtcggcaattaccctgatggcgatggaaaagcttgaacagccacaaggaaatatcatttacactccacatgaaatggaatggcaacgactctctggaattaaaattggcgatcaaactgaagataagaacaaggaagcccaagaaaaacttagtgctaccgttgtcttaaagaagcaccacacagaaatttatactgatgaccaagtatatcaattgccaatcggtacccccgcccaagcagttggtggaatgggtgatactcttgctggaatggttggaggtttcactgctgaatttaacgagaaggcagataaagccgtcctcgctgccgtttatgcgcacagtgcgattgcggaaaagatcgccgaaagccaatacatcgtccttccccaccaaattagccgtgctctcccagccttcatgaaaaagatagatgggatgaatgaagatcaccatattggatttttgaattaagaatttaaggatattaaaaaggttcagagcaaattctcactctgaacctttttgtatgcattgttatttaatgtgtaaaattgttcgtaatcttgctactcgtggtcccaagagctggtcggctaatcgtgactttaagcagagatagagataaattcctgctccgactattacccccggaatcaaggagaagaaagcagtgtaacgcccatacggactaataaaatgaccaatgattaacattacaatctttgtcccagcaaacatcactaaggagtaagccaaaatctggttagttggcagggccatcttatcaaaacgtaggtggaattccatattaaaggaatgcaagatcaaatagttaatcacaaacattgaaatcccggttgaaaccagtggtcctaatccttcaaagatccaaatacatgggaactggaggataaatttaattacaattccgatggctaaaaacatcatcatcttcttattctcagaaattccctgcatcattgctgcggctacagtatacaagcccaacatgatcgaaatgtatgccgcaaattgcagtactacgacccctgccgcatcataacggtaaaagacggtgtagatttgctgagcaaccgcggataatccaagagcagccgggatcatcacaaaatagaataacaagagaacattttgaatctgttttcgcatatcctcttgatcgttctgagcccgggctgtcgcaagcaacggaataactgttgcggctaatgcagaagctaatgaaataacaatcatgtaaagcttattggcattaaacgcgaataaggcataagtaacatccatctggtacttagtaaagtgaccaactaatggcatcatccgcttaaaagtatattgatcaattaattgaaaaatcgttacccctgattcaataatgatgaacgggattgattgataaataatcttaaaaattaatgtttgggttgaaacttcagtgtttacttcaccttgtgccactaagtcattcatttcgcgttggtgacgcatccaggcaatccctaagacgatcactgcaccaattgccccaataaaggctgcaaatgttgattgagaaacggcactaacccaattaccattttgaatcttcataattaaataagtggccgccaacatataaataacccggaaaagctgttcaacaaattgtgaaattgctgatggtgccatccaattatacccttgtaaaaagcctcgggtaattgacatccccggaataatcaaaatagcccaagccaatgagcggataaccggaatcatatttggatctccattatccattaaacgagctccaaacatcatcactgtcgtacaaattacacccattgccattgcaacgtacattccagaatgatacagtcggcgactaacgccatactggtttattccgttataatgcgcgaccattttagaaattgcagaaggaattcccgccgttgcaatcactaaaaacatattataaatattgtacccctgagcatataaggcattcgcttcgttactataagctcctaaccatgtaacccacggaataatgtacagcgcccctaagattcgcgaagtaatactaccagctgtcatccaagctgatcctgtaatcatttttgtttgcgaatcttttttgactgcggtgctgctcaaatcatttactttattttcttccatgatttgttgcaatcctaccttttttattttaatcgagttttcattttatcgtgaataaaaagttggtgcaattcgatttaccgtttttaatatttctttaatctagtattgttccaaatcaacagttaccattttaatgatttgatctggatgttgttgctttaacgcctctaatgaacttacagctggggcatcttcaaagtggccaagtttatcattaagggtaatcgctaagcccaatttagcaaaattcatcgcctcatccattgttttcccctgggtaaatgcttccggcaaatctggaaaatcaacttgaatttcattatctttcggggtaaaaattgctggataactcactatttccataacttatctgctcctcaaataaaaagaagcaggaaaacataaattccctgccctttcttaatttactattttgcaacaatgttaacgatcttgttagggacaacaatgactttcttaatatccttgccgtcagtaaacttcttaacatgttcgtttgctaaagcaagttgttgtgcttcatcgcggtcagtatccttggccatcttaatcttagcccgtaccttaccgttaacctggacgatcatttcaacttcatcttcaactaaagcttttggatcgtaagttggccatgattggtaagtgattgtatcactctcaccgaattgactccagagttcttcagccatgtgaggcatgattggtgcaatcatctttacaaagcctttcatgtattcaactggtaaatcatcaaccttgtaggcttcgtttacaaagaccatcaattgagaaatagccgtgttgaagtgcatccgttcgtagtcttcggtaaccttcttaacagtttgattgtaaaccttggtaagcttaccatcattgaaagtggatacccggtcacggaggtggttattatcatccatcaacaaccgccatacacgttgaacccacttattagcaccatgaagtcctttttcatcccaaggtaccgattcttcaagtggtcccatgaacatttcgtaaagacgtaaagtatcagccccatattggtcaacaatgtcatcagggttaacaacattacctttggacttcgacatcttttcatggtttgaaccaagaatcatcccctggttaacaagcttcatgaatggttctttagttggtacgagaccgaggtcataaagaaccttatgccagaatcgagcatagagcaagtgaagaacagcgtgttcagctccaccaacatagagatcaactggtgaccagtaatcaagagcttcttttgaggcaaattccttgtcattatgaggatcagtgtaccggagccagtaccatgatgaaccggcccattgtggcatggtgttagtctcacgaagaccatgacgaccattttcgtcataaacgttaacccaatcttcaacatttgctaatggactttcaccagttcctgatggttcgatgttatcagtctttggtaattcaagtggaagttcatcttctggaactaatgaggttgtcccatcatcccagtggataactggaattggttcaccccagtaacgttgccgactgaagatccaatcacgaagacggtagttaactttcttatgaccagcatcgtgttcttcaagccaatcgatcatcttttgctttgcatcagcaatgttcaagccatcaaggaaaccagaattaatgtgcttaccgtcaccatcaaaagcaccttctgacacatctgttccttcaataacaggcttgattggcaagtcaaacttagtagcaaagtcataatcacgttgatctccggaaggaacagccattactgctccagttccatatgaagcaagcacgtaatcactaatccaaattggtagtttttcaccgttaactggattaataacgtaagaaccagtaaatacaccagtcttgtccttgtttaagtcagtccgctcaagatcagaccgccgtgacgcttcttccttgtacttttcaacttccgccttgtgttctggtgttgtcaattggtcaactaattcttgctcgggagcaagaacaacataagaagcaccaaagagcgtatctgcccgcgtcgtaaatacttcaatcttagtatcttcatcccccacaactgggaaaaatactgaagcaccttctgaacgaccgatccagttacgttgcatttctttaacgctttctggccagtcaacaaggtcaaggtcatcaatcaaacggtccgcataagcagtaatctttaaaacccattgacgcattggcttacggtaaacggggtagccaccacgtttagtcttgccatcttcaacctcttcgttggcaacaactgttccacccataaaatcaggggcccagttaaccataatttcactttcgtaagcaagccccttcttgtagagctgttcaaaaatccattgagtccacttgtagaacttaggatcagttgtatttacttcacgatcccagtcatatgagaatccaagtgattggatttggtcacggaaatgatcaatatttttgttcgtaaagttcttagggttatggccagtctttaatgcatattgttcagctggtaaaccgaatgcatcccaccccattggatgtaagacattaaatccttgcattcgcttcatccgtgacattacatccgtagcggtatagccttctgggtgaccaacgtggagtccttgaccagatggatatgggaacatgtctagtgcatagtacttcttttgatccttattaaggtctgctttaaaagttccattctttttccaaaacttttgccactttttttcaatcgtcttatgatcgtaagccatattttctactccttattctgattttgatgatcgtaataaaaaagtcccgtagaaatcaatctacgagacgaaataactccgcggtaccacccgttttccatggaagccatggcgcttaggaccttaacgcggtaaacgtcattacctactaagattcagtaataatcacatttagatgagttcgtaaatgaccagtctcctgttcacaccaccacaggatctctgctgccctcgtcaaaaactactatttctattacgatcaaatatttaacgcctattttaacaaccaccgttaatgattgcaagcgtgtaactaaattattagcctaaaatttcttttaattcatcaactttatcaaggtgttcccatggtaagtccacatcagttcgaccaaagtgaccataagcagcagtttgcttgtaaattggccgcttcaagtcgagcatttcaataattccagctggacgtaaatcaaatacttttcgaacagcggcaattaattcttcttctgaacgggtaccggtaccataagtattaatcatgatcgatactggttctgctacaccaatggcataagcaacttgaatttcggccttcttagcatagcccgctgcaacaatgtttttagcaatatagcgcgcagcataactagcagaacggtcaaccttagtagcatcctttccagaaaaggctccaccaccgtgatgggcagccccaccataagtatcaacaataatcttccgtcctgttaagccggcatccccttgcggtccaccgattacaaagcgacctgttggattaatgaagtacttagtttgatcatcaaggtacttagctggaatgaccgcttcaatgacttgttctttaatatctttcttgatttgatcaagcgaaacctctggatcatgctgggtacttaaaacaacggtgtcaacacgtaacggcttgtcattctcatcgtattctacagttacttcggcctttgcatccggacgaaggtaagagataacgccatccttacgtagttgagcaatcttacgcattaacttatggcttaaaaccaatgttaatggcatatattcaggtgtttcgtcagtagcgtaaccaaacatcaatccttggtcaccggcaccaatcttatcaagcggatcagcttcaccttcacgcgtttctaaggagtcatcaaccccttgcgcaatgtccggtgattgttcatcgattgcagtgataacagcacaattatcagcatcgaaaccgtacttaccatctgtataaccaatcttacgaattgtgtcccgcacaatctgttggatattaacgtaggccttagtagaaacttcaccaaagactaatactagtccagtagtaactgaggtttcaactgcaacccgtgaatcaggatccttcttaagcaattcatctaagatcgcgtcactgatttggtcagcaatcttatctggatgtccttctgatactgattcggatgtaaataaatgtcgttctgccattttctaattcccccatattctattgaaactttcaaatagtttgtagttgcggttacaaggcatcttcacgttcagacgtgaatcctatcgggaattgctttataacgagaataatcttagcataattgtcaaccaacaatcaatgttaatccttacattcttactttaaacgggcattgaccatccccaccgctgtcatgaaagagtaaataattgtcggaccaacaaatttaaatccatccttccgcatttgtttggctatttcttccgaagcaggcgttttaggagctaattcaatatcggtagttaaccccaagtcttgaggctgatcatcaacaaagcgccacacataattatcaaacgtctttcccgttttccgtaattttaaaatcacttgtgcattattaattaccgctaatattttaagacgattacgaataatagtttcatcctcgcataatcgattaatatcttcatcggtaaatgatgccactttttcaatattaaagttatcgaatgcctgattaaatgcttcccgtcgccgccagattgtctgccaagttaaaccagcctgaaataattctaaagatagcattgcaaataactgctggtcatcatgaactggaaatccccagtagtgatcataatagtcttgcatttctggtgtcgcatttgcccattgtggtcgtttaagtgtcattatcaatacctcttttttgttttcaaaataaatagggagcagaaattttcttctccctatttatatacgaatttttggttattttgtacttttttccttattagtattagtattttttagcataaatgctagtacgagaccaatcaattcagtgacgatcatgccaataaatactaaatgatagccgtgaagggaagctacttgcgccgaacttccccgttgaagtgcatttgtagtagcaaccgttaagatcagtgttgaaatagtaacacccgcggacccgagaacttgccggactgttgtaattacagctgttccgtgaggtactaattcatcaggtaaggcatttgctcccagtgtgacggccggcatcattacaaaggcatttccaccttcaatcaccattgcgcaaaggatcattcccaataagctgagatgattaaggacgattaatccagcaacccaaccaatgataatcataaacattcccaccagcattgtcggtttaaacccaattttatcagccaattttcctgacaaaggattcaggatactaagaaaaacagctccaggcactagggccattccagaaacaaatggactaacttttaatactccctgataatagaggggaaaaataattgtcgttacaattaaggcaatatatgaaatcgacgttaaaagaattgctaaatcataattaaaagtcttcaatacccgtaattccaatagcgggtgcttgaggtgaagctgccgaatgcagaaccagataaccgcaataagactaacgataaaaatccctgcatttatttcccatgcaagattcttttttccggtttggtcaacaacgtacataatcccaattaatccaactagtaaaattactgatagccaatcaaggttcgtttcatggcgttccattacatcttggatcagtccgctagcagccattaaaataattatggaaataacaagcatgaagaggataaaaaggctcttccagctaaagaactttagaacaattcctgaaacaatcggtccacaggcaagggcggatcccattaccaaaccagcaatccccatcgttgagccccgctcttctttaggcgtaatctcaagcaaaacagtttggtatgatgggaataaaactccaacggcaaaagcttccatggcccgtccaatcatcataaaccagaaaccattaattccccaagacgcgggggttaaaacaatcatcaaggatccaatatcaaatagtcccagtgccccaatgaacattgtcttaaaactcatattattgagcatccacgggctaattggcatgctgacacacattacgagcataaaaccagtcgtcagccattgaacggttgatgctgaaatcccaaaagcgttcattaaagttggataggcagttgacaacgatgattgactaatcgacatcgtaaaggtaccaactagtaaagtaaaaataaaccaaaagcgactataactttttccattgcgtgcgatactttgatccatatcattctctccttctttagaatagttattatctgaccgttaattattatatgttttgaattagtgaatgtaaatgttataatgtcaatagattataattattttaagaaaggggacgacattatggcagaagcagaatttgatcgagctcttgaccatctccgtgaaaacaaggttcgtcttactccccagcggaaaactatcttaaattacttaatcaatcatcatactcatccaagtgtcgaaatgatttatgatgaccttaaagacacagttgacaatatcagtatggcaactgtttacaatactctaaaactctttgttgattataatctcgtaattgagctaaaaaatggagacggcagtacccactttgattatttcggccacccgcattatcatgtcgtctgcgataattgtggtaagatttctgatgtttttgatgaacattttactgcaatcacgaaagaattaacggttatgactcatgaaaagactggctatctagttacaggaaataacatcgaagtccatggcatttgtcccgagtgtcaacgtaaattacatttgaatcgttagtaaaaaattccccgaaaactcggggaattttttatgctttcttttgtgttaatgaagcaacggcaagaattgcaaaccaagccaatgtcagtataagcgcaattaaagtttgtttctccatacataaaacaattagcacaataaaaagaaaaactaaaataacatagtcagtaaaaggtgcgcctggcatcttaaaagtccttgattgcggatgctgacgaatatattttaaatgtgccaagatgatagcagcccatacaaagagaaaactcgtggtagcaatactggaaacaaaagtaaaaactccttctggcattactaagtttaagatagcggcaattccaataacgactgcagaaataataaccgctgttgcaggcaccgaccgcttagataagcgactaatcttacggataacaggccgatgagcagtagaggttaactcagctagcatccgaccagttgtatatagagaactattacaagcagaagccgcagcagtaattactacaaaattaacgatactagcagcccccggaagaccgatgtcgcgaaaaacaaggacaaacggactattgcttggtgaaagtttactccacggataaatgcacataatgacagccaaagcaccgatataaaagagcataattcgaataggaataccattaattgccttaggaataacaactttaggattctctgcctcagccgctgtcacccctaccatttcaattccaacaaaggcaaatacaaccatttgaaaagaaagcatgaagccctttgtcccggtagcaaaaaagcccccatcattaactaaattagcaggagtagcgagatagccgcttaccgaatgaaaatgaagtaaaactaaaatgacaccaacggcaattaaaataacaattgccaaaattttaataagggcaaaccaaaattcgagttcaccaaacgtactaacagtcattagatttaatcccaataaaattaggagagttattaatccaggtaaccattggggaacttgaggaaaccatagttgaaaatataagccaatggcggtaacttcggccattgccaatgctagccaacacacccaataagcccagcccattacaaaactcacgcgattaccaagataatcacgaatcgcatccataaacgaatgataatgtaagtcggaaagaagcaactctcccagggcccgcataattccaaaacaaataatcccagtaattaaatatgctaaaaggattgctggaccagcagcgtgaattgccttccccgatccaagaaataatcctgtcccaatcgttccgccaagcgccattaattgaatatgacggcttttaagcttacgtgtaaattcttgtttttctgccatgatcctctctctttctcaataattgaagttttattaatcctagttaggtttactagtcattactaaaaaaatcaactatgatatataacattgaaaacctattgtataccatttttcgtagaaggagaaattacattgtacgcattagttcactggatcccattttttatttatttttttgcaggatctgtcctcgttacccataatcacctttgggaaaaatttcctaacttcagccagcatattacaattgcaaccttttttatctatttaactgctatcgactggctttgtctaaccccttcaatgtttaattttagttctgctaacaaacttttattttattttcacggcgtaccatttaatatcatccccctccaaggactcagccaagaatttttcttaaatattgtgatgaccttaccactaggagtttatctttatttaattaatcaccaaatgcccttcagtcgtgctattctttacggctttttcttcagcttatttatcgagtgtaaccaatttgtttgcgaccttcttttccatattggaagggttgccgatgtggatgatttgattagcaataccatcggaactacaattggttttgcagtaatgattatacttgatcaaacgatttttcatcaagttattaaacaatttatgctagtaggtggaaaatctgataaactgaataactgaggtggtaaaagatgattacaaatgaacaaagagcgcatgatattgctcttaccttactacaatcccgagcaaaagatctaaagccaatcgaagcatatcatgaatatgtcaattcattattaccaatcttaaaggagattgataaggattttcccaacggtattaaagagcacctttaatttcccgggaaattacgacaaaaggagctgtgacataagttaggtcacttccacaaaatacgaacagcgcagtataacaatggccttcagcgttcgaccttgccggacgctgaaggcctattgttgcttgcgggggctcccagaggctagcttcgcatcaaaaaacaaagtcacaagtaacttctgtctcgctccctttcctacgattagtcaagaaaaatatttagaaaagaagagtatactaaaccaactcggttcttcttcaaaaatcgagaattagtggtatattaaaattgtgaggtgattatgccttcacagggaccattgagtccgtataccgatagtggtatttttcatggtgcttaatcatggataagagacatttcagagttttattcatacaagctaccatggcgaccttgttcagttttggatgaggtcgtttttcttttaaacgatagtaatagtcaacgatatgattagaattagcgtgttgttggcggatcatattacctacagtaaaatataagagcttacgggcaatcgggtttccacgcttattaatgtgatcttgacctaaataggttccagattggtaacgacgaatatcaattccgacaaaggcattaagctgattggcattgtcaaagcgactaatgtcgcccaattctcccattaactgagccgcagtttgtttcccaattcccggaaaagagcagtataggatatactctggtaagcgctgggcaatagattccatccgcttgataacctcttcccttttacgggttaaggcaattaattggcgagcatagtagcgaacttcatcaacctgaatggcatcaccagaaacagccggatatgatttttgggcgagatcgattaatcgatcggcatacttataagctttcatcttagatattcgtttatctgtagatgccattagaatattctttaatttaactctcgaataaggcctaactagtgctgaatgaggaaaaagctccacgatattcaacgctaatttagatgttctatttacaaataattgcttaagttctggaaaaacttgttcaagtgcagtatgaagatgatttagacgatagttccaatcagcattgagctgattatagaaccgactaagctcatgtagctgaagatagtcttttttccaaggaactattaatcgaaaagtattttcctggacagtgagagcaatccggtgagcgtctttctgatcggtcttaactcgtcgtagactctcggactttaaatgaagttctagcggattaagacggcaaaagcggagaccattggtctcacagaaatgttcaattactcgcgaataaattccagtcgcttcaaagtagataattgacttctgagctttcttaatcatatctcgtagagcattaaaccccgctttcgtgtgtactaaagaaaactcctttaaacagtgtttccctcgataccagacacagtagcttttccccattgaaacatccaaggcaaatatatcagccataaaaaaacttcctttctataaatagagctagatataaccgctatcctagatttgtacttcatttcctaaatactcgaactcgtagttccacaacctaaaagcaaaatatcaaatcaaagatagcggagatcattttataatacggactcgaagtccctgggagcatgatcgatcttagctctatcttcagaataacaaaaaagtccaggacaataattatttttatcctgaactaatcttaggttgtttactatttcatcctatatgtattatactaccttgttgagatttcctttcttcttgttttattaacccatttgaactatgatattaataattttatttttagggaggtttttcaatgtttgaagaaactaaaaagggctttgactggtttagcctaattgttggggtcttatttatcattgccggaattgcatcattcacgcggccagataaaacccttcacttcttagccattgttgccggaattacttttattttccgcggaatttatgaattatggttccgtcaacgaatcggtcgaatcttaggagaatcctcaggttggttaattttttctgcaattttagatatcattttaggaattatttttcttttccaaccaagctttggggtactcttcattgctatcatcttcgctatctggtttatccttgattctatcactgagttgatcagtgcgaagtttttcaaggaatttcatcgtggatactactggttcattgtaattctagcaattttgagtttggtattaggagttattcttttatttagcccattactttccgctattacagtggtatggttagtttcaacattcttgattgtgttcggaatcatgaaacttattcaagcattttaacgtataccttatattaaaagagatcagttttgctgacctcttttaattttacgaatattttgaattataagccttgttccgtcatcaaatattaggtggtgagcatggtgatcaattcgttttaattgccccgtgtattcttcataaaaaccagtcttaccattaaagaattcaacttttattaacggatgtgatcggccccgttcaatcatggcaagttggactctaattcgatgcctcatctcagctgtgggataagtcttatgaccatacttttcccctacctttgctaataattgatggtagccggtcaaggccgcaaaaggagaaaactgagcagcgcgatcttcggtggtcattggcgtatgagcttgagaaacatgccgaggggtgttgataatatcacgatactttgaggtatcactaaacaagcttttttctattttcagcaaatcttcattttccattatgcttggtgccctccaatctgattatttctttccaaaagagtagcaccttttttcaaatccgccgctcgaataatggcgtttttaccgtactcattttgcaaatcaaggacaagtctttgtagtttttgatccttttcttgaactttggaacgattcttatgttttttcgttgaatccgtaaataaatctaactgctcattataattcgccaatctggcaagccgtggtgagagaaggtggttcgctattaccgtaattttacgagctgtcaatcgccggtcaaggccagaatcacataacttcataaatgcctccatcaattctgtaccagatgaagtcggtaaggaaagattagcttttccatgcattggctttggcgcctggcgtccatagaagtctgtcactaatggtccttggtaatcctccgatatattagaaacatcataggcgacccttaaagctacttgatcagttactaagttttgcttggttaactggagagctaatgaattaaccatctcttgaatcactaaccgggtttctgtaaagttataaggtcgaggcaacacctgcccagaatacaccccatgatctgatgaatgataatttttgatatctttaatggtggctgactcatatccccacgcatggtcaataatgatttccgcattttttccaaattcgcggtataatacttcttcattcattggatcagataactttcccaaagaacaacgagcaatatctcccattgtatgaagacctagcttttttagtcgtcgcgcatatccaggaccaattcgccaaaagtctgttagtggctggtgcgcccaaaggtaacgacgaaaagtatgttcattcatctgtgcaatccggaccccgtcttcatcccctggaatccgtttagctactatatccatcgctactttcgctaagaaaagattggtcccaattcctgcagttgcagtaatttgtgtctctgctttaattgtttggatgatttccttagctaaagaacgggcgctaacatggtacttattaagataatcagtaatatccatcattacctcatcaatagaataaacgtggatcttttctggtggtaaatagcgtaaataaatttcatagatggcggcacttttttcaagataaaaattcattcgtgggtgcgcaatactataaccaattttaagttccggtgattttaatagttcatcccggtaaattgaaacaactggtgataatcgctggtgagacatttctttggcacgacgattattcaagtacgctacccgttgttccacctcatacaatcgcgggcgaccagaaacgccaaacttttttaaagctggtgagacggcgagacaaatagtcttactagttcgcgattcatcggcaactacgaggttagtgtttaagggatcgagcccacactcagtacattcgaccgaggcatagaatgattttaaatcgattgccatatatgttcgccccatcatgagaatacctccagcacttcagtaaatactattatatcttcaatcaaacatatgttcaagaaacggatgaaaaataaagggttgcagaaagtaattttccacaactctttactcagtttaatttaattattcaatatcaatatgattttcatcgtcatcagtctcatccttcttaggaagagtaattgtcaaaacaccattcttgtattgagctttgatatccttcttatttacatctggtaaacgatattgccgactcatttggccataccgacgttcagaatgcagaacattgccatccttatcaccatcatcatcaaagatatcccgatgaccagtaactgtcaaaatatcattggcataattaatgtgaatatccttcttatcaaatccaggcatgtcaatctttacggtataatttttgtcatcttctgtaacatctgtcttcatgtgatcagcaaccggagttaggttagagaagaaatcatcgttcatccagttacgcatgttcatcaaactatcgaataaattattacggttttgtaattcattagccataaagaatgcttcctttctttcttattcattgtctatgttaaacgctttcaactaaaatgcaactaatatgctagggaccattgactaaaaagaatataatagaagtaggaaaatagaaaggagccgcgcaagatgaaaaaagtcacaatcaatgatgtttcaatgcccgcaattggaatcggaacatggaatatgggaaattctctcgtcaatcggtccacagaaattaaagccattcaaactgcaattgacgttggcgcacaagctattgatactgcggaaatgtatggcgatggtcgttctgaagcacttgtcgctgaggccatcaaaccatatagtcgggaaaagctattcttaattgataaagttcttccttcaaatgccagcaagacaaaacttgagcatagtttagaccaaagtttagctgccgtaggaacagactattttgacctttaccttttacactggcggggtgggattccgttagcagaaacagtcaacgaattagagagagttaaaaaggcaggaaagattaaagcatggggagtctcaaacttcgacgtcagtgatcttgaagaattatggcgccttaaaaatggcactgattgcgttgccaacgaagatctctataatctcgatagtcgcggaattgaatttgacctccttcccttaatgaaacagcatcagcttccattaatagcctactctccccttgcacagggtgacagtctatctggaaagttaaccgagaatccgctactaaaagaaattgccgcaaaccaccatatgaccgttagtcagatcatgcttgcatgggtcttaagaattggaaatatccttgctattccaaagagcagcagcccaaaacatgctgaagaaaatgttgcagctggtaacattgaactaagtgatgatgagttacttgctttacaaaaagagttcccatcaccaaataaaaaagtacccctcgcagtaatttaagagttacaatgtgacataataaagctaaaaatcgaactacaattttgcatttcacaaagttgcagttcgatttttcatatatgaggaaaactaataattaattttcttgattagcctttaccgggtgatagcgatgaagacgttgagatcctacatcgatttctgctggattacctttgtggcccggcttaatctcaacaaggcctaacttaatagcccccacaggacaaacaagtgcacacagttgacaaccgacacacttactcttatcaaaaactggttgccgtttttcatcatcccaagttaatgcttggtgagcaccatcttgacatgagataaagcaacgtccacaaccgatacacttatcccaatcaatcttagggtaaaccttgtaatttcggtcaagctgattagtaggaataatattcttattagctaagccgacaagatcttgaaggtggtctacatgctgttcttccatgtaatgcattaaaccattagtaaggtcatcaatgatccgataaccatattccatgatcgcagttgtaacttggagagtagtggcacccaaaagaataaattcagcagcatcttcccaggtttcaattcccccaattccagaaatcggtagttgttcaaggccggctgctgaccgtaattgttgtaagaaacgtaaagcaattggcttaacagctttcccagataatccagaaacagaagatttaccatcaatatttggtaaaccaactttcttcttcagatcaacatcaacaattgatttaacagtattgattgcggagaagccatctgcccctccttctagacatgccttaacaatcggaaccatcgtcgtaatatttggtgtcatcttcgcaagaactggaaggctagtcccgcgtttaacggcttcacaattcttcttacataattctggattagttcccacatctgaacccatggtatgagaagtcatctgtggacaagagaagtttaattcaatcatatcagcccctgcctcagttactaacttagccaggttggtccaatcttccaatgtctcacccataattgaagcaatcaagactttattgggatattcctcttttaaccgtcgcatatcagccaagtcctgctccaaggggtgttctgataattgttccatattcttaaaggcaacaaaatgcatgtcttccttggctaattcgtcgaaccgaggagaaacttcatcaatcttaaagtgtgttggtgataaagtcttatatacgataccgccccaaccagcgtcatatgcattcttacacatttcgtaacagttcccaacaggtgaggacgacaagcaaaatggattttcaaaatgaacgcctaaaaagtctacagataaatcttttttaatcattttcttgtcctcctaacaaccggtctatttcttctgctacttcttttcctttctgtactgctaccacaacggttttatctccggcaacaatatcaccagtcgcaaaaactttgggatcttttgtccggaatcgtggttcacggaatggaatttcattatgctgtaagtcaatgtctagtccttctgcattcgctttttgaccaactgctaaaataatcttatcagcagtaatagttaattcactcttaatcttccggtgagtaaaggtagcacgattctgatgaacttcttttggaacgtaaccatcaacaattgttacaccagcttcttgagcaccggcaagttcctttttagaagctttgaattcatcaaactgctcataaacaacatcggtaacataaggaacattaagcttctttaaggttgttacaacatccattgcaacatccccaccaccaataacaaggacattttgcggaagatcttctaaattacccttacttttttttgcccgggctaggaatgagattgctgattcagtacagatattgtgttcaaacattggaagcatctttgcttcacttgtcccaatagcaacaattactgcattgtaacgagctttaaggtcatccattgaaatatcttttccgacagttgtgttatagataatgtgcgcaccaaggtcgacaattcgttgaacttcataatccacaatttcttccggcaaccgatactcaggaatgccgtaggtcaagtaaccgccagccttagcagctttttcatagatatcaactgcatagcccttttcacgaagagtcgtggctgcctgtaaacctgatgggccactaccaatgatggcaatactcattccgtttggcttaccagctttaagaatcttcatattcatctttcgctccatatcagtgacataccgttgaatcccaccgatatcaattggtccgtcgattttagcccgggtacatgccttttcacagtaacgctcagttggacaaacacgcgcacagattgatcctaacgcattgttttcccgaatcgtttcagctgcccctttaacattacgaaaaagaacacttcgaataaattttgctggattagtatgtgctgggcaagcttgtgaacatggtgcatcatgacataataaacatcgtgcagcttcctgcattacggttgtcatcgtgtaacctttcgactctgtttcatactttgaagtcattagacaccctcctctaagttgtgactctttgacaattttgtgataaacgtaactttatatataaataatattatataaacgctttcgatataagtaggcgatccccttaatatattgcatcgtttattcttaaagttgatattttcgtatatataatatgaatatttttatttaacatctacaacagtttttgtatcaaaaatcacaaaaagagtcttattacttaatgaaaaatcaaattccttgtacaattattacagagacatggtttggttaaattgaaagaaggattaacatgaaatttatttcttggagtgtcaatggcttgaagtcagccattaatcatggatttgtcgaagattttaaacgccaagatgctgacttcttctgtctacaatgtacacgattggataaaggcgaagaaccgattcaaattcctgattattaccaatactggaattatgcagaaaagaagggttattctggtaccgccattttcactaaatataagccagaaaacgttatatacggaatgaataattcaatttttgataaagaagggcgactaatcacgctcgaatatccaaacttctatttgattgatgtatacgtcccagtttcaggtgaaaagctgcaacatcttgattatcgtctcgactgggatcgcgctttccttgattatgttactaatttgcaaagtagtaagccagtaatcattggcggtgatatgagcgttgcctatcaaccaattgacctagcagagccaacagaagatcatcatgaagccggctttacaaaacaagaacgagctgattttggtaaattacttaatgctggcttgacggatactttccgttatctccaccctaatttgcatggtgcatatacctggtggaattatcgttatgacgcacgggaacgaaatgtaggttggcgtctcaactacttcttagtttctgatgtatggaaagaacgaattgaagaagccaagattctttcagatgtcaaaggttcaagtcactgtccaattgaacttgttgctaatgttgaagtataagaaaaacgagctaaattttataatagttaaacgaaaagaggttagaaaaactaaaatttttctaacctcttttatcgtatgtttgaaatttgttgattatctattttattaaatcttgttttagtaccaaccgtgtgattgccagaatgattgagcagcactccatgaaccgtaacggttagctacatattgatcagctactcgttcttggttagcttctgagtagtcaccatttaagtatgatgctgacaattggtacttaccaatatattgaccattccgtgcactgtagctaccacctgattcgcgagctgcgatccaagccttagcagcagcatcatttccaactacatttgagttatagccagttgatgcttgagcactagattgttgtacattttgtgtttgtggagtttgtacttgttgttgagcaactggtgcttcttggtttgattgtacttgttggttttgttgtgcttgattttcagcaggtgtagcttgtggtgcaacatttgcggctggtaaagtagcaacttcttcttgagtagctggtgcaacttcaccatcatccttgatcactaattgttgaccaacgtaaatcaagttcttatcaacaatattattgttgtttgctaatgtatctacaaaagttagatcgtgacctaatttgtaagaaatcccagaaagggtgtcacctgcttgcaccgtgtaaatactgtcggcgtttgcagtcgttgcagtagctactgttcctaatgcaactgcaccagtaatcgctgctgtaatcttggctactttcttagataacttcattataaattcaatccgtccttttctcttaattaatcaaataactcatttcaacgataactactatacaggattagggttacgagcgggttactaggacttatcaaatttcgttatttctgtaattttttgtaacaaacgttcgctgatttttttatagtcgcttaaacgttgatttaatcgcttttaagtaacttgtaaaattataactagaattatctcatgtaaaaattattcaaaaaaactgctcattttttcttgacgacacaaaaatcgccctgtaacggactgtttgttacagggcgatgacaaaattgtcttaatcgtaatcttaattattcatcaaaacatcaagcaattcttgagctgattctttcaaagcatcctttgacttgtcattaccaaggtgagtaaagatttctccaacgtatacatcttggtcaaatagctttgtaaagaccttgtcaataatcggcttagttaattctggttcttgaactgggccaaatgggttagcaaagaatgtcttgctcattccaacttcatcagttgttccaagggccttccgttgtccagcaataaatactttttcggcctcttcctctgtatcaaaacgatgaataccaacttcatcactgtaattgttagcgtatagccacatatcaatatggtgatgtttgattacattttcgtaagtatcagcaggaataataacccgggcattcttctgttcaggattaaggtaaacaccacggtccatgttattgaaggccacggcactactcaaatcatcaagacgaacaaaggcaccagtttctgttccttgagcatatacccctggttcaccatcagtaagggtaaagcttcccatgtcatcaaagattgtctccatgctgacaatcttatcgtcagctaattcttgtaatgcttcaattgattctgactttccggcacctgaatcaccgaagaaaacaacattcttttctttaccattagtaaatttaatcttcaacatggacccgtgaattggcaggcgaccattgtaaatttgatgaaggttatggagcgtcaagcacatcttcttcatgtaaccaaagtaagtagtcttatctgtgtaaggtacttcaccaacccacaaatcattcttttcgtcacgatagtaatgagaaaccatgccttctgtttcttttagaccgaaaagaagaatcatatcaggtttttgccccttaatctcatcaggggatgcaatttcaaataagtttgaaagagcgattccgtttaccaagtaatcaacattgaagtaaataaaggctaaactttcaccaatctttgctgggtaacaataccacttaccacgttcaccacgaaaacgttcgattgggttatcttttacttcagaaaagaccccttcccgtttgttactcttagtatgcatcatcattggtggacgaagcatcacggtattaataaaatcaatatcctttaattcttcataaccagctggaattttccaatcttgttgttgaactaaaattgttgcgttagttgccgcattaacttgtcgataagtccggttttcaaaaccttggagcttttcttcgaggatccggtatgctttacgcactaagtcgttgaattgggtatcaatagtccggaactcgttaccgataatcttattatcactaagattaattaccgatacccgtaatagtgaacgatagtatgagtataattcttcaacactctcaagaatatctttagggtcatattcatcaaatgcactatcatcctcaaaaagaactttctttaagatatcaacaaacttgttaacagtggcattatcaaaagcatcatcatcattatcagggttacgtgaagctaaatataaacggacaatttcctttacttcatcactattaattaatgaagtaatatcagtaaagtaattttgactatagtttaacgttgcaacaccgcggtcaggatttacatataatgattttgtatcaataatcttactctcttttgacatggatctcatcctttcatcacttgaataactctattataatatattttttaagattaggatgaaaataatattaactttttttcattttacaaaaaataggaaaccatccccttattgagacaatttcctactttaacaattaattattaaattttagtaccaaccgtgtgattgccagaatgattgagcagcactccatgaaccgtaacggttagctacgtattgatcagctactcgttcttggttagcttctgagtagtcaccatttaagtatgatgctgataattggtacttaccaacgtattgaccgttacgagcactgtagctaccaccagattcacgagctgcgatccaagccttagcagccgcatcattaccactaacatttgagctgtagtttgaactagtagcttgtgcttgtactggtgcactgtagctttgttgtgcagcagctgaaacagttgattgttgtggagatactgattgtactggagcctgtgattgagcaggagcagaaaccggtgcagctgatgattgtacttggcttgttgctacaggagcctgactagcaaccaccggagcttggctaggttgttgactttcaacactagctgatgctggagcttgagatgcttcaggtaaagtagcagcttgttgagcagttgcttgggttacttcaccgtcatctttaattactaacttttgaccaacataaattaagttcttattggcaatttgattagttgaagctaaagagtcaacataagttaagtcatggcctaacttataggaaatacttgataaggtatcaccactttgcaccgtgtaaacagaatcagcattagcagtagttgcagtagcgaatgttcccaaggcaacagcacctgcaacggcagcagtgattttcgcgatgtttttagttaacttcataaagaaaaatcccatccttttcataaaatacttttttattaattagttatttattagtttaatttagtttaagttgttgagtcctcatatctctcaacacctattactatactcccccaaaattacatgcggattactccgaaatatcaattcagttgattttcgtaatactttgtaataaaaattttaatagtctgtcaagcaaatcaacctcggccacgtcctgatagtaacttaggtttggctaacttttccccagaattagccaaaatttgtaacataataataaataagtcgctgaatttttcttataaagaagaatttcaacgacttatttttcgttattaatgtttaattgtaacattgctgtaattaactttagccctattcagcagtcattatttgttttagccaacgctcactactagctaattcttttaatggatggatatcttcgctaattgggagtggttcgccggcttttactttaaaaggtgctccagtgaccatttctgaatcccgatattgggtaagagtggcagaagtttccttaccaaaaccatcaaccattgcggttaactgctgcgttccgcttaaagcaattgtgggggtccactgagtattttgaccatccagaaaactataaagatcgacagtagctttagtttgaacttgactcgctacttcaaactgcagcgttgaaccatgggcttggtatgcatggattgtccgatagatatttttactagttgagcgatttgcctgccggtacgtaacgtgcgcgttagctccaactaaaatctccgttccttcatatgatggtaataacgtatcattaaccatccgttcttcaattaccgcattcacctccgcactgatgacaataatattatgggtgtttgcagagttaagatggggactaaagacaattggacgctcctgagtaatttgtggacgcaaatatataaactgtccacagtcaatatttgcaagatgcatggccgctaactggttatcctgccaaaagatggccttctccattaaattttcttgtaatagtgttgagtattcattaaccgcttgttcaagaggcatcgcagttaggctatcttcctgtaaagaaagccaacccctacttacaccagttgttctcttttgccagtgatctatccattcttcttgaccaggtaaagtcggaaaccgtgattgcagtataactgctagttgacgttttttctctaaccatgctggctctttcttccaaatttttgccatcattttctcctctaatgaacaagcttatcccaaataaccactttccccgtttgaagggattgcggaacatcaataattcgttggttagaactccctctaaactgaagggtaagatcctttttagccagcaagaatcgaccatcgactagaatatcgaggtagtgtagaagttcaagtttatcgctcgactccttcattaattcttcccaagtataaccagaccaagaccaaatatccttttcgtgaccgaattctttccgaacccgtttaactaacttcagacaaacctgagtattaaggaatggttcgccacccaataaagtcaatccttgaacataactctgcgaaaggtcttcgataatctggtcttctaaatcctgggtatatggctgtccataatgaaaattctgcgccgccttgttatagcattcggggcagttaaaaaggcatccactaacatataaactacaccggaccccttccccgtcaacaaaattgaagggcttatagtctgcaatatattgtaatgaatgatcttttgctaaccactcttgcaacttaggattgcggggtaatcgtgtttctgccatttctttttcctcctatataataaaaggccggtagctttacgggcaactggccttttgataattaattaaatttgatcaccaataatatgagcatgagccttattatccatttgccgctgttgttcaaattcagctgcattcttgatcattccagcattcatatgtttaactcggtgaataatttcctcatgccgtccatgaaccattggccgctgctgagggttaccaagataaccacatgtccgcttaacaacgtcacaggttgctgggtcatggttcccgcactgcggacacttaaagccgcgagcagttgcttcaaattcacctttgaagccacacttaaagcactgatcaattgaagtatttgttcccagataaccgacatgatcatatgcccagtcccaaactgcttctaaagcttttggattttggcgtaagttgggatattcgcaataatgaataaaaccaccagccgcatacttaggaaaagcctcttcaaatgatagcttttcaaatggtgtcggatgtttacgaacatcatagtggaaactatttgtgtagtattccttatccgttacatcttcaacccgaccaaacttcttcaaatcatcttggcagaatgtatctgttaacgattcagcaggggtggaataaagactaaagtgatatccttcttctttttcccattcagcgcataaatcatgcattgccttagtaattgcaattgcaaagtcatgtgcttctttattatgctcccaatttgacccatagaaagtcgtacatacttcatataaaccaatataacctagtgaaacggtcgcccgactattcttaaagacttcatcgacactatcagtcttctttagccgtttaccaaatgcaccatacatataaagaaggggagcattttctggcttggcttctttagtacgcttaatccggtaatccaaggcaatcttacaaatattcatcttctcttgaaaaatttcccagaataattgcttatcgccatgagcctccaaggcaatccgtggcaagttgactgtcactacccctaaattcatccgtcccgagtttacttctttaccagtttctggatctgtccatccctgtaagaacgaacggcaacccattggtgtcttaaagctccccgttagttccttaatcttgtcatacatcaaaagatctggatacatccgctttgttgaacattcaagcgctagttgcttaatatcataattaggatctttagggtcaagatttaagcctcgtttaatagtaaaagttaatttaggaaaaatagctgtacgatgttccttaccaagacccttaatccggatcttcaaaatggctttttggatctcccgggcaatccagcttgtccctaagccaaagttaatggtcgtaaatggagtttgaccttggctagaataaagggtattaatctcatattctaaagcctgcattgcatcgtaaatatccttttttgtctttttacgagcaaattcttctcgtttctctggtactatccactcttcggcatccttcatatgcttttcgtaatttagctttgcatatggttctaataattgatcaatccgattagcagaacatcccccatattgcagagacgccacgttagcaataatctgcgacatctgcgcggttgctgtttgaatcgagcgtggtgaagaaacccaagcattaccaatcttaaatccatgcttaaacatctcatcaaagtcaattaaacaacagttagtttcaggtgttaccggtgaatagtcaaggtcatgccagtgaatatcaccacgaagatgcgccttagctacaataccaggaagcatccgtaaccccaatgcacggctcacgactccggcttcaaggtcccgttgagtattaaaaacatggctatctttattagcattttcgtgaacaatccgtgagtttcggtcgaaaagctgctctaacttattttggggattagtagcttcggcaaatgcttcttcatcatgttggcgataatcacggtaaacttttgccaattcttcatgattagcattaaccagtccttgaacaaagagatcggcaatctttttagtagtgacagttgtttgattaagcaaggcatctaataaggtaacataaacactttggctagtctgctcatcagcattgagcgcatttaaaataaggttaatcttataggaatagaatggtgttactgttccatcacgtttaactacttgaacacttgttaaactttgaagatccttcttatcaattatttgcactttcatttttatttcccctctcgtaattaacgttatctatcatagctcaaaatacaacttataggaagtattgacattcgaaacactatatgttgtggtcaaattatttatttaaatattctgtttatattctattctgatctaccaggaataaaatgaggatacaagcaacgacgctattttgagattattgtgagaccttttaaatcatttatttttaaattcctattatcactaaatagaattttttatcccgaaaagcttgaatttgaaaacgctaaacctaacttaataatcttaatcaatatacttaagattattagttattaaaaaataacttacgagcatatagcacgatttgctagactaatccttgtgtaatttttaggataaaaggagtttttatatttatggaaaatgctttacaagctcgtaagcaagtagcgcatccaggattgatgatggttagtatgctactaggagcttttgtcggaatgtttagtgaaacttcattaaacattgcattgccaaaattgatggctgcttttcaagtaagtacgtcaacaattcaatggttagtcactggatatatgttaattattgggattatcttgccactgtccagtattattactaaatggtttacgacccgccaagtcattatttttgcattaattgacttcatggttggggcttgtatttctgccttagcgcataattttactattttgttgattggacgaatgattcaagggatcggaacaggtttaattcttccattaatgtttgcagtggtaatgcaaatcttcccacctaaacaaattggagcagttctaggaatgtgtgccctcgtgattatgtttgcccctgcaatcggtcctactttaaccgggctaattcttgctaaattatcatggcaatggatcttctggttatttattccgtttttatttattgccttgatctttgctatcactccattagaaaatgttggtgaaattactaagccgcatgttgatgtgctctcaattattgaatcggcagtaggttgttcagggctcgttattggtgctagtttggctagtgaagatggttggacttcacctacagttctcagtgcgttaataatcggaattattgtcttaatcttttacacccatcgccaacttcatctggaagaaccaattttaaatcttcatatctttaagtatgcggctttcacaattggttcttcaatcgtgatgcttgactttggaattattctttctacgatgtatcttttaccgttattctatcaacgagggctcttagtttccgttgcccttactggactagtaatgctccctggtggaattattaatgcagccacttctgcagttgcaggtcgcctttacgatagtattggggctaaacgtcctgttttaattggttttgtccttgctttatttggcgctttgatgttggccttcactacatcacatagtgcacttctttatgtaatctgtgcccatatcattttaatgattggttgtcctctagcaatgtctcctgcacaaactagtgctctaagtacgctttctggattagaatctggtgacggcagtaccatcatgaatacaatgcaacaggttatcggtgcgcttgcaacagccttagctactggttgcttggcttggggtagttcttctattagtggatccgaagctattcgctttaccaatggtttccactacggcatttactttgcaattatcttaattgtggtggcactgctcttatcattcaaaattaaagatcagaaaaactaaataaatcctcactactcatgcaggtagtggggatttttttactctttaacaattttatacggcaagtaatggcggcgatggttagtcagataactatccattaactgttggtaaaattgtggattcacgcttgattgtatacttaaaagatcaaatttttcattatccttttcaacggtataaagacccgttttgccaaaaccatttttggcgtagaaacgatgccgtctgagtcgctgttcgttattgggtgcttgaggatctgggcgttcagcgctaagggtaatctgctttccagcataccgttctttgatcgcggttagcgtcgcactacccaagccctgtccatgatagtgaggatcaattgccagaaagaaaatataggcgatgcgcttgttgtagactgtgtagaaaaagccaacccattttccctcttcattataaatgctacaaaattctgcttttcctgctttagcacgcattttaagtaaagataatggtaaaagttcattttgtggaaatacggtattataaacccgcttgatatttttgaaatcatttgaatttgtagatatttgacgaactttaatcatttaaaaatccctccatctatgtaatagtacctagaaaaaacttaccagacaagaaaaaagagactagctttaattttaattaagcttcaatgaaatcttgctctttcgcatgtatgtttttacagcaaaacatacctcttaaaattaagtggtctatttttgaaaactggggtgataatttcattttgttctgccataaattaaaaatctccttactgatgatagtctgtaagcagtccgtatccacacgtctagccatcaaaaacttagtctcctatactaaaagcaatcttagtacaggaggctttttctatggaaggaaaacacgatattgtagcaccaatttttaagaccaagaattcagtagttaataaggaagaatttattcctcgacccgccgcaaaactacaagctgataacattgaattaacgatctttaagggagctaatcccagtcttgcgactgatatagctaaagtggttattcgttatgctcattaattggtaggcaccggagcatgtttaccttgtttgtggtaagacagatctccgtaaaggaattgacggtttagcgatggtagttgcggaaaactttggattggatttatataataattcgctctttttattttgtggtagtcgcaatgatcggttcaaagccctttattgggatgatgaaggtttcattctgctatataaaagatatgaaaatggtagtttaagatggcctaagaacaaaagtgaagttaaagaactaaaaccagagcaactaaatgccttatttacaggtctatccccatttcccgagcgacgtattcatacaatcaaaccaggaaatctatactaagctctttttaaactgttttagctctgatataataacaaaagtttattagattggaggtgacgtacaatggctgagtcattaaagaaagaaaacgaagcactacgtgcgcagttgaagaaagctcaagaacaacttgaacaacaagcaattacaattaagcaactgcaggaaataatttttggaaaaaaaactgaagttttagagcaggtagctgatggacaattatcactgtttgatccagttgatgatctgaacttggatcaagagattactgaagtagttaaaacaacaacgactaagatcgtacgtcatcgaccagcgaagaaacagctaactcgtcaagagtttttagaccaacttcctcaagtcgaggaagttgtttctttaaaaacgaccacctgtccagattgtcagcacaaaatggctcacattggaaagaggttagcacgacgggaagctagactaaaagagcctgaattgtattgtgccaacttatatgaggaaagctataagtgtaaacactgtagtcaagatggaaatgataaattggtaactagtaaggcaccaatggctttattaccacatagttacttttcaagcagtattatggcatttatcgcctatttaaaatttaatctggcgttgcctttccatcggcaagaaagctttgtacaagggttgggattacctgttagcgccaagcaaatggcctcgaatattattaaagttagtcaaacgtacttagagccgttgtatcagtatttaagcaatacagttagacaagaaccagtcattcatatggatgaaacaccttttaaagtcgttgatagtcctaaatcccaagactatttctgggtaacgcggacaacgaaagagtttgcccaacatccgattgtagtctttcatcacgccaatacgcgttctggtagaatcattggacaaatagtcggtaataattatccgggtattatcatgtgcgatgggtataaagggtatagtaatcaactctatccgcaagcaaaatttggttcgtgcttagtgcatattcgacgagaatttgtcaaattggtcaaagcactgccaaaaacaatgaaggcgtccaaagcgcaacaagcaataactcttcttagtcaggttttccattcggaaaaccagttgagttatcaaacggccaatgagaagttagtgcagcggcaaatccatgtcaaaccgctaatggataaattttacaattacattagccagattagccagccgattggacagttgcgtaaggcaattcagaacgccatccagttaaaatcacgagtgtatcatgtatttgaaaaaaatggacaattaccgttaagcaacaattcagttgagcaaagtattcggccatcaacactaattcgaaagaattgtctattcgcaaaaaccgaagaaggtgccaaggcgaacgccgtctactatagcttagtagagacagctaaactaaaccagcttaacgtccagcggtacttagaatacttgtttgatcacctaccagagagcaattgtcaagatctggcagcttttttgccgtggtcaaaaaacgtacaagaagaatgttgcgaatagaaaatccccgtgaagccatcaaggacggttctacggggattttttgtctgtcaataacgtgtcaatatggactgcttaccgtgcaccggttatacaaatttgcaccattttgtaccatttctttaaaatcaaaatttaaacaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagtttcccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacaaaaaataggagaaagcctgctataacaagccttctcctatttcattagcttagctgacaattttgtaccaaagtactaatatgcctccggtgggcaaaactcttcctattatattaggctttaactggtctttgtgtgatttttgtgtgttcgtaaaaaaagccctagtgactatcgcaaattatgcaataaccactagggctaattaaatttttacctatttaaacgtaccgaacggctggttattatttgcatcacggcaaacaagataaccgtactgagcgtttggtcgtggctgacgaagccatacatagccatcgtggcgagaccaagcgtcatacttaacttcactattagctggtaaggtagcgattaaggcactgttagtcttagcaccccaccgcaagttaattgcagtgccagtaataaatgtcccgttttcagcaaaccaacgatcaccaagatcatcaacccaatggttagttggaagttcagtggtaattgctggcttttcttgttcaattggtttgtttggctctggggctggtgcttcgcttggattaaataggttgattgcattatcggttaatgtgatagagccatcaacattgtagccaagcaaattattggtatgttgccacatatcaatatagttagctgacgggaagtaattaaagtctgggttcttccctgctggcgttccattgcgatatacatatgcagctaaccagaacatatccatatggtgatggattgactctaagtcaaagttaggcaacagatacttatacgtatagaaaccagtgtgataaccggcgttgcgtaaggtatttaagaacacatttactgatgatgttggcatgttagaaatttcagcatcaagaatcattaatgtaccgggttgcacatttgcctgtgccttagaattggcgataaagtagttggcttctgctaccgcttgtgcatcattatggaaacggccaaagtgatagaaagcataacccctaattccaccacctgcgcttcgatcaatcagcgaccggatgtaaggattaacatagttcgtgctttctgttgtcttaacaattgcatagtcagcaccgatgtttttgtaatcattaactgttaagtgactctgaaaactagctaaatcaattactgtctttcgttctgtcattactttttacctcctttatatttaccaagaaaattgtacttagatgggtcataatcttcttgatccttagctaatttggcttcaaagaaatccatgattggtttaggcaaccaccaccccatctctgtccaattttctacaattgaaattaaatattgataaatccaagcaattaaaaaagtggtagccatcgtgcttgctccaatcgtataaagatatggataagcaattactaccactaaataaattactgtgtgtttaattatcccagggattccaactgaactattagttttcttaattgttttctttgcataatacggtttaatcattcccgtaattaaatctacaatcatcacgattgtaaaagcccacattagtttatcatcaactaatgtctgcatttggtgcagcataaataaatgatagggcaatgttgatcatctcctttgaaggtaaaataaaaacgccctgagtaggacgtattagtttttttaattgttaattttcctagtatatgcataaatgggcttttttatttgtttgaataaattcttcagtactattaataaagttaaaattataatttgaatcaaaaacgaagctacaacattctttacagtactaaaatggctgcttaaagccaaaatacaattaaacacagcatacgtgtagcccatgataaataatgtgtttttaccataaaactctaatatcttattctcttttaacaatcgcgcaatttgcaagcatataacagtacctattgttccactaataattgttaaaaatccattgccatagtttcttaaattcatgtcaatctcattattgtaagctacagataatacaaaaataacaatcaaaagtaagaaaaccggtaagttaatgtgcttagttaaattatatttgtgtgtaataaagcctaggtacatgaataacactgcaaacattgcaacatcaatattccacggtaacggaattttaattgtaatcgagtaaatataactcaatatagctaagattccaaacactattaatggatatttaaaattaaattttagaaccacaaaaaaaataatctctgcaataaataaggctgttagaaaccaaagtggcgaactccaggccatataattaggacctccacgcgagtatagtaaacctaaaacatattttgtagattgaagcatatactgtttactaaacccttcagcaaatagtggataaactatgccaaatagaagcaaacatatcaaccccattctgaaataaggtaggatatattttttagctttatattttataaactctttataagaaaaatacctgtatttagcaaagttgaacaaatatcccgaaacaaaaaagaacagtggtatatgaaaagaatatatgtacttttttaactcaaaaggtatcccagatatatgacccaagacaactagaaggatgctccccccggataatatcaagcgatttatctctcactttagttgtcacttttatatttcctcccaataaaaagaataattccagtatactcttttaaataataaaagtctataagccgcccattaagtttccatttaagcaatgcaactttctatgtattgtgtatttataaggcgactatgttttgctactcaattaaattactgaaaatagttgctacatcactatctagcagactgtggggattaaatttatttagccaaatatgttgcctactttgtgtaaagctcatatacatctgaccatcaatattttgagtaaatgggtagaagcaatcttgtactactgctgttgctacttcatagctcttttccagaacattctgatcaatctgcatcaaactaatatgattacggtctagcggtgaatgaacaaggtacaactgactattattctcgaaaaagtcatagcgtgattgagtatctggtacaagaatcggattcgaccattgaccattagggatattatacttagctaaaactgcattaccttctgtccctcgctgacgacaaaaataataaacattgtctcccttaacatatacagaaggttcaaattctggcttgtacataaagtctggagtactgacaaaagtccagttgattaagtcgcttgattttactacaaagcaaaaatgtaagattccgatacctgcatagtattgcactacgccatcttcaatccgtggacttaatttttggacaaaggaaatatcacgatcttcataatcatagtcaattcctgccttagctaacaaatcatgaacgcttactgtatcaaatgtcgacgtcattactccaactttaaaattcattgtatgaatatcgctcaacagcttagtcttaggatcaaaacgacggtaaagcatatagaacttaccacctaccttagcagtaaaggcatagatcatatatgaatcatcacttgttttaagaagcaaagaatcgtatattgcttcaatcttttgaccattatattcttgtccaatgtcggctacatcgatgtacgtttgttgatttagattctcaaacggtgcataaactaatcgtgctgtatgctgggttggatcttcgtaagccgatcttgtattagcataataagacataaaaagagtatcgttaactttataaaacgttgatacatgaaccattttatcgccgcttttagcaaaatccgcaagatgattggctaaatctttaccaagtaatataccattcatataactagaaattaatgtatcgactgtttgttgattcaataaattcttttttattttttgctcagtaataacattaatgtctggaagcttataaagttcagcaatttgtttgggatttacttgttgatcaagattgaaattaactactaattttttggcgccttttggcgttttgataaagacatcagttaattgatcattaacatttgcaggcgcaacattcattaatgtgttttgctcagaaataaatccatataatcgtggattcaatccaccataaccctttattctgaaagcatcattaaaattacaatctaatataatatatttgtaattacttactttttcaggaattaatgagactgtttctcctgtttgataagctaacttgatatttcgatgaatattggtagttaaagcaatattaattttagctaaatgttctttatccggagtatatctatatgctgtacagttactatccatattattgataattaattttgcagcattacttggcgcatataaagtaacctgagattgagataagtttacttcagatttttgaattaaccggttctcgctatcaataaaggcccaagccattgcgttaaagcctccagatagattattaattacgaaaatatcgcccggcttacatacttgattaatatattgaaacgcagacgttactattggatgtgatacatcaacagtttcaccataatcaacattagtgttaattgtatagccttcaattgcttcaatcggcattaaatgttcacggatatataaatgatcaatatcattaattactgaacggtgtcctcgatcgataatttttagcccactattttgaatagtatcgcgtaaatcattttgcttcatagtagcagcagtactagtaatctgaaaccttaccgcagtcgtatccttttcaaatgtatatatcgctttatcgccaacactatcgtgcttaataatctccccatttgaattgaattcaaaaatactaatatattgcaaataatcagtattaagcaaaaattcaaaagcatgtgatttaccaattactttgagtgatgagtatgcacgattaaaactttcgtgaggtgtaattttaccagtatttgcatcaatttcgcctaaaaaccaatttatatcaacgacttctttagtcaattcactgagtgatttttgcaaaatagaattagatgtatcaaggtatgtaaggcgtcgtcgcgtttctggatcaaaggtagtaactgtccatataccttcatctacccatgatccattcttgtattgatacttatgattattgtcattagtaacaaagagtccatcttttccattaggatattgagcttttaagtcatcgagtgatgaaaaactctcaatgttctgtgtcattttactaaggcgattatcaatctgattagcaagattattatattctttacgtgtaattacattacctgcatcaatctgcgcttgaattgcaccaacagcatcagcaagtttactcaacgctgctcttgtttccgcagacatatcctcattcttcttaacttctgcctggtacttttcacgtaattctgctaaagcgtcaataatcttaccattgcatcgctctaatacttcatcaaattcagtaacaaagtaaggaatagcagcccccatcgttggaacaccgccaagaacacggaaccaaacattaacactagtaaagatattaccttgtctatcttttaggccaaagtaaccaaagaaaatacctttttgagggaaaaattgttttggcaacttaacaaccgtaattccatcgtctaaactaccagcttcatctttatcttcccattcaacggtagatgcatctgcagacatcttaaagccagttccatcttctaatttttcaaggtactgtccaactgaacctgtcccaaagaaatgtaatcctcgttcttttaaattaattttagtttcagtcttactagtttcccactggatggctaattccgttccttgatctcctacacgagcattaaattggttaaacatatcaaccaaaaggccgcctcgttcaaatttgtaggtgttaaaggtaatcagattactaatctcttttgccatttatcatcactccttcttaccaaaagaattaaaaatatcatccatagacgatgactttttcttttcttgttgtttcagttcttcttcaatactacttaaatgtttatctaagttttcgaagccctgtgcaattgcctcacgcacatcttttccataacccttgtgacgaatagcgtcagcgatttgtttcatagtatgatccgtattatcaaatgactcataatcataggtttcacttgccattatcatcgcctcctgttgttagtttttctacttgttcctttagtttattgaattcttctaaggaaaccattcctttgcgagcacgatcgttatcatcttgaagatttcttagatcctgtctcatttgtgcaagatcagcactactagcaaaattttgcataaccttattattgttattagcagattgctcttgggtttggacaacctgattaaccatcactcgaatttccttaaattgttgaaaattgacttgattttctaactgataatcagtaagccccatcgtcttatcaccaatcgttaatgaagacgcatggggctttagtaaatcaatttctttttgagtaattcgtaataattggggttttgcaacatttggattaataaacatgtacctatcagcaaccttaaaagatttgaagtttgtcatatgtaattctaaagctgtaacttcccaactttgaggtattctttgagcctttatccatgtttgagcttgttgcattaaaacattcggatcatctacattatcaaattcaacagttccctcaataataccgaattctttttgtaaatcaggaatatcaatatagtctctaccgttattgacagtagtaatggttaatttaggacgtgcagcattactattatcaacagtttgatctttctttccttcttgtggtttagacccatcgccaccttctttaattagttttactggatctagccaaccacctgcaggagaaaaagaatttcgaactgcttgataaaaatcttgcttagttacgccaatatgaacatggtctgtatcacgatatccaattacatcaccagtttttactttttgcccaacactaacaataatattagagggagaactaaaagcttcttgataaacgatattgaatccttccggcgtatgaataaccacaaaattacctaagccacccatagctgatttgatagttaccgttccaccatgaatacaatgcacttctctaccaggatgatctattgatccaaaatccacaccatcgtgataactattttgacgatatccgccatcatttccgaaactctgaacttgagaaaaatgaccttccccaacatcaggaaaaggccatccccatgtaccaccagctgcattagaatgaccaccccaacgtttaatacaagaaatgcatccactaattggctttccaatagctggattaggcgtttgaccagctaaatcccaaacagcagcggcagtcccttgtaaataaacgcggccaatagtaccttttccaaactcttgattccatttatccgctaatgcttgattcggcgccattgatccttccggtgcgctccatgctggattaatggaattactatttgaacaatttttaatccactcacaaacagattgcgcatcactatacgcatcaccgtgtcgataagtatggttaagccatccatagtaagttccttgttcttgaagttcataagcaaagaaccattcaggacttactccagcatttttcaccacatcatataaacgattaacgtccactccccaagcccgaactctcgaagaacgagcggcaaaatcttgtttcatattattaatatcactaccccaagtagcattaatttctgatttacaaaattcttcagggctatctaatgatccagaaccgccctctccatcatcatcacttacatcaacttttgatggttctagtgtctttcccagtggaatcagtcttgtaatcaccttagtaggatcaatttgcatacttgcagacttcatatttttagctaactgaataggagtatcatctttatgatcaaccccaatatccgttaagtagtcaatgtagtttattccgttagcgttgtaagtagtcacaatataaccaccaagagatttaactaatttatcattaatagcatcgctagttttgggataatcaatttgtcgatattggtcatccttattattagtgacatttacattccggacttgaaactttttatagtcaggaacctgtgaattatgaacatcgattaaagtttgtaaaaattctttgggcgtttgaccaacaccttcataaaatctttgggtgctatccatgagatatgcttcaatatcttcaaaaacatattcacgaatgaattgtccgctttcttccatcgactttttaggtttgatagctcgtccacgaaaaataagttcattatcatcataaacgttaacatgagtatgataaggccttacgttgtcccataatggacttgcttgattaaccgtaatagtcaaatcatcaatattagattctttaagcgtgagttttcccgaactaatatgacgattaactcggggatccagtacaataaatcctgctttatctgttggttcattataaccaataattcggtacactaaatcatctcctcacgcttaaattgaaattcaattgtcccgtttccggatagatgcattttattgtcacccatctctaatacaatcgtggttgttttaaaattgtcttgagttaaacctacttcaccaattgaatcgttcttcaaagttatggaccctgtcaattgaaatgagcattcgactggtcgtgagccgatattcttaacattaacatcctgatcaccgttaacattgaatttaactggttgccaaatccaatgatcaaatgcgacatcatcccaataatcggtgccctcgttatgattagtataagcaaaaggataagccttgaaagtaatagttgctgtgagcattcccttttcttggtcatcctcaacctcaacactagtacacttagctgaccagtagtaaacaggatcatgagaatcaattagtttagtgaaaccatgtggcagtaattgccgtttaagctcctcttcgtaagctttacgatcctgataaacttcaccaaaatatacaaacttataagtcaactcacgggtcttaaaaaaacgttcctgatcatacattgagaaatcatattctccttgcatgtaagggacgctttctgtaatttcttgttcttctggcgtagttgctgttcgatcaatcaaccaccaatcataatcagaagaattaaaaccggcaaagtcgatatattctgcattttctaagtattctggatcatcctttgtgggtcctaatccacgaaaagaatagtcattatttaagaatttcatcggctccacctatccttcaatgctgtattttgacccaagcgataatcgtattgatccgctgtatagccaacaagagtgccatcgtcaagaaccattgtcgtgtctttattaagtaattgacgaagcaaagcattattctgcatttgtaactgactatcttgaattgccaggctaccagtataatttgaattaattgaacccaagttaccaatacttgctccaatatcaaagcctggattagtaatagcttgctgaatttgattagccatatcactaacgtttgattgaacttcactgaatccattaatcaatccgttattaagaccattcataattgcttgcccagctggaataagtaacttacggtcataactgattggtcctttatgttctttaatccaatcagcaataccgctaacccaattcttaatactattccaaatggatttcattccattccaaagtgaattcatgatagctctaccagcagcacctaaatctatatgaacaactgatttaatgaaattaacaccttcactgaatagcgatttaataccattccaactactagaagtaatactctttaaaccattcattacaccatcaaagattccttttattccattcaatacactagaagtaatactggcaattgcattccaaacagttgatacaacattctgaattgcattccaagctcctgaccaatcgccttgtattgcagcagtgatagcttgaattattcccgcaataacgttcagcacggtagatataatagtagtaataacgttccataccgtacttacaacaatactgaatgtattccagaccacattccaaatagcaacgataattgccaagcctgtttggattattgtacctagcatcgtaatagcagtagatacaactgttgaaattaattgccatacaacttgaacaatgggtacaagcatattacacacagtttgaaagacggtaacaatcgtaattagggttgccccaatgatagcaactacaccagctacaatcggaacaataattggagctaaagcctgccaaacggctaaaattgcactgataatgctattaaagacattaactaacccttgccaaattggagcaacacccgccacaattgatgtccagattccggtaaagaatgttaataatccttgccaataaggtttaataaaattaactactgcattaatagcattaccaattgcattccaaacagtagtagccactccaaccaaactctgccatactccagataaccacgtagtaaaactttgccataaagccctaccggttttcgtttgggtaaagaaataagttaaggctgcaaccacagctgcaattgcaacagcaataattccccagggacctaatgaggccaccgcactgaatgctttcatcgctccaccagcaatcttagaagttttagcaagtgttgacattgcttcactaaacgccattgccaaattaccagcttttgtaatcacacttaaaccaactattgcagatcttaatgttgtaaatattgaaataaccttatgggctgccataactgcacccacaaagcctaatattcccacaactgctgttttaaaaatatcattactgaaagcagatttaagcgctccgcctataacctttgcaaaattaagaactacaacagtagcattagtaacaactggtccaataacttgaaaagcagaattaatactacccttcatgttgtctaggacttgtgcaatacttccaaagcccgcttgcttaaaaccattgtcaattgccgataacatatttgccagatttttgacaacggcattttttaagtttgcaaaagatgtaccgataccttcactatttttctttgctaattgagcaaaaccattaactccaccattcagcttgataaaacgatcattcaactgatctaccgtaatttgtcctgactgcaaagctttataaaggtcttgttcagcagacttaccagtaaaaccaaatgaattggcgactttacgtaatgcaattggcatggtttccatcaatgttcgataagacattaaatcgactttaccagttgaaagcatttgtgtgtattgttgaagtccacgagaggtatcggcaacactagcaccggaggcaaggaaggcattattcaaggcaatcgccgacttagaagccttagttgcactaccagttaatggcgctaattgttgggcaacacttgtaacgtcttgcaaagaagtaggtaatccatcaattcccttagataagatagcggttgactttgcaacatccttagttgaataattcaaagccttcattactaccggatacttgtttaatgtatcaaaccggttaatggcgccactcattgaatctttaacaacgtcccatgctttaccagcaatcgcaactacacccattgctccagccatcgatttaaaggtactggaaatactagaaccacctgcactaacagtttgagaggttgactgggtttcacggcctaaattattaatcgatttaagcgccttatctaaggttgcgctaaaactctcatcgtatgctgataataccgcttcaactctcattgattgtgacactagccattacctcctctctgtttttgtttcatcttccggaattcacgccaccgcttgacgattagatcatttcgtttcttttcaaggctggccttgcttgttggctgatagtcaggctcatagtgcccacgaacatcatcaacaaatttatcataatcaaaaaattggctaaacttcttatacttcggaattgggtgcttttcgctccctttcgtcgcttgtaccgactgattaaggaaagcttgcaatgctaagtctcgttcctggctaacccgttggaggttataggcttccatccggagctgatattcagccaatcccatttcttcaatttctgaaatattatgaaagcctagataagccaacgaattcaaaagaatttcgtgatagctttgttctgaactaagctcaggaccatctaggcttttagattttttgcaatcggcttagcggcattacttgccttaatttcattcattacccgattaaataatgaatccaagtccttgcaattatcaatataatcatcaattgtatctaacttaatgctagacttagccgcacagtacaacacgtctgccaaagcggccgcatccttagtcattaattggggaagcatcatggctagccccattcctagcttaaccttaactccttggatttcttgttcagcgccccgataagcatcaagttttcgcaaaaacttaactccgaatacaaatgattggtcttgaccattaatttttaacttcataatcttcctcctattcagttgttactgcttcatttgcaccagcaccacgatcgccatcagcaaaagcttcaccttcaccgttgtcgtcatcgcctttaagctgtgccaagccacggaatacatagtcaatttcttccttgatttctggcggtagagtgacccacccacgtttggccacgccatcaatcgtaaaggtcacatcccgagttgaatgatcgtctgggtcgttatcattagagtcttctgacacaattccttgcatatattcggcataaactttgccatctgaccggactcgatcaatatgaaccttccatacttcaatcttcttattaaagtacaaagaatcataaacatcatctgcagctttggaaattgcatttaggaactctacttctaaatctgtttcaatattagaagcagtaggaacattccccatcttcgtagttgttgaatcagtatcccgtttaggatcataacttagtgatgtttgatacgggatcaattgtgccggctctttccttgcattttctaatagtcgttcaaaaagaactgcattcttcccttccaatactggatatgttgccatatttatcctcctttatttcaaatcaaaaacgagtgttaaataaccgtgctttaacacagtattcggaacactcgtatcagttaataattgttgttcttgctcattaggtcgtccttgccaagcataatgtttcgtccgaactgcttgcatccccagacgactaatttcatcaaccatcttagtaacagtcttacgttggttagacttcccccacacatggactattaaagttacccgcattcctgtggctgttttatagttcgtcaaaatcgactggctatcatcaacaaccacgaatggataggtaactggttcatttaactgcggtgggtgatcgtaggtctgataatgcttttggacctgagcaaaaactgcatcataaatttcaatacttggtgacattttctcacctacttaaataacttattcaaatcattagcaaatttcatagactcaattgcaaacgctggatgtaatgtcggtcgtgctgccataaagcgagttccatattcaagatatgggaaatattcagtttgtggagcaaccgttgctgttaaaccattattagaaattgtatttgttacggaccgtctagtattcccggtagggctaaccattgttagcccagcccccttcttccattcgtagtggcccttatacaaattgttcatattttgctgcgtttgctttttgagacctgctccatgttttgcgactatccgtttaactggagtcaaatctttattcttctttaagaaattcgctagttctttagtacctttaacatcaaccttaaaagaattagccactggcttcacctacaatcagcgttgtgccttttaatggtttccgacaggtttcaagacgatacttgataggacaatcatcaatagtcagatatgaccaagagtcatttactggagactccaatcgaattaccttggcgttctgatctagcctgctaaataattcaactaggcgatttgtccctacatcagtaacattggcataccgttgtgctactagcttaggactagtaatcgtgtcttcttctgcatatggattatagccattttcatcttgaaaataaaacttaattatctgtgtttttcgcatttttactcatccccgcataaggattaataaaagaaacggcacctaaagatttaacatctttctggtgtcgtcgtttccacaaatcaatatcatcaaggaaatcatcaaaatctgaagaattaaaagtaatactttccccttcttgactatattgactcatcccttcgttttgcagtcgattgaatcgtcgaactgaaacttctaattcaatataacctagttctccaggtaaattttcgtcttcagttagttctagcttaaatcgcaatgcttggtctgtattatcaatgattagtttcagcaaagcatcacggtcatcatttttaatttcaagcattacttttaagttttgcaaaaccgtattctggtccattcaatcacctacttaccagcagacttagcaccactgattgttgacaatacaatgccgtccaaacgttctgtagtcaatacattagccattgttacaacagtttcgtatgacaaattgttattaactgcatcatgagttacaccaattaaaccagtttcatcagaagtcatgttaaataactgaccaacggatgaaattggagcgtagaagtaattgatattatctgcaactgttgtagcaatcgttccctgtggtacttcagcacttagaataatagtgtcaaagccaaggaaattctgaatgtattgcaaaccaaaggcagattgaacagtaagagtttggttacctaaccatgcatatagatcaagcggattagcaaaggcgacagtttgtgtgtcgtagtcttcccacttaactgaaagttgtcctaaagctgccgccattgccttttgaaaatcgtcaccagaggcggtagtcttgtttgcatcagacttggtaatgtaattaaataagtccttcttaacatccttttgaatttctcgaagtagcttattatcagtatccacgatagcaggtgtagcaccaccagctgactgaatagcttcaatggtagttaccttacgatactttttaaatcctaatgtcaaagtattagctagcttgcgagtaaccttacttaacggaataacttccccttcagcaacattaccatcgaccttagttacttctgacttgtaaatcttaatctgtgaaccagtagtcattggctgcatacgaataactcccaatgcattcaataaagtttggattcctccagagaattgttctacaaagtcgatagattgtgcaactaggtctgtacttgtcgttaaattagtttcagccattttatattcctccttttatttttcatattgggataagttatcccgaatggcttggacccgtttgacgggatccttgatctttgcaatttgttctttagtcattgcagtagcaggagcaccattaattcgtggtgactttccctttaatagttcttgacgaacattttctttaattcggttataagctttaagaaatgcttcaccacgttctttagttgtttctgctttatcagtaacaattaaatcgatatcttcatcagttggattgtcataaccgccatcaattaattgttgcttcgctgtatcacgcattttataacgggccaattctgcttcagcatcttgggcacgtttttcagtttgttgaagcttatattcttgcttttgatccttattcatcttggcaagtttagtagcttcactcttagcctggtcaatttcctcttgcttattcttcaaggctcgattgactcgggctttgacaatatcgtttaattctgcttgagtaaatgtcttttcacttttaccgttatctccatcatcagttccttcaggtgcaccatcattatctggatctggcgttggatcttcagcaaagaattgtaaacgcattggtaatttttcaaacataaatacacctcgtttatagtccggtggactgtaatatccgggttgttctttaacgactgcaacaagtaaaaagtccaaaacaaaaagcactcactaatttgtgaatgcttagaaacccggaagccaatctctgacttctttaaaaattcgatatgcttttttcatcattgagttttcagctaaatattgcagaccttcaaccgttattgacgtattgtggagtccaccaacaacagtaccttcgattttggcttgtgtaaatctcactcctgaaatataaccatgctcgcttaacatttgtagagttcttccaaattgaactttactaatattaaatgtatcagcattaagaatattaggatcaggattaattccattttcataacaatacttaagataacttagtattttgtacgttaccgtaaagaaatcattatttcccattggatcacctactttttatgtgagtgtttttcttttaattgtttagcaaacgtctttttgaataactcatggaattcttctgtcttcttcttttgttctgacgttacttttgaattatcaaatttaacgccttccaaagaattatctcgccaacgtttatcagtaaaaggcttgttactcatctaattcactccaaaccattgtcatcttcccgttatcatcaacgtatgcatcatcaatcctaaacttactatttctggggaataatacttcctgctcattaaaattaaactcagagatatctcttcctgtcttacttgatttaataataacatgaattgtctctttgccctgtccataataaattttagaagttgaaatgtatgatgaatcagtgaagactccaccaatttcaaaattactaataaaatcatccaatgcttcttgtttatcaaagaaataatcacgctggagtggcttgctactatgataaattggcattttagccaatgcggcatctaagttttcaataaattgtttcttatttttagaaatcttattacgcctcaaatcatcattaatcttatatgaatctgaactaatataattattcaatgccgcctgttcatcatcagataatgctatattgcgttgaccatcgacccatgtctcactaattgaacagcgacaattaggatgagtatcgtctggtattttaggaactttattaattcgataaataccatcaccaaagccattatcttgcgtcgcaatctttcgacactcatcacaggctcttggctccgcaatccagtggacaaattgataaccattctttttgattaattcaatctgagcagaatactgaacccgtgctgattctgtcctggcaatacgttcagtaacataactgtgatttttaacagtgacttttactttatctcttaattgtcttgctacaactcgcggattcttaccagttaaaattccgttggtgataaccgtatcaagttgagctttcaaagtatcttgattagcccaaattcgttgactaaaagttgctccattaatttgcttcattacttgtttcgcaacatctttagaagtccaaaacgaactattttcggtagaatgatctagaataccagactgacgttttagctcatcagtataatctttaccaattttagcttgcatatcagcatcaatattcattccggcttcaaccatcgataaaccaattttagatttcaataaattcaatcggttatatcgcatcgccgtattataattcctcaatcgttcattaacttcatcagagaaatcattgtaagtaacatgcttcccttgtgctcttaaacgattagcttcctgaactaccttcttagcttctgtttcataatcagcaatatcggtagtggacacttctttttgagcttcagcataagaaactttattccggacagctaaagaatttatctgatcttcaatgtctttattaatctggacaattgcttgatcataatactgttgaaggcgctgattaaattgagcatctttacttaattgctcttcttgccatttacgttcccgagcaatacgatcagcccaataattattcttcttcgtcatcggattcaccgttcttccggaaaccaactatctctttatcattttctttttgatcatccattagcatttgatctgtagcagaagcagaatgttgaagcgcttggtttatttcttcctgcttctctttttgcatacgctcaacttcttttttaggatcatcaattaaacgactatttcggaatgcagtttcttttgacacaacccctgatagtttttgtaaagtatcagcttcttcagaaacatcaatcggtaagttttgtttgaaatcaaagagcaagtcttgccaggcttccttatctttgactacttgatcagcactaaacactattcgatataacttccggagtgcctgagtaaatttacgctctttattagctgccatatttcgcattggaagtaacttatattgcaaagccaccccagaactattaccagcaaacgcttcatcattaaggttagcaaccatacttacctggtaaatcattgaaacaagccggtcaataatatgttcttgcatattatcaccatctggttttgaaatgaattcgacatcggcattagcagcatcagcattaggcgaataaatcatttgattaccaattaaattagcatccggtctaccatcaccatcctcatctaaatcaagaccaagaattttaaggtaagcattatcaaaatattccacttggttagctttctgtgataacactctgtctaattcgtcgattaaggttttcacattatcaaaaacaccttgccgctcttcatttccataaaattcaactgctggcactaaattatacatattattttgatctgaatcttcaacaacactacctttaaaggttttaattttattagcgtaataaaccattccggtccataagccgctttcagtatctttccagtaacgaacaaaagcaaaaggttttctagcaaccgtatcatcgtaaaccatgaaggcatctgtaggagaagcataagcaatacaagtgtctgcgttctcatcttgataaataaaagcaaacgaacgtccgtagatatccgtttgcttactaatttcactcaatttgtcctggaacgaattagtgtcattccattgctgtaatgcttcgttctcattcttatcatctaaagtaatcttaggtgggattccagtaaagaatccattataagtatcaacaatataatgcggtaaatttgctactagccgattatctggcccatacatccgccgctgttgatctaagatatcgtgattacctagatacatttgcatattatgcttgtaatccttagcatactgaatatttcttctcatgaacgacagtaaatcatgcggatcaagttcttcttcatcagctggatagataaaaatatggccatctaaaatttgtcctttaccgtttactgtttccattcaatcaccacctaaatataaatatttttcattacagttgcctttggactagccattccgttgatttcagataaagcatacctgatagcatcgatttcgtggttgtaactatcgacaggctcattggtgtattcaccagtttgtttgtccttcttgtatgtataattttccaattcctcaatcgttttcacacaccggtcatcaacgactaagtgatattgctgcataaatgaaagtccctgtataatgctgtccttcccctttttagctggacgaatccgcgagataccatcgcgtttaatttcagcaatcgatttaggctcagcagcatcagcagtaataacttccttgctataacccatttgtttaattattcgggcaatatcatcgttcaacataccgtgcttagcgtactcttccatcacgtaaattttacgggtactctcatccactttaacgtgcataaaggctgtttcatcgttagtgtacccaaagtccaagccgaagtacgagggaagctgtgataaggttcgaatacttaaccgacgtttttcaaactctggaaagaccagcttatccaatgtagcaaactcgcccagcgtatagattttatagtaggccgggttggtttgttttaagttctcaatcgttgcaatgttatcagcgtccaaaaagtgattatccttgtaagttgattggtgaattgatactcgttccggattaactttcactttcggatcaaaccattgcttataagtccagttcaatttgctaactggattaaacatacaaaacaattgtcgtttcttatgcttaggttcacggagacgtagggtaagctgcgtgaagtcgtcctgtgtaaattcggaagcttcttccattaccacatcagataaccctttgattgacttaatcttttctgggtcatccatacccttaaacaggaaaaccgcaccgttcggtaaatgaacagtacggtttgatttatttactctacataacgataacaattgccaatttgataaacagtcaattacgtcagcgaagatagattcttgaattgttcgatcaactttccgcagccatagcactttgcggggatgtttccagtgttggagtgatttaagtacaactttctgtaccacaccatgcgatttaccagaagatgcaccgccataagtcagtaccaaacctcaacgaaatgactgtaatcaaacaagttatcaaaaatttgtttattgaaaacgttgtatggtttaggaaaatttagtttgatgtttggcatggtatcaccttcttttgtcttgaccatatgtatcctttgaaagattttatttccccatcacaacagcgatacacacttctacggttgaatccatgtctgtcggcttctctcgctgaattccatacttttaccaaattaccgtttaaatcatattgataaattttccaagtactatggctttgttgtgaaagaattgaccttttctccacgtcaccataattcatgttgtacttgctagtacaccattccaagttatccacctggttattatttttatcttcgtctttatgattaacttcaggcaatttgtctgggtttgggataaaagcttccgctactaaacgatgcacctttttggagcggcggtttaaattaacctgagaatatccataagcatctttcatctgtttaagcaagccgcctttatactcactgtaaacattacctttattgctaaccaagtaatgaggatgatctttgatttttctccattgttcttcactcttcatcatcataatcccccattcccacatcaatctgaacatcaccagaaataacctttttatcagtccaggcgccgtgacgctttccaattaattcagcagctttaatacgatcttttgccgacacttcaacgtcttcataaatacccttagcagtagcaaccgattctgtttgctcaccacgcataactgaagtaagatattccatcacctctgtcatatcagctgttttctcggattgaatttcagcattgcgtttttcgattgcagcttttaagtaaggttttgctaggttttcagcaccagactgcttagctgtcttcttagaatatccagctttaattgccgcctgagtagcattacccgaaataatgtactcatcgacaaatcgttgttgcttctgtgttaatttttgagtaatgctactcacctcctaaaaagtaaaaagtcagccgttaagctaaactaattaaatttatttaaatttttctgaattcttttctatgatgtgtaaagccggtggctgtaatacaaaaagaaattcaggatcgtttatatcttcaacttggctttctcttactataatttcattattaagttgcataattacgtacatattaaccaattcaataacattagtatcgttttgtcttaaatatccttggtgatgttcattagcgtaaagtttctttacaattgccaactttttatcagacaagcctaagatatatttttcgtaatctctttcaactttatgtttgttatacttgtttctaccccattcgtatacttcaactattacttcaattattaatgaggctacaaaaaataaagtaattaaaataataatccaagaaaacttattgtaaaaccatttcatattatattgaattaaaaatggttttaagcataaaagtactattccaaaaataactccaacaaatttagtttttggcttcatactcaaagcctccaaaaatgtttttaagtattcaatcatataaaaatcacccaattaaacataatacaaaagcctagccataatagctagacttcatttgggaagattattatatgaatatcgaatcattcgacaatactattatcacatttctatcatgaattgctcgctcaataatctatcatcaatttatcaatcttcctcgtcaagataaacgtgtagatcatcaatttcagtatgaataccgtgcttaactaactgaaattcaaaccggtccgcaaactcacacagcgctttttcctgctttcgactatacgttgctgaactaatacttagctccctagcaatgttatacgttaacatctgatccgaataccgatttagtaaaatccgttgtgattcctttgtcatattccgcatagcgcaacccacacaatcaacaacctcttctgccaaccagatattcagcattcgattttcactaccgttaccatggctgggagctttaggcattccgtccatccctggtgacttcaaatcaaaacgttgcttccccgataaagccagatagcgatccagcttcttatcaagaaagtcagtaacctttcttgcagttttcagacaatcaatatctaaattcaaacttgtttgcatgacgtaccctcgctatctgatataataattatggttaaatatttttagtgaggacacatcttttacggtgggtccttttttcgtcatggatttttcttacccaataggaacccagcaataaagacaatcatcattaatacaattaaaagtaacattgcctcacccttgtaaattccgtccacaatgaggacaataattaaatacctcaccgtcaactttgattggtacttctgtcttaactgatggatctggagatgctttagtaaccattaacttcttaaatggaaattgacaatactcacagttacttttgctaggaataaaactttgtcccttaaatacaactgtttgcgcattaattttaatactcatgacaattcctccgcttgtacatcaaccggcaccgtaaataacggattaccacttagctcacgaattgtaaattgttcggttaactcattgtgcccgattacataatattttcgatcgctatagaatactggcacattattttcttcatgttttaacgcctcttcaaatgtcattagtaacttacctcctacataaacgccgtacttattataagaattattaaaataatccacgttataattgcaaaagcttccgcaacctgaagaaatgtaactttcctcctcggtttactattagtgaattcttccacatgtggataatgccttttttcgcctaattcaaatgcaacactctctgctttaatttcatcattactcattggaacaactggtattttgataatcttcgccgtcacatttttcatatgcaattcagaactaaaagcatcccatgctgattgataaaattctttcttaccatcagctgctacttcataaacaaacggttcaactggataaacatcagtactccaatcgccacatcttgctttcattagtcacgctcctaacgccaaattttgtaaagcatctcaagtgtcatcagaaaaagaaaaatccatatccagactttacttcccgtaactattgataagacgactgaaacaattaataacagtaaaaaggaagtcataataattttgtcacttaatctcatccaagcatcacctcatcaatgtagttattaagattgattaattttgttgttaggtcatacattgtcacagttggcctgataccatcatcacgagtgctgtaataatcaagaataattttcttagcattatcggcattcttagcaacaacaaagtggctaatatctgtgccaaatacagctacaacgattacttcataaatgtgcattagtcgcacctctcataacttttacggaatatatcatcagctaccacttgataattcccatattcatccttaacaatccaatcaccaatagctagaacgttcatacctataaagaagatgtttttagctaaattaggattaaatacatgcactgaatacctttcaatcatttcatctgacccatcaaactgttcagcttccacaattggtaactttctatatttgtgtagcattacatctactcctttacgctataatcttatttgaggtgaatttaatgactaaatattttagtaatgattttacagggaaagctcctattatttgtccttattgtcatgtatatgctcaatttgattggaaatatgcagaaaaaataaaatcaaaacaatacgaatataatttaatagttgcaaaatgcacttcatgttatttagattctatttggtttcataatcggcaatccaatgaagatatacttatctttcctagttttcctttaaaattaacagctcctaatccagatatgcccgatgatattaaacaaatttatattgaagcggcaaaagtacttagagattcaccaagagcatctgctgctttgtctcgtctggcaatagataaactaacaaaagaattttccaataaacattcattagataatcgtattggtgatctagtatctaagggacttccggctaaattacaacaagcgtttgatattgtaagaattgttggaaataatgctgttcatcctggtgagatagacttaactgataaccaagaaatggcgaaaagtcttttaaatctgttaaatataattacagacaatttaataacacagccaaatcaaattgataagttttataatagtcttcctgaaaaacaactaaagcacatagagaaacgtgactcaaagaaaaattagtttccaaaactttctgctaataatgtgccttctttgctccaatactgaataatctttcttatcggatcctcctttgttccagctccacgagaggttataacctgaattacttcaactaattttacttgttgtggtggttctttttttattttcatatccataaccaatcaatccttcctcaacaatttttactgcatctccagcagacctagcgattccatgaataatttctcgtttagttagcatttcatgaaatctaatttgatccgctctaggcttacctttttcgtttttcacttcaatataaaatacttgatgatccgaccaacgaaatccatataagtccgggtgaccactaggtacaccagctgaaaaaaatcttccatctggtgtttttaccgaaccgacatttacccggaacactgtacactgatgttttgatagtgcaacccggatatcgttttgaattttatgttcactcgtcaatgctcacactcccacttaatcatgcggtcaataattgaatttcctacataaataggatatgcgctaggcaatttaatatcgctaaattgatattttcccttcaactcccaattccgataaagaccacaatctacacgaaataatgcattacgttcaatcagttcatcaagtaattctgatgtgctgatgttttttaattcattcatattttcctccttgcatacactatgcatacagtagtgtatacagcttaattcttactctctcaacggatttagttactgcatacacgcatacactaactttcaactttttataacgcatatatagtatttatatatatttattttttattattaaaatagtgtagtagtgtatgcaaaccttaataaacgttgatgtaataggttttttctgcatacacttaactatattcatagtgtattatctgtatgcacttttctataaccacgatgactaattcctttaattcgccgttgtcctgctttccaatcatgccggttatccattacatacttaatctttttggctaatgaacgattcttaaccagattatcttcacctaattgatgagcaatttctgagctttcaatccagtcatcgtcccaagtactgagaacccgttcaatttgattttcagtttcatcaatgtacataaatatctttcgattatcctcaatgagcttctgctgctccttcgtcaatatgaaagaaaagccttctttgtagaggccaacagcttcaccccaaatgtgattgaccatcgtatcatcaagatcagttaccggattagccattgcttgggacttatcagccatgttaggtaagaaacgccgctcaccggttttatctttcaaataggttgattcgttagtagtccgggccataacaaaattctttggccggcggattgtatgtcgtccatatggtggccggaactctaattcttcagctgagataaatttcttcaaattttcaaagtcagaattatttgtggccgtcatttcatcgtcattaacaatcaatgcccgcagcatattggcaaaattatccttgtctttgaagtccgtaaattggtctgtataccaaccatgggctaactttttaagtaaagtagttttaccaacgccttggccaccaactaaatcaaacacccaatcaaatttactttccggcttatagactttcatcaccgctccgactaagaataattttgtctgcagcgttgttacttcaccactgggtactcctaaatagactggtaggaagtctttgattcgttctttgtggtcccaattcttatagcacttttccatatactctttaaccggattatatgggtggctttttgcttcaacagtgattgccatatttaacaatttttcttgaaacatcaccccatactcatcctcaatgtaacggagcataattgctgaatagctatcatcaagttgccccttttcaataaatagctgtggaatgtccttaacaacatcaattgaataagcaaactcgttatatttgaaggtgccatgcagtagtggatcgccatcaaggattaaaccaatattcttcaaactattagttttaggattgccttgagtatttaattcaaattcaattggtttgcgaattatattatccgccacgtatttcacccccgtttctcaaatcacgtcttagcattgattgaaatgtccggttcacttcttcttctggtagtggatcgggcgtattctcattacaaatcatcgctaattgataagcagactttggttctactccccgaaacaataaagcaccaatcattccagctaagtttttatttcttattcctttatctcccaatccatttgcgatggtctcaagtaagtcagtagttgagttgcgttcacgtggtttaaaaactaaatcatctggagaacttcgccggttactggctcgcatttggttaatattcactactaacgacttaggagccgtaacaatcggcttcttattcagccattggtaaccttctgatggcgcaaccacaacataattattttggtgggcctttacatcaacacctggtaaataaccaattaactgattaactcgcatatctgaacgtttcaaataaaataactgtcggccaccatgcttggtggtttgggttaaagtttccggaaaatattccgctggtaattgcttaattgattcaaaaccatcaatgttatcagcatggttgcggtctatatcaacaacgaagaacttatcagtccgcaacgcaatttgagcatatggatgttctatccagatggtctttatttcttcggcggtaagtggatcacgatcagcaaacttaattagtggacgcttgccagcaattgggaggacgcttaaaccctttgcttgataggctaaggcgtaattaactagatttttcatttttcctccttaatggcctcccagccatacggtgttataagttcactgactcaaatatttacttaaaagggcatttcatcatctgtaacttctggcgtttccggctgttccgcttcatcaaagtcataattacggtatggatattgggggttcttcttgtttggtcgaaccttcaaatccataatcatggtctttcctactgccggtgcaaatgctttagccaagttctcgtagattaaagtatcgtcatcccaaacttcatcgggaatttcaacacctagaattgctgctaacttagaaaccaatcgtaaattagtttctagcattggattgggattacccttagaagttaattcatctaatccaatttgtaagaattctttttggccggctgattctccatcgacaacttctaactcaaagttaagctgttcagcattccaaggagtttcatggttttctacttttgcaactacaacggtatatttaccactttccagtcccttaaatttattaactgaatcattctttggatcaaaaccttcagtagctttattcattgcatctcgtaaactcataattcattaaccttcctttacattttgctttttaattttgttaacaatttcattctgctcttttgtagtagtctgctttggcttatcaaagacgccatttacatgttcaagtacccgtaagattgccggatcagtaatatcatctttgacataatgaattcgtcgatctttaaccatccggatataacggtcaccatagcgcttagtttcaatcactaaatcacaatttccgttaaccacgttgtaatatttctgttttagtgatggtcggtcttcggtgtggccagaagattcatcagttagcatcattaaccggctaatgtaaaccgtattcagtggtaaggcttttagctcagtgacaaatgcttgaaagacggtattaaattgtgcatatcccttgccgtaaggaacatcccccagcgtttctactccattgtcataacagatggcctgttcaattagtgttactacatcatcaatcacatcaataactactgttttgtaaccatgattttcagtaccaagagcaagaataatcttgtctagttgatcaatcactgactctttcaagcttccatcgctctttcggacattctttaattgaatacttggtgcggtgttcatctcactattaccatcggtgttaagaaatagcggacttggaaaacgttcagctagatatgactttccggacattgtatctccgtagataaagtaatttcttggaactcgccgtgccttctgtggcttatttggtggcaaaatactcataatatcaacctcacttcttaataaatccacgctgtttagcgtagtggtaagcccagcctggtttgtaaccttttaatttggcataggcttgtatttctttcagattcttcaattcgtttggacgcttgccagcaacattattcataattgctgacgattgaattttcttaataatcgctagccgtgacttagtaactttttttagttgaacatcatcaacgacttcaatttctttttcttctcctaatgccgccccgcaataagggcaaatatcacttgtacgataaaacgaagcaaaacatatcggacatactgatacaggtttaagcgttgttcctggttgttgtttattttttccgctaccttctaatgtccattgccgctcatcagtcggcagcccgaatcgttcaacatttcccacgtgatcgataattattgcagtcttaccttcccgtggattcattgagcgcattgcaaattgtaagtacaacgataatgattgagttggccgtaacataatgacacaatcaacatttggtaaatctaggccctctgtaaataattctgcattggttacaatttgaatttttccttggcgatagtcctcaatgattttattccgttcttctttgggcgtttttccggaaacggcgcttgcagttatcccatagccattaaatgcattggctaacttaattgcactatcaacgttataggtataggcaatggcttgcattcccgtagcaagtttcaaatagtgcttaaccgcattcccgtagattttaggcttcatggcttttttgattgaatcagtgtcatattcaccagttcgttttacttttaacttggcagtatcaatgtaagaaggagcgtaataatcaactggtgctaaaaagtgatggtcaattaaccaggggactgatttgccaataattaaatcatcagccacatcagtaaaaccctgtccacctaaccgataaggagtagcggtaaacagtaacttataagctttcggaaaagcatcaagaatccttcgatatgatttagccagaacatgatgggcctcatcaacaaaaattatcgccggtgggtccaaattattaacgtgtcgggtaatcgtttgaaccatgccgattttagctaaatccatatttacatcattagctttgaaagtcttgataacctgctggacaatttcttgccgatgaaccacgaacaagatacggttaccctttgccgttgctcgtctagcaatctcggccataataactgtcttccccgttcgtggcggctgttgaaccatgatagaacggtgaccagcacttatagaattcatgatgttatcaatcgtttcttgctgataatcacggagttcaaacattatttaatcaccgtgttacggttagcttttaaatgtgctcctggtacttcttctccagctttgagtgcttggtaaatggcctgcttatctggcttagtagtcgtctcagtaattttgaacttatccggaagcttcttatcactatcaataatggttgaggccttaaagttccgggcactaagtaagtgattttcagtagttattttcttaataccggcatcatcaagaacttcagtaatatatttcttgatccaagtaagtttattttttcggtaagtaatttcttcttcccatgacttctttttgtcggtcataaaatcaatttctgacttcaaatgatctgcccatgaagcaagattgtccaatttggtcttccgatcatccttaattgattccaatgtatcctttagaatagttggatctaagtcatcccgactagcaagtgttttgtagttgtcgtttaattcaaataaattcattagttcttacctcctagaaaaatctgtgcaaataaatcagcagttggatcagtttccaaagtatcaatagttgctttgacaattgaagctgctatcggattagtatgtaaccaattcataatcatggctgctaccgttccgggatccgcatcaactaatgaattagtacgttcgtcacgaatttctgattttttagcagcgaaaatggctacctcctcgtattctggtccaagaatttgtttaattgccttaatcttttcttcgttagtcattgttcttacctccgtaaacattcttagtttcagtggccaaacgctcagctgaaatgcgtaacatcgtagcagcattctccattttgatggccattgccattcgctcttcaggagtagcagcgctttgatagcgaactgccaaattcgatacaaatacacaattatcgccaaccctggcatttaattttgataaattaaactcattcatatataattacctcgtagattatttatttatcggtacgactgtttgcggcagtcgtaccttttttatttagtggatcaagaaccactagcagaagataaactgctaggatcgccatcgctccatcataagagccaatcattgaacaatacatgatccaagcaccaacgattagcgcaattaatttactcattaaactaccatcctttcatttgctatactttgattaactcagtacaaaaggaaaatcattatgcgtaaaatttttaagtttttaaccaaatttaattactatagtaagaaactaaccgactttatggtttgtatcttctgcctcatctgttttacttatttagctctacatattacatatgctgctaatccagatgctgtaatttttgaattccaaaaactcagaatatttgattgcttaattactattctttttctaactggcttcttttcttttccattgtttatccttggctggcttacagaaactttaggatttcaaataagcgaaaaatacttggatgatctttcaaaaatagcaattattctttctactattactgggctattaataactcagaccaaagaacaatttgaatttacagctactttcatttcattcgttcttatttttatggctttttttccaaaagaaattttcaatttgccttctgatgtaattcaaaaattgatacaaaagcggcattataacaaagataaaaaacaacaaaagaaataaatttaccaaagttcatatcacctcctttcaatgtttcttccgatacttttctttcaatagcaatggtttattccgctcatacaataagctgtacaccaatgcatataacaaacacattgcaataattaatattggtaatccaattaccaacgccatttaactgctctccctttctgctatactttgattaattcaaaataaaggtggtgaaaattgtgaaattgaagcaagactgtgttaggtatgttcttttatcattagaaaaacagcaattgcaaatgctttaccaaggttttacagattctcaaattgcaaatgttattgctaatgagacctttgataaaaatgatattgtttataccctttatcagctctactcaggcggtttcattagtgccaaaccatttattaataaaatggttcgccaattaactgtctatgacatcacttggtctgggcatgaactacttgattccattcgagatgatgaggtttggaaacaaacaaagaaagctactaacactctaaagtcagtttccattggtgtccttaaatctgtggctactacggttcttactggcatcatcaaaaagaacactgggttgccactttaattgctccataatttgaaagtctttaccttgataacgagtaaacaatttcttgttttttgaaaatccgctggcttcttttattaggtcagcgtttttcttttgcaaaataaaatcagacgtttgttcaaattgagaaactataattcgtcttccaaaaattccttttacaaatatcggttgtgccatctgttcacctcctaacgtggcaatgactggttccaatcaatatcagcttgatgagacataatccaaggcaatgccttggtcacatttaccttagttcgatgaccttgacctgcattcaaattgataacccagttcttaaagactggaagtgtaaggagaaacattctgacccattccttgtcctttataacgggcaacttactcgtgaattccttgataccgacccatttgtcagtttggacatcttgtttaggcactaagttgtaacattccttaatacgcctgagaacctcattagtaattacttggtaatcttgttcatctagcgatgcttgcattttgtgtcacctctcttagccctttgttccaatatggaacttacgaggcaaaaaaatagtgtcaatattaagatcaaataatttactaatagcaaacatttcatcttgagtaaattgatttttaccattttccttatcacgataagctttgacactaatatttagataatcagccatttgttgttgagtcattcctttaacatgttttcgtaaatcatataatcttgactgcatattatctctcctttccgttccaatttggaacaattatatattaaaaccattctggaacaaatgcaactatttttttcgaaaaagataaaaaatattccatttcggtaacgcaagttatataattagttacataagagaggtacataaaatggaactaagtaaattcattggtcaaaaaatcagaaattttcgtgaacaacgtggcctttcagtagaacaacttgcagacaaacttgatacgacaagagcaactgtgactagatatgagttaggatctagaaaggcaaatcaagatgttttatttaaattagctgaaatttttaatgtaaatgttgatgactttttccctaccagagaaaagaaaccttctaatattatttatcctaaagaaggattagaagttgtttcaattccaatcattggtgaaattgcttgtggcgatccgattactgctgaagaaaatatcgaaggttatactgatgaaatctttgaaaaaccagttcctagtggaacactttttggtcttcgttgtaaaggtgatagcatggagcctaccattcctaatggcgcattagccattattagagagcaacctgaagttgaagatggtgagatagctgcagttcttgttgacgatgataacgaagctactttaaaacgtattaagcatcaaggcaatttagttatgctaatgccagataataaaaactatgatccaataattcttgatgaagagcatccaggtcgaattgttggtaaattagttaaatattcagtgacaatggaataaggtgatccaaatgagtaaaaagagatgcttcatatgtaatgatgccctgggaatgttaaaggcttcttgcattaccaaagatggatatttaatttgtggcaaagatgccaacagacttgatcccaaacgtccagcaaatacttaccgtgttccaattaaacttagcaatttcattagttcccataccgctagtgaaattgaaagtttattagggattcattctaccgtaccttacaaagaacatcctgatttgtataaatcaaagctatctaaagtaactgagaaacttgattcaattgctgatagcgctggtaaaaaagctgatactttacaagcagcaattgacgaaatcaacaaaggcgaacaagaaaaattggatgttattaagcaacagttaaaggatgccaatgtagaaaatctattcggtactaaaaaggaaatcaaagccttgccagacataatagatgtcgatggtggagaaaaaatactttatgctgctaatgctttcgttgaaactaattccattcttgcggtttgtactaataagcgcgtaatttttcttgaccacggcctgatttatggtagtaaatcaactgacattccccttgatatgattaatggcgtttcatattctaaaggtttaatgttgggatctattgcagtaaccaacggagctattacaactcaaatagaaaatatgcaaccctaccctgctaaaaagatggctgagactattaaacaggcagctgcagattttaagcagacatcagcacaatccaattctagtaatgacctttcgcaattaagagaattaaaacaactacttgatgatggaatcattaacaaagaagaatttgatgctaaaaagaaacaaattttaggaatataaggagtcaaaggatgaataaacttttaaaaaacgctttttcctatcttaggaactgtaatgatttaaataacgctctttacaatgtaaaaattaaaaagataggagaaagctaaaaatgagtattttcaatggtaaagatggatttgctaaagacaaagataaatatattaaagaaaatcgtttagaaagtttagatgacgaaattctcgaatctgtaaaagatatagcagttgccgaaaaattaacaggtgcctatcctacttttacaagtaatgatacaaaagccctttttcatgaattaagaataatcaaacagcaaaattggataacaattaagcaaaatcaagaaattattaatcaattaaagaagctaaacaaaagctaaatttctcgtccaactaaattgatgacgtaaaaagctatttaaactaaaaaagcccaccgacagcggcaactgtcagtggaccaagggttgatattaattgcgtccaaacaaattctatcaaccctttcattatacacaatttaataatggagggacaagtatggctcaaatatataaaagaagcggaaaatggtctgtaagaattcagtggaaagatactgaaggaaaacgtttttcaaagtccaaagctggttttgcaacaaaagcactagctaaaaagtgggcagctgaaatggaaactaatcttaatcgcggaatacacattgagaaaaaaattgcttttagtgattattacgaagaatgggttaatacttataagcaacctaaaatatcaagtgtaactctgaatcgttatattataatcggtaatctaattaatgattatttcaaagaagcttctattaaagaaattaaccgttctaaatatcaagaatttattaacaagtatggagcaactcatgctatagcaagtgtaaagaagcttaattcaataatacggtcttgcgtacaatctgctatccttgatgattatctgcttaaagattttactaaaggtgttactttagctgccaatactagcaaaacaatgaaggtagaataccctaatgtaactgaaataaggaaattattaactactacaatcaatggaattactaatagaagatatacaagccgttatatgatagtcactgcgatatatactggaatgagaaaagaagaaattcaagctcttacctggaatgatattgatttcattcatcataccattaatattgataaagcatggagagaggtaaaaggaagagacgaaacagacgaacattttaatacacatcgctttaaacccaccaagaatgaatcatctacacgtaaaataaaagttaatgaaaaactactattactacttaaacaattgcgcaataattcatcaagtaaccttgtttttatggatcaatttaatactatccctactagtacagcattaaataaaacgcttcgacaaattatgagtgatacaaaattatcaaagaagaattttcatttccatagtttacgtcatagtcacgttgctttactgttaagtaacggaatagatatttatgcaattagcaagagacttggacataatgatatcacaaccacaatgaacacatacgcctacttgattgatgaatataaaagtaaaactgatgacaaaatcgtccaggcacttagtcaattttaatgtgtgatttttgtgtgttttcatcacaaatttgcaccattttataccatttctttaaaatcaaaatttaaactaaaaaataggagaaagcctgcaataacaagctttctcctatttcattagcttagctgacaattttgtaccaaagtactaatatgcctccggtgggggtcgaacccacactccctcaacgggaactggattttgagtccagcgcgtctgccaattccgccacagaggcatcagctaactaaaaggtggtaatcggatttgaaccgatgataaaggttttgcagacctctgccttaccacttggctataccaccaaatagttaagattaagtaataagcttaatcaaaagggcggtatgtgggattcgaacccacgcgtgccggacccacaaaccggtgtgttaaccaaacttcaccaataccgccaaaatattcagttaagcagggatagtaggaatcgaacccacaatgacggttttggagaccgtagttataccgtttaactatatccctataaaatgggggagagtggattcgaaccaccgaacccgaaggaacggttttacagaccgtcgcgtttagccagacttcgctactcccccataaatggcgcgggacggaatcgaaccgccgacacacggagcttcaatccgttgctctaccaactgagctaccgagccattgtgtcatgggtatatacaactattaagttgtaatggaggatacagggctcgaacctgtgaccccctgcttgtaaggcagatgctctcccaactgagctaatcctccaaaagtgacccgtgcgggatttgaacccacgataccagcgtgaaaggctggtgtcttaaccacttgactaacgggtcatattaacggagagtaagggattcgaacccttgatacaggctttaacccgtatacatcatttccaatgatgctccttcggccagctcggacaactctccaatatccaagccctggcacaattaagaccaggtgccaaagcttgattttgcgtggcaacgtcctatcctcgcagggagcgatcccccaactactttcggcgtgttgaagcttaacttctgtgttcggcatgggtacaggtgtatccttcaagccatcatcaccacactctttgtcccttcggacgagagcttgtgctctcaaaactaaatcctatctattctcttccaataaaccttaccgctccttggttaagtcctcgaccgattagtaatggtccgctccatgcctcacggcacttccacttccatcctatctacctcatcatctctgaggggtcttactttcccgaaggaaatgggaaatctcatctcgaggcgagtttcacacttagatgctttcagcgtttatctcgtccatacatagctacccagcggtgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacctgtctgtctcgcagtcaagctcgcttgtgcctttacactctgcgcatgatttccaaccatactgagcgaacctttgggcgcctccgttaccttttaggaggcgaccgccccagtcaaactgcccacctgacactgtctcccagcacgttcagtgctgcgggttagagtggtcatattgcaagggtagtatcccaccagcgcctctgtcgaaactagcgtcccgacttctacggctcctacctatcctgtacaagcagtacaaacactcaatatcaagctacagtaaagctccatggggtctttccgtcctgtcgcgggtaccctgcatcttcacagggatttcaatttcaccgagtctctcgttgagacagcgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacttcatcttacgattttgcagaaacctgtgtttttgataaacagtcgcctgggcctattcactgcggctggccttgcggccagcaccccttctcccgaagttacggggtcattttgccgagttccttaacgagagttctctcgctcaccttaggattctctcctcgactacctgtgtcggtttgcggtacgggcagttaactactccttagaagcttttctcggcagtgtgacatcggcaacttcgctactttaatttcgctccccatcacagcttgtcaacacggatgtaaacatttgactcacatcctgacttactgcttggccgtactcttccagtcgtacggtttgcttagcctcctgcgtccctccatcgtcaaacgcagttaactggtacaggaatctcaacctgttatccatcgcctacgcctctcggcctcggcttaggtcccgacttaccctgggaggacgagccttccccaggaaaccttagtcattcggtggacaggattctcacctgtctttcgctactcataccggcattctcacttctaagcgctccaccagtcctcacggtctgacttcgccgcccttagaacgctctcctatcacgtgcacatagtgcacatccacagtttcggtaatatgcttagccccggtacattttcggcgcaggatcactcgactagtgagctattacgcactctttaaatggtggctgcttctaagccaacatcctagttgtctatgcaactccacatccttttccacttagcatatatttagggaccttaactggtgatctgggctgttcccctttcgacggtggatcttatcactcatcgtctgactcctgagtataaatcgatggcattcggagtttatctgaagttggtaacccatgacgagccccttgtccaaacagtagctctacctccacgattctttacctcaaggctccccctaaagagatttcggagagaaccagctatctccaagttcgtttggaatttcaccgctacccacacctcatcccagccattttcaactgacacgggttcggtcctccagtgcgctttaccgcaccttcaacctggacatgggtaggtcacctggtttcgggtctacaactacatacttcttacgtccatttaagactcgctttcgctacggctccggtttttccaccttaaccttgcatgcaatcgtaactcgccggttcattctgcaagaggcacgccgtcacccattaacgggctccgacagcttgtaggcacatggtttcaggaactatttcactccccttccggggtgcttttcacctttccctcacggtactggttcactatcggtcactagggagtatttagccttgcgagatggtcctcgcgggttccgacggggtttcacgtgtcccgccgtactcaggatcctgaacagagagtgtgacgtttcgtctacggggctttcaccctctatggcacagcttcccaactgttgcgactacgtcgcactttggtaactctaatgttcagtcctacaaccccaacaagcaagcttgttggtttgggctcttcccttttcgctcgccgctactcagggaatcgatgtttctttctcttcctgcagctactaagatgtttcagttcactgcgtctacctcttgctagctatgtattcactagtcaagtaatcagcgactaagctgattgggttgccccattcggaaatctccggatcaaagcgtacttaccgctccccgaagcatatcggtgttagtcccgtccttcatcggctcctagtaccaaggcattcaccatgcgcccttcataacttaacctaaacaatcaaagattgtctgattaattgagttagcgattataattcgttaattaaaactcaaataacgcggtgttctcggtttattgttttgttaataaagaaattagatagtatttagttttcaaagtacaaactctatcaaccttatggttgataatggagaataacggaatcgaaccgatgacctcctgcttgcaaagcaggtgctctcccagctgagctaattccccatatgggcctaaatggacttgaaccatcgacctcacgcttatcaggcgtgcgctctaaaccagctgagctataggcccaaataagcgtcttataagttaaagttttaagaggtaaacctctcaaaactaaacaaagtttctccgatgtgtaggttccgttttattccttagaaaggaggtgatccagccgcaggttctcctacggctaccttgttacgacttcaccccagtcatctgtcccgccttaggcggctccctccataaaggttaggccaccgactttgggcgttacaaactcccatggtgtgacgggcggtgtgtacaaggcccgggaacgtattcaccgcggcatgctgatccgcgattactagcgattccgacttcgtgtaggcgagttgcagcctacagtccgaactgagaacggctttaagagattagcttactctcgcgagtttgcgactcgttgtaccgtccattgtagcacgtgtgtagcccaggtcataaggggcatgatgatctgacgtcgtccccaccttcctccggtttgtcaccggcagtctcactagagtgcccaacttaatgctggcaactagtaacaagggttgcgctcgttgcgggacttaacccaacatctcacgacacgagctgacgacgaccatgcaccacctgtcattgcgtccccgaagggaacgccttatctctaaggttagcgcaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagcctcagcgtcagttgcagaccagacagccgccttcgccactggtgttcttccatatatctacgcattccaccgctacacatggagttccactgtcctcttctgcactcaagtcgcccggtttccgatgcacttcttcggttaagccgaaggctttcacatcagacctaagcaaccgcctgcgctcgctttacgcccaataaatccggataacgcttgccacctacgtattaccgcggctgctggcacgtagttagccgtgactttctggttggataccgtcactgcataaacagttactctcacgcacgttcttctccaacaacagagctttacgagccgaaacccttcttcactcacgcggtgttgctccatcaggcttgcgcccattgtggaagattccctactgctgcctcccgtaggagtatggaccgtgtctcagttccattgtggccgatcagtctctcaactcggctatgcatcatcgccttggtaagccgttaccttaccaactagctaatgcaccgcaggtccatcccagagtgatagccaaagccatctttcaaacaaaagccatgtggcttttgttgttatgcggtattagcatctgtttccaaatgttatcccccgctccggggcaggttacctacgtgttactcacccgtccgccactcactggtaatccatcgtcaatcaggcgcaagcaccatcaatcagttgggccagtgcgtacgacttgcatgtattaggcacaccgccggcgttcatcctgagccaggatcaaactctcatataaaatatataagaacttgaatagctctcaattatctttgttattaagcgaattgacttcgcaaatgttttacttcaaatcacatcgtgattgaagaccctacacatttgattcgtcgaaactttgttcagttttcaaaggtctacccgttggctaatcaagcagccaatcaacatttttattatagcatatatcagattagcttgtcaagaagaaattttaaattatttttgattttcttttgatcgataactcaatcagcaactttattaatatatcatgttgtcaaatctatgtcaacaattatttttaacttttttgtcaaaccatctcaacagcgcttaactgttttgacaacgataattactatacatgggtttttattccccgtcaactgttttttctaaaaaaattaaaaagtattctcaaggtcatataaacagttaaaaacttcaatagcaactaggtcaatatcatcaaagcgaaaacgttcataagggcgatatcgaacgaagataaattcttccctactatggatataagttacatcacataatggaataccaaatttttcaaatgttcgtttctgtcgatctcttgaatcatcgttttgcatcgcaatcaaacgtttaataatcactaataattctgattctttcacaatgataatcctccttcatacaaataaaggatcgtgccttcacacaatccctttttctatctttttactttatcaggttttataaatacagctacaattccggcgaacattccgaagtaatatgtgagtagtcgccataagatcattgctaaaatcaattttgtatttgagtgaataaaacttgcaaagagaacggaaaaactatactcggctccccccgcccctcctggaattggaaaaagcgaaataatcataaaaattaacacgtgcaagctgagcaccatcacaaaattaatgtggtcaattccaagtgcaagcataataaagtatgggattgcatagtaaaagaataattgaaaaatagttactacgcaaaccttaagcagcttcttataatcttgcttcattcggagactctcttggtaaaaagtatccactttttcatttaagacaactttcatgtgctcatatcggttagccttcataaaaatggcagctggtttgataacgaggttcattagtctcttagtaaaactataccagtacatcaccatcagtaatccgacaattaccgctaaatgaatcaaaaagccaaatattactaataatgaaagagcatggagtttctccgcaataaaatgaaagccaattaacaagctgattaagaagttaacaacaatcattgcctgaaatacaacaaacttcattaaaagaactgaacttgctaatcccccatcaacacctgattgaatcattgcaactaattgcgctggttgtcctcctgttgagaatggagtaattccattaaatagttgttcgattaatggtaatcgtaatgcatccttccaggtaaaaccatcgtgacgatcattcataaaaatctttacgacaaccgcctccaaacctaaatataaacaaatacagccaagtgcaacgagcatccatccccaattaatggcagaaacatcctgtaacaataggtggatgtttgagttacgtaatgagtagccgagaattccaactccaataattagcattatgcttaatactaaccaatttcgcctgctcactaagcatccccctttcgcgcttgctcctgataaaacttagtccaaacatctgctaagtgttcttttgagtattccttagcagctcgctgggcctgagtttgccaatgtgccagtcgtgcaggatcattgcgtaataatgtcaacttcatttgcatctcattgacatctttagcaggctcataatccccttcaacaatagaatgataaaggtcaagatcgcgtaacattactggtgtcccacagctaaaagcttccaagacagacattggaaatagttcattatatgaaggtaaaagaaataggtcggcaagattattcagttcagcaatcttatcccgtgaaacgattcccgtaaaatgtaaattagctggtggattatctaccaccttttttaattcactataaccatctgttaaacggccaaaagaaaatccgccagcccaaaaaaactcaacgtccggattttggcgagcaagacgaataaagtctggaactccttttcgttcttgaacctggccgcttcctaataccacaaacttatcggcagcaatcccatatttttttcggagagcagttcgcttaacagccgaatatggatggaaacgatcattatcaacaaagttaggaatataggtaatctttttttcaggaatcccatatgctactaactgcttgataaaagagggattcacaactactaactgatccattcgtttataaaaggcaataatgtaatgataaaaaagcccgcgaaacggttgcgggattgtaagacttccttctaacgtctcgggaagaaaatgcacatagccaatctttcgaccccgcttttttgaaaaagttgacaggtaaaaaagagggtcgattgtatgataatgactgatctgactcttcccataacggttgatttcaatttcaaatttgtcactgcactggttgcgcaacaagttaattaattcaagataggcacttcctactccttgtcccgcaaccttatctgcagatgaaaacattgttattttaatcatcattagctccttgggcggtgaaaaagacgatgtgatttttcagcttgattaagttcatcatggacagccatatctttttgacaatcctggtagaactgaacaaccctttcaacaaagacctctgctgagatctcatgcagcttttgttgtcgtctcacccttgattctgagttttttggttggttaaggtaaaataggacaccattaaccaagtcagcccgtttttgaaaactaatgccaatcgctgggtcatcaatcaattggtcagtatattcactacgcataaccacaattggcaaatccgaggcaagggcttcatcataagtcagtccttgtgattcagaatcggaggctgaaacaaaaacatctgccatttggtaataatggtaaacttcatcatttgatatctcaccagcgaaactaacattgtcattaagctgcatttcacgaacttgacgctccagagtatgtcttgcgggaccatccccaacaatcagcagctgtgcatcaggcttgtgagcaagaatatctggcattgcttctatcagtgagtggatattcttttcatatgctaaacgactaagcgaaagtaaaactggggtctcttcactgtagcctaactttgcccttaaattagctatttcttctgctgaatctcgtttactatatacccgtaaattaatcccagtcggaataacacgaattggtgattcaacatgataactggttaaagtatccaaaacacggtcacttggagcaataatcccagaaatattttttaaataaagatgagcaagccgggcaacatcattcggcttaagaatatggccattcgcaatatagtggagataatcctgatacatcgtatggtaagtatggagacaagggatatgcaaatgcttggcaaccgtcttccccataactccaagcgcaaattcagtttgattatgaactatatctaattggaactttttagcaagcttgatggctcgaaatacgccacgcaccgcaattcgacgatcagaaaacgaaacaaagggaatgcttgcaaagcggtatatcccattttcaacatcatcatgtttagccttaggatcagttgtcgtaaaaatatatacatgatgtccctgagcaatcaattcatcacgaagcgtcttaatcgaagtcgccacgccactcacctgagggaaatatgtatctgtaaaaataccaatattcaacctaactgctcctttttcatcataagttttctagataataattagtcataactgctattatactaaagcattcactgaaccgcaaaacggatttaagatattttaaatcttcctcctaatagtaacaagactcgggaagcctgattaagatttctttacaaaatcttttaataatgagaataaaaaataaccctcttgaaatggtgaacaatcaagaaagttaatttcatttatcaaagttttacctgtggaacatacttttccactaattcttggaccgccacggcagtttcagcatgaatcgctcgatgaactaatggttgtaatttgcgcgtattcaactggttaattaaagagcgaacacgtaaaatctgactactgctcattgaaaattcatcaagccccatcgccattaatagaggaaccgcataaggattattagccatctctccacacattccgacccacttgccttcagcatgcgcagcttcaatcacttgccgcaccatccgtaaaactgctgggtgaagttcttgatataggtatgctacttgctgatttccgcgatcaacagcaaataggtactgaataaggtcattactgccaatgctgaaaaaatcaacatattttgcaaaatgttcagccataactgcaactgctggaatctctagcatcatgccaacttcaatatttttagcaacttgaatacctgcttgctcaagcttttctttttcatcgtcaagaattgctcgtgccgcttggaactcttcaattgttgcaatcatcggaaacataatggctaaccgtccataaacggatgcacgaagaagggcgcgcaattgaggacgtaatatttctgggcgtgccaatccaatcctaatggcacgaaaacctaggtaaggattgtcctcatgaggaagagcaaccatccccagctttttatcgccgccaatatcaagcgttcgcgcgactacccgttgtccgttcatcgctgaaacaaatcttttgtaagcattaaattgttgctcttctgttggcaattcatccttactcatatagaggaattctgttctcaaaagaccaattccctcggcaccatcctcttgagcatcaataacgtcagcaaatgttccgacattagctcccacttcaaatcggcgcccatcagcactcacagtttgcttatcttttaacgctccccacttttgctgctcctggataaatttaccggctaacaaacggtaatgctcaacctcttccttcgttggattgacaatcactttgccatgaatcccatcaacaatcagtaagtcgccatcatgaatgatcgcagtagcatccttgacaccaacgacagctggtaacgaaagagtcttactcataatcgtaaaatgagaagtccgccccccgttagttgtaacaattcctgcaacatatcgtttatcaaattgagcggtatcagtaggcgtaatattattagcaacaaagatcgcgcggtggtctaaaagtcctgggtctggtaaaggaacattcaataggtgactcaaaactcgtttggtcacatcacgcaaggcggttgcccgcgcatataaatattcattatcgttcttgcgctcaaaaatacttaaataataatcttcaacgcgtttaacagcccactcggcggtatcatgatggctattaatacggtcaataatcttcttttgtaaagtcggatcgtctaaaatcgcaatttgggtatcaataatcgtcactgcccgttgacctaacagctcatgggcacgcttagataaatgctgaaattcggtcttgcttaacgcaaaagaatcatgaagccgggcgacctcatgattctcatcagctgtatgctgtttttttatagatagatctgactctactaacaggtgtgccggagcaatcgtaataccactactagcggcaagtccggttagtagtatagacattagtcagtcaatccttccttcttcatagtttcagcaacggtgtccaaagcttctttttcgtcgtcaccattagcagtaatagtaaccttggcgttttgaccaacaccaagggacattacacccatgattgacttcaagtttacactcttaccttcgtatgaaagagtaatgtcagatgaaaactttgaagcagcttgtaccaaaatagtagctggacgagcatgaataccagtttcagaagtaattgtaaattcacgtttttccatattaatcagtctccttcgagcagatataattaatttattatcagtagcttgaccactgatacacctcgataattacattttagcaattgtaagcgttaaatacaaggctacatcttgcgatttatcgctctcttaattgataaataactttaccgcctcgctgcgcttcgcctttaatttgcgaacgatacgcatacgagtgaaaaattggttgaaattgctgaaaattctcaggggtaattacaaaatgatcaatctttttatttcgcaagtcatccaacaattgctcaaaattttcttctgccattcaatcacctcaacataaaattttattttcttattatacacgaaattactttcatctttctattttagcattcatggctaaagagtgctaaaatcaaagtaagctgttttcggtattcctaagtaacttagctatgcggaaaatcgctctttatttaagaaaatatttaagttttatggcttgctttgcgataaaaagtaagtataatattaatcaatggtcaagaaaggtcaaaaaattcttgatggaactatttaggaggtattaaatttagatgcaatgtcaatactgtcatcaaaatccagccacgattcatcttcaaatgaattttaatggacaacggattcaaatagacctctgccaaaattgttatcaaaaattacaaaatctacaaacagatatgatgaatggaggtaacggaatgaataatttcggttttggaagcctcgaagacttcatgaacgcaatgaacaatatgcaaagccaagctgctggtgctaatggtcaaaacatgaacggccaatcccaacgacaaggtggcggacgaaatggaaaaggaatccttggtcaatatgggatcaaccttactgatctcgctcgccaaggtaaaattgacccagtcatcgggcgcgacaacgaaattaaacgagtaatcgaaattttaaaccgtcggaccaagaataacccagtcttgattggtgaagctggggttggtaagaccgcggttgttgaaggcttagctcaagcaatcgttagtggccaagttcccgaaaagcttgctaacaaggaaattatccggctcgatgttgtttccttagttcaaggaacaggaattcggggccaatttgaaaaacgaatgcaacaattaatggaagaagttcgtaagaataaaaacatcatcctctttattgacgaaatccacgaaatcatgggtgcgggaaatgctgaaggcggaatggacgctggaaatgttcttaagcccgcccttgcccgtggtgacttccaattagttggtgccactactcttaatgaatatcgaaagatcgaaaaggatgcagctcttgcacgacggttccaaccagttgaagttgatgaaccatccgttgaagaaacaatccgcatcttaaacggaatcaaaaatcgttatcaagattaccaccatgttaaatacacagatgacgcaattgtagcagctgctaaactttctgaccgctacattcaagatcgttacttacctgacaaagctatcgacttacttgatgaagcgggatcaaagaagaacttaacgcttaaaaatgtggatccaaacgcaatcgaaaatgaaatccacacagctgaagcacacaagcaacaagcagctgataaccaagactatgaaaaagcagctttctaccgcgatcaagtcgctaaacttgaaaaggcaaagaaagaagctgaagaaaaccatactgaagattctgcaactgttaccgttaaggatatgcagagaatcgttgaagaacggacaaatattccagttggtgacctgcaaaagcaagaagaaaatcaacttcgcgaccttgataagaagcttgatgaacatgttattggtcaaacccaagcagtggataaggttgcccgtgccattcgtcgtaaccggattggtttgaacaagtctgggcgcccaatcggtagtttcctctttgttggtcctacaggggttggtaagactgaaactgctaagcaacttgcccttcaattatttggttctaaagatgccatgattcggttcgatatgtccgaatacatggacaagacctctacttctaaattaatcggggctgctcctggttatgttggttatgaagaagctggtcagttgactgaacaagtacggcggcacccttacagcttgatcttacttgatgaagttgaaaaggcgcacccagatgttatgcacatgttcttacaaattcttgatgatggtcgtttaactgattctcaaggacgcactgttagcttcaaggatacaatcattatcatgacatctaatgccggaactggtgattcagaagcaagtgttggtttcggtgctgagtctaatggtagtacccactccatcattgacaagttgacaaactacttcaagccagaattcttaaaccggtttgatgacattgttcaattcaatgccctctctaaagatgacttgatgaagatcgttaacttaatgattgatgatgttaataacatgcttgctgataagaacttgcacatcgaagtcactaacaatgttgaagaaaaattagttgacatgggctttgatccaaagatgggtgctcgtcctcttcgccgggtaatccaagaacaaatcgaagaccggattgctgattacgttcttgatcacagtgacgctcataaattagttgctaaacttgatgataatggggacattgttgtcgaagaaactgaagaagtaccaacaattgctaaaaaataattgagtataaaaaacgaggctgaattttttagcctcgttttttatatgctcaatttacttccaaacgacggcggacctccaatactggaagagcaaccattggaacaataataatcgccaatatcaattctgcaagtccattagtcgccatgactgtttctaaagcaattaataaatgattaacatttaccccataagtttgcgcaactgctggagtacgataaaatagataaataaagcctaatactaagccagtattagtaagggctcctactatcgcagcacttactgcggcaatatattttactttgaacaaacgacacataaggataaaagtatagccagctaaaatcccaatcataatgcgcgggacaacggaaacaagcgggttaacaaaaactaagggagcaagcggactacttggtgcaacaaatgctcgcacccaagtcaaaagcccccaaataccaccaataattgcgccatcaacgggccccaacacgattgccgcaataatgactgttacatgaagggttgtaatactaagcggccctagcggaatgttgccaaaaaatgggacaaaatcttgtaagagaataattgcgataaagattgctaatgtcgtattgtgcctaatttgttggtgccgtgtttttgccatttttcttctcctaaataaatttgaataggcttattgtaataaaaaaatcacctattcgcaattctcaagagaaatatggtcgttccttatcgtgtcagctactaaaaagcgctataataatagagaattaaggttacggagtgttaataatgattgacaagtttaaaacaggaaatcctatctgggtttactataatgatatcgattcaggagcaaaccttaccgtcccgcaattattacgcggattcatcggtcaagaataccaaattgaacaaaaacaatttcctaattaccgatacgtaaaaactgaaggtgaaactaagggaacatttgatatgcggcaacgaattgtgcaccttttttatcggaaacaaaattggggagaggttcaatcgattgaaatgtatctccacctcgatgcccctacacaggtatttgacacagctggtggaatgccagtcggtgccccccttcctgctgatattacagttaagtcttttcaccgggttgcaactaagaatggtcagttttggtatgaaatcggcgctgatcaatggattaaatacgatcaaatgcacgttgttgacaatccattcaaccaggatatccggaaagaaaaatcaaaacttattaataatttaacagtgattcccttgaagaatgttcaggccaaagttgattatctccataataagtcaatcaatgtttacgatgcgccttatggaaataaagtggcagagattccaaacggcgaaacaattaccctaattggaaaattaaacgataatgatgagattacctggtaccaagtgggccgcaaaaaatatattactagcaactacattcaaattgaatatccggaagatgatgaataaaaaaagcgagaggttgagaaaaagcaaaagttttttctcaacctctcctatttttacaaacaatagcaaaataacatggaactagcttcgcatcaccacaaggctcaaggctcaagactaatgctcactcacttttattaatcccgccgtaattgaattttattattaaagaatcgcgctaaagcataaacaatgattaagtaaataactaagattacccaaccagtaacgtttgagattatgattgatttaaagacaccactagcagaaagtgcaggaattaagccaaccagtgaataagctaacatcatcaataaaactaggcacgccattggaagcccaattcctacaatccatttccaccgacgatttaataaggcaaaaccattaccaattgccatcatcgttaaagaaaaaccgaagtaccataaaagactatgccaagcagaaacaagatcaaacggtgtattcattaagcccaccagttgtgcgataaaccaaactactaatgtcatcaggaaaagagataaaatccgcccttgccatagtgttttacgagaaataccgttttgaattgcccatttaaagtcagtataaggagttacaaggaaaatcgccattaaaagcacgcttaagattgatgaagcaatgcttggaagggcttggaggctaaccaaaaaagattcaaggttgtgtgaaataattaatccaagcaggtaggttattaatgcaattcccagcccccaacctaaggcaattcctgtagcgtgacctgcttgttgaaacatggttgaaataacaaggtttctcttttgattttccattagtattctcccccattcgttaagtaaatgaataaatgctgcaaatcataatgaccaatcttaacttgatcaggaatcacacgctgttcatctaagcgatcaagtaagtaggcagtcttaatattacccatcatctccgttttaagaatttttaagcctgcagtatactcatcaaccattttttccggaccactaattgcataagccttggctaataaactttctgtatcttcattaataatgatgtggtgttgatccatgattagaacatgttcgactaattgttgaatttcttcaattaagtgagttgataagacgaaggttcgcggccgctcttgataagtcttaactaattctttatagaagctatcacggtgattagcatctaaacctaaaatcggttcatctaataaaacgtaatcggcattgactgctaaagcaacgatcagcttggaggctgtccgttgcccagtcgataagttagtaattttcatccggtcattcaagccaaaaaccttgaggagacggtttgctagatcatagtcaaaattattataagcgacatcggccaagtcaaaggtttgacttatcttcatgtgacgcggataaagattaacttcactcatcaaaaagatcttgctgaggaggtcatcattgttattaacgtcttcattaccaatttttacttccccgctcgttggaaaaatccggttgctcataatattaagaagagtcgtctttccagccccattccggccaaggagaccataaattttagcaggttctaggataaatgaaatattatccaatactgtttggcgacggtactttttgacaatatttttaactattaattgatccatcattctcacctcgttcgattaagtctaataaatgctgcttggtaatcccgagcttacctgcttcaactagcaaactctttacatagtcgttataaaaactttctttacgttgttccataattttttgttgtgcacctttttttacaaacatccctagtccacgtcgcttttctaagaggtctttattaaccaaaatattcatccccttaagaactgtcgcaggattgatatgcaattgctgagaaagctgggtcgttgacggtacctgcgaaccttcatcaaagcccccagagaaaatcatctcttcaagctggtcagcaatttgctgataaagcggcatcgagtcattaaagtcgaaattcataagtgcacctccttttcgtttaacacttcattacttatgtaactaagtatatatgtaaatgagagatttggcaagagggtaaaagaaaaaacttcctgctcggctgaggaggaagtttttaatattattgatctatccatgatttctgataactgtttgtggatccaaccattcaccatggcctgttgcttgactaggatcattccaacttggaacaaaggaattctttaaatcgatgccatagtttggactagtattaattcctaagtgaagatgatcaaggtcacgataaccaattacttgaccggcataaacgatatcgtttggtttaacagtgatcttatcacggttactaaatgcttcctggtaaacatataagtattttccgtcccaaacagttgtaaaccaccatagaactttaccatcatcatcttttaccgtatttacatctaatactcgcccaccatgaactgcatgaacttctgaacctggatgatcttgagtcccaaagtctaggccatcatggaagccattcttacgaatattgctggtataaccaaatttctgtccctgatagtgccaaccttcaccagaccgtggaaatggccaactccaaccgtcattttgcggaagtgcacgagcaatcccatcagtaccaaaatcataacaatggccgtcaacccattgaataccagtatacatttgaccataaagctgatcattgtaaacccataagtcatctgggtcacgttgaacgtcataaccgtctgagaaatagtagcgattaccattaatagttcgccaaccagtagctactttcttagttgcaggatcatcataataaacttttccccagctagtagctactccatttgcatcaaagacataggtatttccatcgatacctaaaaacttagattctgctcgtgagccatcattggtaaagtaaaatttttggcctttaccactggtcatccactgattatcccaacgtgcaccgtcactaccgaaataataggtccgaccccaattagtatagaattggttggtataacgcgcaccatcggctccaaagtagtaggtgtggccccagttattatagaattggttcttatactgcttaccatcttttctaaagtagtaaagcttcccgttttggttcaagaaataatcgcgttgcatccgtccttgatcatcaaaaagatatgttgcatcgccaatagtggcaacttgtgaagttgcccgtactccatcgccaaaaaagtagtaactattgccccaacgattcatccattgattatcccaacgtgcaccgtcttgcccgaagtagtatacattcccccaagcattcttaaacttatcatcccaacgtgcgccgtcagctccaaaataataagtccgaccccaattggtatagaattggttggtataacgcgcaccatcagctccaaagtagtaggtgtgtccccagttattatagaattggttcttatactgcttaccatcttttccaaagtagtaaagttttccattttggtttaagaaataatcgcgttgcatccgtccttgatcatcaaaaagatatgttgcatcgccaatggtggcaacttgtgaagttgcccgtactccatcgccaaaaaagtagtaactattgccccaacgattcatccattgattatcccaacgtgcaccgtcttgcccgaagtagtatacattcccccaagcattcataaacttatcatcccaacgtgcgccgtcaactccaaaataataagtccgaccccaattggtatagaattggttagtgtagcgagcaccatcagctccaaagtagtaggtatgaccccagttattatagaactgattcttatattctttaccatcattgccataataataaactttattatcgactgttttaaagctatttggttgcccagtttcagtaatgttttgttctgaagtatcggtactttgtgcagctggagtaacaggaactgctcccttattatcattaccaactgtgctattactagtactttcagtattgtcgatgacattttcattactagtattagtttgagtctcagtaactgattgttgaacttcaacattactattatctaatgtagaatctgcttgaacagatcctacgcctaaaatcgtccccgcaagaacaactgctacagtacaccaaagtttaccacttttatataacttaaaatgtttctttaattccaagattattttctccctgattgataattatttaactacaactgcaaaacgtttaatattatatgaattttcaaaattacttgctgaaacccagtatgatcctccagcaggatcttcaacgtgataataacctggacgataaccatcaagagtcatcacatgactattattaacacctactccccagaaataattaccatattgaggggcagcccaatgcatcgtgacatagacaacaaccgggttaccattaagtaattgactttgtaagtcagtaggagaagaccctgaaatattctgaacattaccgaaccgtgaaccccattttgctaaaggttcgggataaattgattgaaagattccataggttactcgttgatatccgccaccgaatccttcattaggattaccatttggtgaaattggcatcgttttaataaatgattgaatgttgtagttgttggcatatcccttattatgaagcgcttctaacaaggctgtcgcttcacacgccatatcaccaacttgatattgattaatgtaaggcgcatttaataaagtaccattaattattccactatttggatcaacgtaatagttctgatgtccaagaataaaatcctgcttttgtagggcaccgtcatcaccaaagtaataggtatgaccccagttgttgtaaaagcggttatcccaacgagcgccatcactaccgaaataataagtgcgaccccaattattatagaaaccattatctaagcgacttccatctgcttgaaagtaataggttcgaccccagttgttgtaaaagcgattatcccagcgagcaccatcactaccgaaataataagtacgaccccagttgttgtaaaagcggttatcccaacgagcgccatcactaccgaaataataagtacgaccccaattattatagaaaccattatctaagcgacttccatctgcttgaaagtaataggttcggccccagttgttataaaactgatctttatattcttttccatcagcaccaaaataatatgtcttaccatttctttgttgaaagtaatctgtttgcattattccttgtgcgtcaaatgaatacacatcattattaatttgagctaattgattagtataacgtgcgccatctgctccaaagtaataactatgaccccaatttgtataccattgattcttagaaaggatcccattattgtcataataatatgttttattgttaatggtattgaatgtatttggttttccagtttcagatatctcatctacattattactttgagattgtggtattactggaacttgaatttttccttcatcactagtattttgatccgtaagagtttgattactatctgaagatatattctgcgttatttcaacattatttaaattttgattttctgttgtactatcagcttttgcgaaagtaggtgttactattaatagacctagagcaattgcagcataacaccatttctttccacttttgtatagcttaaaatgttttcttatttccaaaataatccatcccaactgttaattttaattaaacattattatcataatatatttttttaatttgaaaaacttttttcaagaaaaaattatctcttacagaaaagagaagtcgctatttaataacagacttctctttggtaaatttattaagcttttacttaaccaagccattttaaggatgcggtatagtttacaataataggttctccatagtttacattactagtttctacggatgcaagccagaaatcataataatattgatttccatctgcagttgtatacgttttgcttccttttacttctttaggtaaaagactctttacatcattaacagtactttcgctaacatctttacctttttctccagttaaagcttctttgatatcttttgaattcaagataccagaaaacgcattatcacttttatcagttattaaatctccctgctttagaggattatcgattttaatttcctcattgttaacagtattccaaacctgagatattttaatttgtaatggagaagttgctacttgagtacctggttcagaatcaacgactacagttgccgaataatttgcaattaatggttgtccatacttggcatctttatttgcagaaacaaacgtatttaccttattatttccgccttcaagccagtaaatatagtgataccgtgcaccatttgctgctgtgtatacttttgaagatattccatctttaagccgtccagctagcttagttaattcagcattaccaatcgattgaccatcatttccacttaattgagtagttccgaaaaggtctgtcgataactttgttccttcagttaatccatcattaggaataacgtcagtctcattccaaatttttactaattgggttgaaagagatgacttaacatttttggggctttcatatccatttaacattccattataaacgttcaatgattgcagtggatgtccatgatcatcaaataatgaaatattatcccaagatgaacctccccatgcttccttgccatcataatacaatactgaatctggcgcatatcctttggcatactgtgaagcccatcccgaaccataaatgttagacattaatttattatattgccaattattccacccagcctttactgggatccatgctggttcccaataaaaagcaccgagacctttttgtgcaataatcgcattatacatatcctcaatttcgtctacctgaccttgaggatcagcactatatcgatctatattagtagtttcattattttcaccaacggagttatgggtgccatctgcatcgttagtattatttagccatccagattccaaaatcaccgttcttttaccaaattcattccaagccattttttcaatagcttcaagatttactggtgtattagctccgtatccaagatcaacattatcataccacccattgccttgtgtggtactccagaatgggtagtacgaagttccaagataatcataatctacattatttttctttaagacattcataatcccacgatatttattaatttccggagtttctaattgaatagcaactttaatagttggatcaattctccttacagcggaggaaccagcttgaatatatttagcaacttgatcaccatcactggtttcccataatgaagcccagttacctccaccattacgtccagtgtaaaggccaaatgctccattggtaatttcattaccaatttgaaccatctttacagatgcaccagctttttgcaaatcatttaaaattttagaggtgtaaaggtaaacctcttgactcatttcaccatgagataaatttctccaagcttttggcaaaatttgctgtgctggatcagtccaaaaatcagagtattgaaaatctatcaataatttaagaccattatcagatgcttctttagccatttttatgagattttcttcattattgtctccaccagcatatggctgcccctgtgcattataaggatcattccagactcgcaatcgtacccaattgacacctgaatcctttaaaattttaaataagttcgattcttgcccattaaagtcataaaattttacaccagcatttatcagcgcttggtaactcgaaacatcaaccccacgaaccatatcatcagtcattccagggatcttttcaacctttacactatcataacgaagtcctgtgtcagtcccggtcttataagctaagtctaactgttcatctgttctttcacttgcagggaccttactctcattagagttagtaccagtttcttgaccgaatacaagtgttgcagtgtaatttacctttagctgatctccgtatttagcacccttgttaagtgcaaggaagttatttaatttgtcatcagctgattgaccttctagccagaattcataatgataagcatcattaccattatagtaattcttagtgccttctactgcagaagtattacctgcaaaagcagcaaaaattgctttaagaacctcctgactaataattgtacctttatctccttttagaagttcagcagttccattagtcaaagcatttccgagatctgcactattaactacacttcctttagttaagccattatctacgtcaacatttacgccagccttcttaaagatatctgaaatagaagcactaatcgtggaagtagcttgtggttgttcagctttttctcctggtttaaataaaataattactaacttatttttatttaggtctgccccaacaccaagcaccgagttgtctgcatttgtaaagtcataactattcataaaggtattagtaatcttttgaggatcatcatttgtaaaatcagtagaatatactactaaaaccttaccactcagtaagttattagcttgtaatttcttttcaattacatttttatcaggattagtatcaccttgagctacttcttgtgcaatatcatgaagcgctaattcttgataatcgttattggtgtttcgccaatcatatttaacacctttaataccttggttagtcaaagcctgagcaacttccttagctactgtatctctagtttgacccatatcggaagtctcggtcgcttcaccattatcattaaattcgtatcctttaccatcaatgactcttacctgattagtaaccataattccttgattatcaaagtagtataccttaccatctctatttaagaattgatcggtgtaacgagcaccatcggaaccaaagtagtaggtgtggccccaattcttgtaatattggtcttggtacataattccttgattatcaaagtagtataccttaccatctctatttaagaattgatcggtgtaacgagcaccatcggaaccaaagtagtaggtgtggccccaattcttgtaatattggtcttggtacataattccttgattatcaaagtagtataccttaccatctctatttaagaattgatcggtgtaacgagcaccatcggaaccaaagtagtaggtgtggccccaattcttgtaatattggtcttggtacataattccttgattatcaaagtagtataccttaccatctctatttaagaattgatcagtgtaacgagcaccatcggaaccaaagtagtaggtgtgaccccagttatgataaaacttattaacaactaatgatccatttccatcaaagtagaataattggttctcatttgctgttaagaattgattttttaatggaataattccttcattattaatccagtagttaatcccatttatacttttaagctggttttgaagaagcgccccatcattaccaaaatagtaagcacgaccccattttaccatgtaacggttatcccaacgggcaccatctacaccaaagtaatacgtacgaccccaattattatagaagctattatctaaacgactaccatcattttggaagtagtaagtacggccccaattattatagaaacgattatcccaacgagcaccatcggaaccgaaataatacgtacggccccaattattatagaatccattatctaacctagcaccattggcttgaaagtaatacgtacgaccccaattgttataaaattgattacgatacaagtcaccattttccccataataataggtactaccattaatctctttaaaagaattcggcgttgatttctctggaatactatctttaatatctgtattttcagctttaacgttaactggagttgtttgttcttcactattattagatttagtttgttcttgattaatctgttgacttgaatctatatttttattctcatttatctctttttcattagtactattcttgtttgtgtcagtaaaagttgactccgaattagaatcagtatcactagtattatcgttttttactaaagaattattagcatcagaagtagatgtaatagtatctgcatcagctaaaacactaggcgaaccaatagcaagtcctatccctaaaacagtagttgcgattgctgcacaacaccattttttaccatctttatataatttaaaatgcttttttatttccatgacttttccctttcaataacgttttacctaaataatataaatcatcttttaaatcatttcaatcagatacttaataaaaaagcggtactatacattttcaaattatgtataatgcaatgccacttttttattacaattattttatttataagcaactaacttattagcataatcattgatcaaagtttcgttttgttcattattgtaaatagcggtaagttcctttaatggaatagctttctcaacaaatttcgaatgagcaatatcagtagcagtagttggatctacatatttaataagcacttgcccgtcttgaatttccttaaagtagaaccaacttgttggatcacccttagcagtaatgaaactgtagccatcatttacgcccgatgtaacttttccataatacatcgtatggttactcaaacaatccttgaaccaatcagcattctgatatagaccgactaatgttccaagatattgagtataatttactctattaataccatttggaattaatgctccatcttcattaaaaagataattttgtccattaatatcttgtttaccagttacgggatatccattttcatcaaaataaattgtacttccttcatacataagccattgattgactaacatccgaccttcactatcaaaataatgaatatgagtattagaatcatctttatctaagaattggttggtgtaacgggcaccatctgcaccaaagtaataggtattgccccagttcttgtagtaacgattttgatacattactccatcgttatcaaagtaatagaccttgccatctttagtcaaaaattggtttgtataccgggcaccgtctgcgccaaagtaataggtattgccccagttcttgtagtaacgattttgatacattaccccatcgttatcgaagtaatagactttaccgtctttggttaaagattggttagtgtagcgggcaccatctgcaccaaagtaataagtattgccccagttcttgtaataacgattttgatacattaccccatcgttatcaaagtaatagactttaccgtctttggttaaaaattggttagtgtagcgggcaccatctgcaccaaaataataagtattgtcccagttcttgtagtaacgattttgatacattactccatcattatcaaagtaatagaccttgccatctttagtcaaaaattggtttgtataccgggcaccatctgcaccaaagtaataagtattgccccagttcttgtagtaacgattttgatacattactccatcattatcgaagtaatagaccttgccgtctttagtcaaaaattggttggtgtagcgagctccatctgcaccaaagtaataagtattgtcccagttcttgtagtaacgattttgatacattaccccatcgttatcgaagtaatagactttgccatctcttgtcaaaaattggttagtgtagcgagcaccatccgcaccaaagtaataggtactcccccaattatgatagaacttatttgtaattaatgaattatttgcatcaaaataataaagttgattatcatttgcagttaaaaattgattacgtaaaggaattatcccctgattatttacccagtaatctttcccattaacatttaagcttttattctttactaaggcaccatcgttaccgaagtaataggcatttccccatcgaaccatataacgattattccaacgtgcaccatcattaccaaagtagtaagtattaccccaattgttataaaaaccattatctagccgagcaccactaggttgaaaataataagtttgaccccaattactatagaaatcatttttaactagctgtccttctgaattatagtaatacgtattattatttattgttgaaaaagtattaggagctcctgtttcaggaatagtttgttgtgctacatctttattttcagttgtttcaggcttaaccggcgtctgattatcactttgagtatcagtgccagtactattattaccttgtagaggattagtattagtgggagttccagtagttaaagtatctgtagcaggtgtctcattattaggcatcatatctgcatgcgctatcgaccctagactaatacctagccctagcgaaattgtagcaatagcaactacacaccatcttttaccgtttttatacattttaaaatgttttttcattactatcctctcccaaaaagttattacttaattaagtatatacctctatataaaattattaaacctattacaactttgccgttaacttcacatcaggatacttttgcttaaaccaattttcagcaaattggttttcaaacaagaatagtggctgatcatggatatccttgactaagatgtttcgtgatgatgacatcttttcatctaattggtctggatcaatccaccgggcagtcttagttcccattggttccatgacaacctcggaattatattcattttgcatccggaacttgaatacctcaaattgcagttgaccaacagcaccgagaatataatcgccagtagaataactccggtaaagctggacagccccttcttgaactaattgattgattcccttgtggaaggacttttgtttcatcacattcttagcataaacacggacaaacagttctggcgtaaattgtggtaacttttcaaattgaatatcttttttaccattgtaaatagaatcaccaatttggaagtttccggtatcgtataaaccaataatatcaccggcaacagctgtctcaacattttcacgggtatcggccataaattcagtcacatttgataaccgcattggtttcttagtccgtgataatgttacatccatcccccgatcaaattcaccggaacaaatccggacaaaggcaattcgatcacgatggcgaggattcatgttagcctggatcttaaagacaaaaccagaaaattcgggatcaaggggcttaacaacatcctcgtcctcagttttgtgatcacttggtgcaggggcaaactgtaagtaggtttccaagaaagtctgaactccaaaattagttaaagcagatccaaagaagactggtgtttggtcccccttggcaatcttttctcggtctaattcattaccagcaacttcgactagttccatatcatccattgcatcttgccattcaccatcaccagctaatgggttatctcctttaacattaccgtcttcatctaatggtaagtaaggattattttcatcagctgggtgagtcaaggcaacacgttggttaaagcggtcatagattcccttgaactggtgaccagaaccgattggccagttgattgggtaagtttcaattcctaatacgtcttcaacttcatttaaaaggtctaatggttcgcgggcatcccggtcaaatttgttcataaaggtaaagatcggaattccccgcatcttacaaatctggaacaacttcttagtctgcggctcaatccccttcgcgctatcaataaccatcacagcggagtccaccgccattaatgtccgataagtatcttcagagaaatcttcgtgccctggagtatccaaaatattgatccgcttaccttggaaatcaaactgcataacagatgaggtaacagagatcccccgcttcttttcaatctccatccagtctgactttgcaaagttaccggtcttccgtgctttaacggtcccggcttcacgaaccactcccccaaaaagcaagagttgttcagtaatcgttgttttcccggcatccgggtgagaaataatggcaaacgtacgccgtttattaactgcttcagcaagttcttttggtgacattaaatttttcctttcctatatattatttaatttaaatctgggtaatatctctactatattattacaattttttatgaaagtctattcttagaaaaagttacagaaagtttaaagtcttacgatatatttgaacttgatattaattttctgctatattaataaagttagaacttattttattgaggtactttgtatatggataataacaataatcacgaatcacgggaacattaccgtaaacggatggaagaacgtatccaacgtgacgttaatgagcgtaaacggcgagaacgcgaagaagcacataataatcgtgaaaatcgattgcggcacgaagaagcacaatcatcaccagactttcagccaccgcaaaaacaccactaccgaactcctaattgggtacggctcctgattggtctcctaatctgccttgtggttgctggtggattttacgaatatcataaagttcactcagttgccaaaggagtgtttggcgctggtgatggtaagattagtaagaagctgcaaaaaggtgagcctgtctctgttcttacgatgggaaccgatgttggtgccctagatcggggtaacaagggtggtaataccgattcactagaattattcaccattaatccaaagaacaaaacaatcacaatgacgagtattccccgtgacattttagttcgtgtcgaaactagtgatggtccagactatgtcaaaatcaatgcggcttatgcaattaatggccctaagcaaaccgttaaacaagtatcagaactacttgatgtgccaatcgattactatgccgttatcaacatgggagttctcgaaaaagttgtaaactctgttggcggagttgaagtcaataatccatttgcctttgactatgaaggtcatcacttcaaaaaaggaaaacaacaccttaatggaacaaacgcgttgaagtactcacggatgcggtacgatgatccaaataatgactacggtcggcaaaaacggcaacaacagattctgaagagcgttatcaataaattcaaaacttccggatcaattggagcagctaataagattcttgatgctgttggggatggggttaaaactaatattccgattgacgacattgcaaccctttatggtaactaccatggagcaatgaataacgttaaaacgtaccatttccaaggtcaaaacgcaacaatcgaaggagtatccttccaaattgccagtccaaaagaaatcaaccgggtatctaaattagttcgtgcgcaactgggcttaaaagctaaaaatgttgttaatcacgaaactaagatgtacaagtcgcaaccacactacaacggatataatgaaactaacttcattcttccaggtggtgcaagttacaacgatcctggtagtggtaatggtagcgatgaggttactggctctagtcaccattcacaaactagtcaaaacgaaggagaaagtacctcagtaaacaatagcagcgaagcatacagtgaatcacaagctgttcctgctacagaaaatcatgcacaggctgctactacccaacgttactcaacaccgcaatatcacacttatcgcagttataataatggttatcattcaacctacactcacccagcatacggtaaccattatggatatacacatcgatattattaaagaaaaaatcttcgttgaaattaaatcagcgaagatttttctttactcttgttcttcctttattggatgttcaattcggtaaatatcaaagaagtattcacaaatggtcttaataaccgcatagaatggaatacaaagaatcattccaccaattccagcaatatgaccagcagcaagcaacagcataataattgttaacgggtggatttgtaatgtcttaccaataatgtttggataaacaatgtttccatctacctgttgaacaacaattacaacaatgattacccaaataattttatttggcgccattgttaatgccacaaataaggcaggtgcaatcccaatataaggcccaatgtatggaataatattagttagtccagcaacaattcctagcacgattgccaatggctggccgataattacataaccaattgatgtaaacacaccaacaaataggcactcgatcatctgtccggaaatatatgaggacaaggtggaattcatcttcccaagaagctcattcacctctttagcatgatgcggtgaaagccatttctgaatacttggaataagcttagaaccatccttaagcatgtagaatagcattacgggaacagtaatagtcacaacagtaacgtttgtcaacatcccgataatatcacccacccgttcagatagtccttgtagaactttttgagcatagccagctaactggtgatcaaactgacggtaataagaatttaaatcaacgttctttaaaaatgagtgttgaatagtatcattaattaaatgctgtaatccggtaactgtttgcggtaaatgacgaactaaggaagatatttcctttactaccggcggaatcagcatcgttatccccccgacaataatcacaattagcaacagcacaattaataaactagctagccccttgttcatccgaaaacgaccaattttaatcttcataaaaagctttaaaaccggatttaacatataatacaagaagccagagataatcaggggaacaaaaacaactgaaataaaagttaaaaatggttgaaatacaaactggattttcgtacacatccagattaaagttgctatcgacaataacattaacggccaaaaaagccaatgataaaatttttgcttagacatagatactccttaaataaaaagaatcaatatgtccattataaaagacatactgattcttttaaattataagtttaattacctgtaacagaattggcagtaacatggtaagtatgaccatttccagatacagtccaattattagtaccgttttgcgtagcagtgtaaccatctactgaatcaattgatggcaaatcatcagtagactttcctgctaccccacgatcatttaattggttaccaatatgttccttaacaatattccgcgcatcggtagcagtcattgttgactgttgggcattagagctttgttttacgcttgacttagcagaaccgccgttacttgatgtcgttgttgaagaaacagcataattagcattacttgatgagttacttgcactagaagtactattcttagaagatgcgctattttcactagtttgagaatcttcattactattacttgcagtttctttttcagaactaaccttatctttattagaatggtgcttcttagtaaccttacttgaggtaacttcagaactactatcagaattatcagaagcgctattattaccacacgcagctaaagttaacattaaggtcccagcagctaaagttgtaaataatttatttaatttcattaaacttctcctcgtttctatatcatcgctattataacagagatcattattaattacagttaactaattatatcagaattacatattgatgtagaagcttggcttaaagtattttgagtaaccgatctttacaacgtcacctggttctggggcatgaacataagtaccattaccaagagaaatagcaacgtggtatggtgcaccatcactaccaaagaataataatgaaccttttggcgcattcataacatcacgcttgtgaattcctaaagtagcttgttggtaagtagtccggtatgatgcccctaaaccataagcccattgaactaaaccagaacaatcaaaaccagctggggtgtttccaccccagacataaggaacaccgcgttgtgataacgcacgatctactttagcatcagtattattctttacggttaaaacacctgctgaatcagcatgatatttcttaccattaactgttacatcattattttgaactaaagcaccgtcattaccaaagtaatattggtggccccaattagtataaactgaattatctagacgagcgccatctttaccaaagtaataagtatgaccccagttattgtagaaactatcgtctaaacgtgacccatcagcttggaagtaataagtatgaccccaattgttgtagaaaccattatctaaacgggcgccatctttaccgaagtaataagtatgaccccaattgttatagaagccatcatttaaccgcgtaccatcggcttggaagtagtaagtatgattattttggtttaagaaataatccttttgttgttggccttgatcattaaagtaatattgtgagccgttgatgtctttaacaccagttgctttttgaccatcactgtagtaataagtgttaccattttctgtttgccaaccatttaattgagccggtgcagctgcttgaggcttaacggctacagcatcagtagcaatacttgtactggtgcttgctgactgagttacttgacttgccggttgagcaacttgactagactgagcttggttacctacctgtgatgtattatcagtagccgtactattattgatagctgtttgatcagaaacttcaacttgttgtgaagttactggtgtagttgctgcatctgttgtgtcagcattagctacactagtagttgatactccaaatgcaattgctgctgtagcgattgccatgtagcaccaatttttgcccttcttaaacattttgtagtgtttctgttctcccattattaataaatcctaccttccatttgtcatttcttttctttagataaatttaacgattattactttaccacaaataaaaggctggtaggcaaatctggctcttttgttaagcaatgataatgttcgcaatactaatgtaatgagaatgtcataatcgagtaggagataattgattagttcaattatcgacctctcacaccaccgtacgtacggttccgtatacggcggttcgacaacttaatcacattgaattgactggagcgtcttggatatattcataagtccaagacgctccagttttctattagttagagaatagctcaaggtcttactatgtgcagttcgccagtagcccttgcgggtactagcgaagacatatgcatcacgctgggacagccccaatttctgtaagttagttaccttagttttaaactttttccattgcttccagatatactgccttattcggaccctcaaccacttgtcgaggcgttgaataaagttagttagtttcccaattgagtagtactgaagccacccacgcatttttcgatgaatttcttcaaacattcttgtcagagatattccacgattacgtttagttaataacttcagcgctttctttactcgttgttgcgattgtttagctggacgggcgtaggccccattgtggtctacacccaacgaaaagccaagaaatttcaaccgtagagggctaccgactttggttttatctgggttcactttaactttcaagcgcttttctagaaactgggtaatgcttcgcattactcgttctccggctcgttgacttttaacatagatattacaatcatccgcatagcgcacaaagtgatgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttggagatacttaatcattaagtcatgattaacgttatcaaaataggcttttaggtctaagtcgacaactcttcgatagccttgattataaagatctactacttttgcaatagcgtcatgggccccacggtggggacggaagccaaaactattatcagagaaaacacgctcaaagataggcgtaataatttgggctacagcttgttgaaccattcggtccaccacagttggtattccaagtcttcttactccaccattaggcttcggaatttctacccgtttgactggtgctggtttatacttgccctcacgcaaactagcgatcagttccatcttattttctctgagatatggcagaaggtcattgactgtcatatcgtcaatgcctgctgctcctttatttctcttaactcgcaaataagcctgattaaggttattgcgatccaagactaagtcttggatagtgacactcatacctttaacttcaccataaccggtactacgcgcccttgtgtactttcggttttccaaacctatcctcgacaagaggtcagcttgttgttctgttttctgcgatcgtcgcacctgattacacctccgatataagttacaagttattgtcgttcagtccttcatctgattactcaaactactatgacctcggctgactcctgacttactcaacgctacatcactgtaccgcttgcttctgtggaaatttatcttattcctcttgtcggaagcttgtaagtcaggcctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagttcatggttccgactactacggcccatagcggactttcaccacctagctaatacccatgccgggcgcactagaaaagcagtccatatcaccaagagaatatgaactgctttatttttagataaaattaaagattaaaggctacgcggtcatagcgggttagatcataggtattaattacactacgtaatgaattagtatagctagatgctgttgcataaccatctgcccgaattaaataagtagctgtatttgcatcacgaaccccaattaaattatggtaacggctattcttaactaagaagtcagtatggtcctgaacactagcattattatctggatagcgacggaaagcatcattaattaagaccatccgtccaccgtactcttcataggttggcatattaactgacatacctttatagctccccttaataccaaacaaattgtggtattgtgaagcaagcgaagacttaccccatgcgctttcaagaattgcttgagcaagtgttaatgacggcaagatttgatgttgtgtccatccttgaatagcaccattgacgatactgccaataaaagcattattagaggttaaacgtccttgactatcaaagtcaagattaccataacctaaattaatagattgaccttgaagcaatgccccatctttgccaaagtaatatacattaccccaattgttcataaaacgattgtcccagcgagcgccatcactaccaaagtaataggtatgaccccaattattataaaaactattatctagacgagcaccatctttaccgaagtaataagtatgaccccaattattgtagaagccattatctaagcgagcgccatctttaccgaagtaataagtatgaccccagttattatagaagccatcatctaaacgggcaccgtctttgccaaaataataggtatgaccccagttgttatagaaaccatcatctaaacgagatccatccttttggaaatagtaggtgtgaccccagttgttatagaagccatcgtttaaacgcgtaccatcagcttgaaagtagtaagtatgattagcttgattcaaaaaatagttcttttgttgctggccttgatcattaaagtagtagtctttaccgtcaatactttgttgaccagttactttttgaccatccttgtaatagtaattattaccattatctttttgccaaccattttgagaagccgctgcctgtggagctaccgcaaccttactttcacttaaagttgcttgaacattgttatcttttgctggttgattaatagtttggtcagcttgtgtattattattgttattcgtcgatgcttgtgctcctgcttgatcagtagccacattatttggtgttgaaggtgttgttaatgatactgtattggtaacttgacttagtgcatctgctgaagcattacttacactttcagtatcattggctgtagtatctgcattaacactttgagaaacagatagcgtaccaacagctactgaaagcgtggcaattgccatgtagcaccagttttttccctttttaaacattttataatgtttatgaacactcattgacttatttaccccttttttatttttaacattatctatcctatcacatgtttttaaataagttctcattctattaaattgttactaaaggataatttttgaaatatttttgtaacttaaaagcgttgattaatataatcaacgccctatcatattattagcttaatttagaatactcataatttactaattgtagaaaatcattcatattatacccagtaccaaaataactgctagctcgattactccagtaaccatctggatcagtatgattagtattacctaagtattggctaacattatggtgtgaccaaagagttcctgttccattggactgagctaatgatggtgtcaatccgtacttgcgcatgttgtatgccgtgtagtaagcagcattaactaattcacgagcaaaattccaggcaccataaacttcaacctgttcaaattgaacagcacgaccgttggcaggatatgcagctccccatgcttcatgatcggtatcggaaatttgaataatgttattagcatcaacaaatgcatgaacaaacgcactattataatgctgcttttcgtaattaatttcaccccaaatactatcattgggattatcggtttcatgtactactaccatattaggcttaccgtctgtcgttccggagtatgaatggctacttacatcaggaattgcattaacatatgaaatattagcatgaccaataccattattcataatgtaactattaatcttattattgtaaactgagattggtaaaagaatcccactgttatcggcacgatagaagcttccattaacccaaattcctgtgccttgtactagggctccatcattaccaaagtagtaagtatgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcatccaaccgggtaccatctgcttggaagtaataagtatggttagcttggtttaagaaatagttcttttgttgctgaccttgggcattaaagtaataattcttaccgttaatggtttgttgaccagttaccttttgaccatctttatagtagtaactactccctttatctgtttgccaaccattctgtagagcggctgcttgcggagccacagcactcttatttgtggctgaagattgttgatcagtttgagtagttgaattagcctgatcatcttgcttagccgtttcacttgtactttgcgttgcaggtgttacttccgcagcaacatcagtcgtttggtcctgtgccttttgtgaagctactataacactggtggtattgactgtactatcagcacttaccccctgtgaaactgataaagcaccaactgctactaccaatgtggcaattgccatgtaacaccagttctttcccttcttatacatcttataatgtttatggatactcattgatgtgtacctcccctttttatttataatattatctatcctaccataattacaatttttaaaatttcatttttttagaataattttcatatcttatgtgaaatctaggtctcatctttacctctgtaaagattttacctatatactcacctaagacacttagtgaaagaagctgcactccccctaaaagccaaatcgatatcattaatgaggaccagccagaggtcgttcccccgctaaacttctgaactaacgtataaatcataagaacaatacttacaataattactaatattccaagattcattatcaactttattggtgttgtagaaaaagaagtaattccgtcaaaagcaaaatgtatcattttctttaatggatattttgacttaccagcaaatctcttctttctcttataaaaaactttagctgattgataaccaataagaggaaccatcccccttaagaatagattccgctctttatattccaacaaagctaaaacagctttcttactcatcaatctataatcagcagaattgggtactaactgtactcctagttttcgcattagtgcatagaaagccaaggccgtgttcttcttaaagaaagtatccgtttcacggctgctgcgaacaccataaacaatttcatttccttgatgatatttatcaatcatttcatacattgcattaacatcatcttgtaaatccgcatcaatagtaatcattatatctgaatattttgaagcaatgcttagacctgctagtagtgcattttggtggccataattacgcgtaaaagtaatcccagtaacatatgaataatgtttactatagtcctcaattagtgtccacgtattatcgctgcttccatcatccacaaataatattttgcttttagcagagacctttcccccatcgattaagtcatttaaaatcttaccgacttcttttcgtgtttccggtaaaacttcttgttcgttgaaacacggaataataatcgttaatatatcattcattagttttcccctatactttaactttttgttctattgaattaaactagtaatttttcacattgtttctctaggatcttaagattttttcatagaattgattcagctcttttaattgacttctaagcctctttaacttgctaaaaaataacgtttaatgggcctcaactaaatttgctaaaaagctagatactatatcaaataattttccaaatagctttctaataagaaaatcaattataatacataccgtaaaaaccaaaaaagacactattaatgcatttcctaaatagctaagccaattatttgcaaagcaatttgaattagcaatatgctgccatagaataggacggataaacgagtcctcgctgatcaagtataccccaaacattgacaaactaatctcattaatcactttgctataaaattcaaaccttgtgaaaaaaataaatatagaaattgccaagaaaaggtcaatcggattatagagtaatacaaaaatattataatgattatacaaaaaactgttttgagtacacaaatacatccacagtactactattattattcctataattagcatcttccagagattattacctccatataaaaattctagtccgtgtctttgaatgattccaccaattaaatataataacaagaaataggctcctgctgaattaccgaaaacatcatacgtaaaatcgggtttccctggaaaaataaatccgagagtcggcaatactgaccaaaaaagcactagtatcataaacgtatttagcaacattttcatactaaatttttgtaatattaggttcattgccggcatacatagtaacataaatatatatgctccaacaaaccaatatccacttggcaaaggaattggcaaaagtaattgtgatactgtttcatctacagacttaggaaatagaagttttagtaaaccgaatatcaaaaagctataaaatacagttattgttactaacttaatcggtcgcctaacactataacttttctgagacagaaaatatgcacctagaattacaaataaatctacccctaacttcccaaacaacaaaattatcatatttattcttaaagtcggtaggtttgctatagaatactgatgccaattaaaagtcccatgataggcataatgatgtagcacaattgcaaacatactaataattcttagtaattcaaaactagagtttcttcgcactttcatatagaactctccctacattttatcctttaaaataatacgttgtataatatctgcccgtttgtattgttttataagaagctttgtccatttttataccattttgaactatatatacccctctttttttactcttcaattttctattgatcggcaaatcaacaatattccattttccaaagtgattataagtcataaattctgatggctgagcatatagagtctctctatgaaattcataaggattaatttgttggtagaaaataggtaaaacaaaataggataatgaattcgtttgtctaatatcatggctagaaactaaaaatacattattataagacgcagcatgatgtatcatttcttttaattcacttggtgttgtattttcatagttgttgtaagttccgttattataatcattaacataagatttagcggcacccaaaaagaaaagagtaaatattaccatgaaagtaattaaactttggtaattatcaaatgcttccattattccccttgcctcaaagtaaagaattggaactataattgcattaaaatgcgtaaaattaggctgtatcaaaagtaagttccataaagctgaaattagcattatgaacataaaagtatcaagtaccgacttttctttaacaatataggtaataataccgatgcaacaaaaagaaagcattaatggtaaaaaagctccaaaaaattgtggagttattttaggaatcccgtcataaccattaattagcattttgatagaatttgttaggttattaataatgcttgttaataagtgcctattctcaatagcaaaagctgatcgagaagtggctaacttagtagctgtaaatcctccaaagaaaatttcccttttactaataaagttaacatagaggaaaagaattaatggaaggcattctattaataaaataataaatgagactagcacttgtttaatgtcaatctttccttttagaagaagccatgtataaaagcaaatagcaaaagaaaataaaaaaatccaattattagaataacaataagctaataatccaataaaaatcgttatagtaatcaaataagcatttcttgcgtacttactagtcgttgatataaatagaataaataaacttaatataactacgactagcggaataaacaaattactctcaatagcccatctgctagcacatatagttaccggacttagaaaaataactatcaatagcattaatctttgaatatttttaagtattcgtgtcttatataacgaatatgttagaagcaggattgagactaaattaataataattaatggtagtcgatacgtagtaatcgttaatcctaaaattttaacaaatggtactgaaattaagggatataagatattcattccagaaccccaggcatatagataaactggatttttcactaaatgaaaataatcaacaccatactttcccaacgaccaagagttaattcctcccattgcttcatcaagatccaaattaggaagcttatcaaatttataaattctaaccataaatgccaaaattaaaaataccaatagaaatattttatatttgatacttacttttcttattgtatcgttctttcttataaacacagctataaccaaaaaatatactattgtaatagtgaaatatattatctgcattacattgatcctttatttatctgccttaactactatccaattaataattgagtggaatataactaattaattcaattggcaatcactccacactattatacgtacagttcgccagtagttcttacacatactagcaaagatatatgcatcgcaataaaacaaaactaacttttgtaggtaacgtcattaagttagtgttttaatacttaatgtttgattttctctctgtattttgaaatattttagttaacttaaaaaccatctaattggcaattccctgattgttaattaggtggttttgtctatttaataaattgttatagcacttccattgtattcagaagcaacgctcccccacgaacgccaactatctgctcctgtatcataagcatttcctcccattgaatgcgcaccttgccctctgccccagtaacatggatccaatacgtggaaatagccattagactcaccaattataacttttgcatgattacgatttccatacatccgttcaaaggaagaaaatccataatataataccggatgaccagtggcaactatagaagcaatttgagataagtccttaccagaaatatcacgtacactactatctatatttttatatgcccaccatgctaatgctcctgctggaatgatacctgaaaaggcaccagtgttatacacaccgccagactgtggtacatggttataggcatatcctagattaaaaaacttacctttagtacttaataacattgccaatgcagctactgagcatccttccggtgcattgattggtgtaaattgactaaagtattgagctgtgcgcaaggaaccgtcagattgagcataccaatcttgtgagttaagaaatacataaccatttctcagcaaagcaccgtcatttccaaaccaatatgtatggccccaattactatatgtttggttagtataacgggcaccatcatttccaaaataataagtattaccccaattattataaaagcgattatcccaacgggcaccatctccaccaaagtagtatgtgtgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcatccaaccgggtaccatctgcttggaagtaataagtatggttagcttggtttaagaaatagttcttttgttgctgaccttgggcattaaagtaataattcttaccgttaatggtttgttgaccagttaccttttgaccatctttatagtagtaactactccctttatctgtttgccaaccattctgtagagcggctgcttgcggagccacagcactcttatttgtggctgaagattgttgatcagtttgagtagttgaattagcctgatcatcttgcttagccgtttcacttgtactttgcgttgcaggtgttacttccgcagcaacatcagtcgtttggtcctgtaccttttgtgaagctactataacactggtggtattgactgtactatcagcacttaccccctgtgaaactgataaagcaccaactgctactaccaatgtggcaattgccatgtaacaccagttctttcccttcttatacatcttataatgtttatggatactcattgatgtgtacctccctttttatttacagaattacctaccctaacataactacaacttcttaaatattttagaatgttttagaaaccccattttttaccttcccaatttcattttctattcaataatagcaaattctttgtaaattagaaatgctcaattaaaaaaacttacgtacttcttgcaatctaaattcaaattcccttctctcctgccgttgaatagcatctagtgttaatccactgtaaaaagagattatagctgctattgcgcaaaagccacatataataagtgtcggcatgtttgcaacaactccagtcatcctatatggaatccatacacgtggaataaatactgctatcgatatgatcatcagtattaacgatagtataccgtagaaattaaagggcttatgattccggtataaagtaaatattaacctaagaaccctaaatccatcggaaaaagtatttagctttgagacgcttcccataggccgatcacgataatcaattacatagtttttaattgccatattattcactatagcaaaaatactcatttctgtttcaatttcaaatccacgtgataacactggataagtcttgacaaactccaaactaaaagcccgatatccagtcataatatccttgatatcatttttaaagaaaaaattaatactccatcgtactagtttattaccgatcccatgaaaagctcgcttattttcagtaaaatagctagaactaaggcgatcaccaattaccatatcatatttatcttttaaaatgtaattagccattttaggtatttcttcagctggatatgtatcatcaccatcaatcataatatagcattcagcattaacttcgcgaaacattctcctaataacgtttcctttaccttgtttatgttcataacgaacaattgccccagctttttttgcaagttctgccgtattgtctgtagaattattatcatatacgtaaactttagaattaggaattgacgaaacacttttcaggcaatcttcaacaactttttttattgtttttgattcgttgaaacagggaattaatatagcaattctatccacttaacattcatccttccttacatttcttatatagtaaatattatttttaaatatctcaactatattcacaaatccaattcctgctaaagtagtaatgaatgggagaaattgaattaggtatctacttcttccgccttcaaataaaagcaaaaatatcattccgccacttactacatactttaataactgtacttctatttgcgaattcggtaaagtagctaaaatacacaatagtacaactatccatagactttgtacaattaaactattcccagaccaatcctttcctgaagtatccgaaacgtatgttttttgaatttttgctatcaaaggattcttagaattcgaatatggtatcaaaaagccaacttcgccaccatcatttcgccaaccaaaagtagcatcagacgtattagaaatttgtttattgaataaaaacttagtatagccgagcacttgtttctcgtgcaatctttcttttataaggttaatgttcatttgatttcttttactttgatctttaattttttcattaagcaaaacatcctgttcattatatcctccaccttgtgctagtcccattgccatatagtgtgtaagagtcatggctctttccttttcaacttttacaagactggtatgagaagctgcactgttgaacacaggaattataattaacggtaaaattacgaaaataattaaaataaaaaaatgctttttgctgatttttctattcgtcatctcaacaaatcccattaatatccaagcaaccatatataccatcaaactcggttttactaaataggaaatagctaataatgtcccaagcccaaggcatagataaccttttttaccaaaattagatgttcttataacacgataacccattgctagggtaatagtactaaaaaataaggcccaaatatcactatatggtattgctattagtggagaaataactattaaagtccaaaagaaaaaagctgagactacagatatttttttgccaaatgttttttttagcgaagagaataaaataagtaatgacgtatccaataacagcaagtttataatattaagaatcttagttagtgttattaatctagggtgccctgcaactatataaacaaaatgctcaaaaaacagcaataataacgtatttggataaaaagaaaaatagtcttttacccaataactatgaccagcagctgctctcactattatagaaggatcccatgtagtacttccagctagcgacatcacaatcataaattgccaaagaatcgtaactagaaaaaatagaactagaaaaacgcgtttattcaatactataaattttcttattttctttgccaaataaacgctctttccccaatatgtacctataaaagctatcagcattatcaaaacgatactgatcaacactattagtttagaggatcttccaataatagtcggtaaaaccacaatggcacctattatagatactacaactaaaattactagaaagaaattaattattagattacttaatcgaattagcttcatgctcttccctccatcattttttgactctctgatatcataattccaacacataatggaacaactgaaacaatcgggaaagcatatctatataaaacaacagggcctagtaaaaatgttcctagtaggcttaaagttaaaactattaggaaaatatattttctttccttaaaaataatcatccacgctgtaaagaataataagataaaaacattaaaaccaatgctatcaatcatcgatattacaggaatacgctggtttggataactattaacaaaattagtatagaatttatataacggttttaaggctttaggtgttgctactctttcatgatgccatgctttctcatttttgtgttcttgcttaacgtacgatgaatattctaagaaatacttgtaatagcttcttcgatccggataagaggtatctgggtaccaataaccaatagtcatcttagcaaaagcattcaaatattcattaggattttgttttgctaatttgaaccataatttccaaaaattctgtttgttttttatatactggtcggaattaaaactagacttaagtggatcagataaagactgacaattttgagattcatacattttataatttggaatataaattctaacttgatttacctcatctgaagtaatatccaaatttttttgtgacgcaacacttgaaagctgcataattggaatgctcaaagattcacgtaccctatcctctttatctatatgcccatttagacttcttgtcacggggccattatagataactgttccaaaaagaattgcaatacaacttaatagcagctcttttcgaatacttttttggaaaagaaatgcgaaaacaagagaaagcgtgataacatatacgccttgattttcaaatattaaattaatgagagcaaataaaacaaaaatggtccaatactttaactttccgaactttaataaccaattttttctttctaaataccacaggactagaataataaaactagctgtataaggtacattttttgttacagaaatcgacattatgcctatatatggtgaaaggcaaaaaattacaaaaaaacatatacgaatagcatagtttaaatttatttttcgtagatattctaatactcgagaataagcaaacgagagccataagatttgtaaaaacgtataaataaacagtccttgtgtctcgccacctaaaatatttctaccaatttttaatacaaagaaaattagtagttccgtatgtgcaagtggatgatgaagataaatttctctagtatttagataactttgtaattggtatcccgcatcataggcgtaattacctggataggtagcaaatagttctattagccaaaatattatcataccgaaccaaagcaacttccacgtttccctgcaattgaagaatctttgaagggcattattagtagagaaaatagaattgagctgcggaagagaaagatatatataattaactattacaaacaaaagaggtaaattccctatcacctttatccatgtctttaacgacatgaaattcacattattataccgatataaatttactccaataactagtaatattgaataaatagttgccaaacataaaagaacgaatattgatcttcttgaattttttaaaaaatcagttgaactatacaatttgtaaattacaacaaatagtaaaacggaactccaactatttgtatatgataaaccttgattaggatctttaattaagtattgaaaaaacacaactgcttcaaaagaaagaataaaagctaacaatttatacagactttttctattttcttctatcatttttcttcctttcttttttaactaagaaagtctttaattcactaaaagggtgttgccgatgcatataaaatgatcttaaaaaaggtatgtacggcatcattaacgcaataatcgacacaaataatattcggtatacaacaccaaaagcaatggctggtaaatagccgaaatgattatttaccatttgaataaccttaggccataattgtacataatcaagatcaattaagtggaaacataataaaataagagactgttctccaaaaaataaaaagatcctttcaaacacctctattacactagcagttaagttttctatatacatactaaacttcataactactatacttgacgttatcccaactggaagcgcaatataaatattcgttgcattgaccccttcaaaatcaaataggttaaaaaatgcatcccaaatccacaataatagcagcataactattactaaccaattcaccttggatagaatattatacttttttatcaaataacctgacatgagaaagcactgagctattaacgcaggttgtactgaaaacggcaaaaagaaatatttagctgtttgaacacctaccaaagttaataatattattaccataactttgtatcgtacttttattttgagtttcataatcaaattaaaaatttgattagcaatgaacattgccattaaaaaccaaatagcacctatagcttttatttttatagatgtatctggaataaagacatctccacctgctccataaatagcagagaagaaaaagtctctaaatgatgaacccctactaggcgcaattatactgttaggaaccattctgtaaaggaacaataagataaatccaatcgcaactgttgcaatgtaaggcattaataggttaaaaaaattctttttttctagtgttttctgattttgctcatgatataaatatccacttaggataaaaaaaattggcatatgaaaggcaaaaaggaaattacccaaatatccaggccaatagttgcctaacgaatgtcccgcaacaactgcaataatagcaattcctcttgcaatatcaatccatgcaattcgtttattttttgtattggttttcatctatcttaaaatccatttccttttaaatttagtttcctccagaagaaagcgaaaaatgaaggaaagtaatagttaagccaataaattattttatctcggctaggtaaaatatcattctttaaaaagtcataacgatactttttttgattgtttctcaactcatccatcaatttgggagaaatttcttttttattaggagctaaataaatatttctgagaatagaggttgaactccatagaattgatgcattaatggcactcactactttaggataattcattggctcaacaataagttttattaaactataagtttttaaaacatctaaggattcttttttaaaatcactaccgtacttattagaattaatttggctatcagaattaactatataatgatatttcacttcaggatttaagctaatacggctacaatgagataaatatttacaacagaatagtaaatcttcagcaatcttaatcccattatcaaagctaattttattctctcttataatggataatttaaaaagtttattccataagtatccttcatagccggtactaataaaaatatcatgtaatgcttcttcacgacttaagttttgctttgtacctaatcctttaaaacgaactatcccatttttttcttctttgcagtatccaacaattgataaatcacactgttgtttcttatattgatccaacaataattccaagtagtccttttcgacatagtcatccgcatctataaaagtcacatattccgaatttgccaattcaagacctcgattgcgcgtatctgaagcaccagtattagatttattaactacctctactctgttatcatctttatattctaacaacttatttaacgtaccgtctgttgaaccatcgtttaatacgattattcgatatttttcttcagtggtttgattaagtaagctataaaggcaacgatcaatcgtatttattgcattaaatgccggaataataatgttaattttctcttccatctgttcttctctcttttaatattttcttaacttgatttactattggtgcacgtaaagcaattatacaaatgatataaatcaaggcacccaaagcaacctgtaatattaagttagctattgtcatattcataatattatcaattcttgatacaactaaatacataaaaaatccacttaaaatatatcgccatataggcgcaaataaccgtctacgtcgtattgttccttgaatataccatagctgaacggctgttactgaaaattcagaaattacagtagctactgccgcaccatttgcaccgtatcttgaaattaaaaagaggtttgtaataatattgactaccgctccaacagttactgaaatagtaaattcgtgttcacgatgaattggcattaaatattgggttcccgtaacattactccacgcaatcatcaaaatagcaggtgcttctaaaaagattacacccccagtcggctcgtactcatgtcctaaaaaccaaggtgcaaatttataggcaatcgccattaaaccaaacatcatcggaactgaaacagcagttacaaagtcaaatgatttatataaactatctctaacccctttaacatccccagaagcaaacttatttgcgatgtgagggagcattacagttcccgttgcagtaactattgctaagaccaatttcacaatattatctccaaaattaaattgcgaaaccgctgcttgcggtgccatgcgccctagcataatccgattaaccactaagtatatttgagtagtgattgttggaatgaataataacaaagctggataaaaatgttttaacggatgccattctttaatttttacccattgaatattttgtcgtaagtatggccataatgtaagactacccgctaattgagcaaatcctaataggaagatatatttcgctaaatcgccttgattacgaaccataataaaaatcaaggcaatcgtaattaatttaacaattgtatttctggaaacagttttcttgaaatcttccattcccataaaataccacgaaacatcaatcccgtaagcaacaatccataaagcttgtaagagaaaataaaccttaaatgcgctactgaataataaaaccgccaataagtatattattagtgcaattgaactggtaaaaatctgaagagacattatcccccaaaaagtttttgaccgattatatttatctcctcgttgataggctatttctcggttaccatacaatgaaattccaagttgtccggcaagatagaaaaaagttacccatccattcgtataagtgttaattccgttattatttgcgcctaatacccgtgatacatatggagtggtaatcactggtgccaacattaataatatttggtatcccgcattatataaatagtttttaatgaccttcatacaataacctcgtctatcctttcaaactaaaaactaattttaccactgtcctcttataaacaaaaggtaaccttaatcaatattaaaaacgacgagttaagttttcccactcaactcgtcatcaggatttattcaaattctttattaacagccgtcaatgctgcatgcaacacctgatccatgttgtaataacggtattggcctaaccgaccaccaaaaataacattatcagccttttcatcagctaacttggtatattgcttgtaaagatcgttattccgttgattgttaatcggatagtatggttcatcaccacggtgccagtcagcagggtattcacgagtgatgatcgttttatccttatcacccttgccgaactcaaagtgtttatgttcaataatccgtgtgtatggtgtttcggcatcggtatagttaattaccgcgttaccttgatagttatcaacattcttttcttcagtctcaaaacgtaaacttcggtactgtaactcacccaattgataatcaaagaactggtcaatcatcccagtaaatactattttcggataatcttcaaggtacttagccttttgatcaaagaagtcaacaccagtctcaacatcaattaagtcactatcaagcatcttctcaacgatctgagtgtaacctccaattggaatcccttggtaggtatcattaaagtagttgttatcatagaccaaacggactggcaggcgtcgaatgataaaagctggcaactcggtagccttttgtccccattgcttttcggtatagcctttgatcaacttttcatagatatcacgaccaataagtgaaatagcttgttcttcaaggttctttggttccttgccagccattgcttgtcgttgctcattaatcttagccattgcttcttctggcgtacgaactccccacatttcactgaacgtattcatattaaatggcaggttatacatatgccccttgtagttagccacaggactattcgtatagcggttaaattccgcaaattgattaacgtattcccaaacttctttattagatgtatggaaaatatgggcaccatattggtggacttgaattccgtctacttcctttgtatagatattaccagcgatgtgatcgcgcttttcaattaccttaacgcgcttacctcgcttagcagcttcgtaggcaaaagtagcaccaaaaagtccagcacctactactagatagtcataattattcatattcctacgacccaactttcataattttttctactgctttattaaaatttaataaatacacctcaggcataaatttttttgaagttttttgaatcattaatggtgtaggcatttttttattatcaataattttttgtattatttttgttaattttttactattccctgatggataaagttctccattataattattaattatatcttcagggcctgtactaatatcagcactaatgcaataaactccgtgagagatagcttcgcaaagaaccattggtaatccttcatatttagaagttaatattagtgcagttgctctatttattacagaccatggctttttaacaaagccatgccatattatatttttatctactcccaattttcttgcatactcttttactggcgtcgcttgagcagtattcccatatatatctagttttagctccccttttacaccagataatgcatttaataattctcgtaaatttttttggccatctagcattactctaccaatataaagaaaatgtggagtgctttgtggcctgttaatcaaacgtaaattagttgttatcggattaaaaattaagaaaatcctatttgaactaattccacgttttttaagctgttcttttatcccagaactaatagctaaatagtaatctgcagagtttaaaaatatatgcttaataggcttttgatcaatcgaatagtgataccaggcaatcacaggtgtcttcctttttaatagctttaaactctttttggctaaataccaaatcactggattagttgatataacaaaatcaggattttcttttctcaaatagttaaagatattaagcggcataatcgttaacgcatataaatcacgtaaaaatcttcgcttactaatccacttaatatctatttttacgttttctgcccagctataatcaaagcttccaccaatagagtatacttttaactcaaaagcttgttctgacattaaacgtgccttaaacaaattttttataaccgtttctgttccaccaaatccagtcataaatggtacaattatgatcccttttttcataaaaattccctttaccaaataattgcttcgatgtttgcaatagctttttttatatgattaccatttcttaaatcatttgaaaaagataacgcatttttcttgactaaactaaaatcactctgggttatactacttaataaccctggtaattcataaaggctactaatagtatatcctagcttatttttagaaataatgcttgctatcgcagctttattccaaacaataattggaatacccgtacttaaataaagtgatgccttatgtggacaattatactgtaaatattcaccatacattccattgcactcttcagcactagagccatcccaaatcaaaccaaagttttctgttaaatgggcaggcaattcttcaggagaataaactcccttatatttaacatcgttatccgtcactccactaaaatttggtccataaacatccaatgaaatctttgctggaactttagacaaaaattgagccttttttaaatttccagcaaaacaaagtgtctttgtatattgataattattgttaacagattgaggatttaaataatcaaataatcctaatataaccatcggagttgtaattccattatctttaatccactttgccattgtattattatgaactatcaggccatcaacttgttttaaccaattaatttcctccggtttatacgttggatcatccttataagatcttagagattctaaatcatgaataatcaaaattaattttgcctttgtataagcacgaatatctctaataaacgcattcattaaggctcgtgaataggttggaaattgaaagaaaatttcatctgcttgtaaatttttcattaatctaggaatattccaattgatatatttaaattttaataattttgaatgccagttaaatcttaaattaattacttgaaatccctctttttttaaaatcttatcaatatctgttttagctttaggaccagcattatttttatcaatttcattaacagaaataattactctctttttttcattaggcacttttttgaacctactttcattttgaattaaattctttagacgtaataaaaacaaaggaaataattaaaccaactaagccccccaaggcaactccgacagctacatgcttttttattgaaggagatgtcttacttgaagtatcacttttcgttgctttatcaacaattcttacattttctacacctggctgtaccttaggcaattctttgacaaaggctttagcagatgcatttgcgattgttacagaatcttctttggattttgtagttgcttctaatgtaagtactaatgattgtggttgagttttagcatcaatcgcactatttatatcattttgtgaataatcttttttcatttttgaagaaagatactgccgagcttctttagaaacagtcatattctttgcaatttcttcatatgttggcatcatatttaaatctgcattgacaatattgtcctgactcttattatcattaatctttaagtcatgggaaatgacaatattagttttagcagtatacgttgttgattgatgtctttttgcacgaatccccattattcctcctccaaggatcgccaaaactataattataagtaaactcttccaaaaatttctatataaagtttcagatttcacgattttcctccaataatgttcttagacttgtcttttgcataaacctctgctaatagcgcgatcaaaaacggatcataactaacatcaagaagcctttgttctacaactgcgctaatggatataactactaaaactgtcgcaagagcatatttctcattgctaattgaccgaaacgagataaacgtcattattcctaaaacaattaaaagtgcaattattccatataaaatcataatccgaatatatgatgagtcaataaaaaaatatttactttgatttgtcataaacattctcatcccagttgttcctccccaactgtgttcaaccatatgttgcccaaagatggaaaaaccatactgctcaaatcccttttttccaagagctaacctaccggataataagctatttatcttttctagaattaaattagatttattgtagaagtaggttattaaaaaaattatatatgctgataatattggaactgaccagtagtaattagctatcttttttgcaaacttctttcctcgttgtgacgctttacctattatcataacaggaattaataataggagtgatacggcacttaaacgagcatcacaaaagtaaataagtagatatgcaagtaaacaaaatacaaaatagctttttattgatattttctcaaagaataaataacagtatgctaaaacaaaatataaaacatgtgcagcaaagtctgttgggtaaacaacaccaaatgattgtctaattgttccagtggtttgtcctctgcgataaaccaaattctgaattacaccggttaatgagctgaatacagcaagtgttaatataattattcctacataaaagtacaaataaataattctatcaaagtttactcctctagcaccaagaataaaaattcccattgaaaatagcataaaatctgaggaagttcgccatgtaagtactaaaaagcctaaaacaaatatatctataaggaaattttttattgtttgttgatcaataaaaaataatttaaaaattatcatccccaatgcaatatacgaaaacatatgaaacgtatttttagcgaaaaaatccataaaagttgtaaattgtaagaaaaaatcagtgaaataaaatacaaatgcaacttcataaattaattggccatttatatagaatttatttatttttaaattattcactcaattatggtctcctctcctaatacgcgccatcacgcttaaaaatactaataatgttcttaaacattatctttgtatcaaaagcaagtgaagccttatcaacatactctaactcgacatcacagcgttctggatatggaatgttgctccgaccactcgattgccacaatcccattgcacctggttttactgataaaaacttatcaacccgatcaccatattcttcaagttctttttttacaataggtcgggggccaataatgctcatctcgccacgcaagatattgataaactgtggaatttcatcaattgatgtttttcgtaaccaccgacctaaacgggtaatccgtgggtcttcttctggctccagtttatagttattggcaacatatttagcatacatttctggatcattttctaaaatcttatccgcattcacaatcattgaccgaaacttataaatcttaaatggtttgccatgccaaccaattcgttcctgcttataaaataatggacctttgttatcaccaaaccgattcattataaaaatagtcagaaagactggactaaaaccaatcattgctaatgacgacagcgtaatatcaaagaaccttttccagaaaaggtatccctttgattgttgtttaatttttaccttctcattcatgattctcaaccctactttttctctttaataatatatattggccgtttcttggtctgcatatagatccgaccaatataacgacctactattccgaggcaaagtaactggataccacccaggaataaaataatacaaaccattgaagcccagccaaaagcactactagcaggctcaataatctttcttattataacaataatcatcccgataatggagataaatgccgttaatccgccagcccaggtagcaattgctaagggagcttctgaaaaatcggtaatgccgtcaatcgcatacttaaataacttccaggtcgaccaatctgttgttccagccacccgttcgacatttttatagggaaggtacttggtcttaaacccaacccagttaaaaataccttttgagaaccggttatattcagttaatgacaacaccgcatcgaccatctggcgggtcatcattcggtagtcacgggttccagagacaattttagtatcagaaattttattgataacattataaaactggttagaaaggaaggacttaaactttgcctcaccttttcgatctgtccgccgcatccccacgcaatcatattcacccttagaaatatcctgatacatctctggtaaatactctggcgggtcttgtaaatcagcgtccatcacaacgacataatcacctgttgcgacctgtaagccggcataaagccctgcttctttaccaaaattccgtgaaaaagaaacataatgaacccgttctggatcttgtgcgtgcagcttgcgtagttctgctaaagtgtcatcactcgatccatcattgacaaaccaatattccgtttctactggcatctgtttaactactttttcaactgctgggtaaaaaagtggaatagtttcttcctcattataacaaggaacaactattgacaattttggcattcttgtctctccaatcgttaatgttcaccatgaccggtgactttacgttttaagaacttcacaatctttaatggccagttttgcttttcaagaaatacccggttaacttccactgtcttgtattgcggattagtcaacaaccaagtatctagtaaaagctcactcaaaaagccaaagacccgttgctcatatggtgtgtagtcagaataatcaacttttttctcaacttcgcctaaaacatcaaacagccaggtacaatattcatccaacggctgcttcttcataatcatcatgttgaaataatgagccgatgtctgtttcattactttttcaaaagcaggtaagtagtggggatatttatcctttaacacctgccgcgtaatttcaagcggctcgtgctcatgaacatggaggtaatgggattcatttgtttcaatgtaatagtgccgcttctttggcaagattacatcggcatcttttaataactcttcaacttgtccatgattgaggatggtcgaaagatcctttgagtgtcccagcgtcaagtaacgacggtagtggactaatcctaatgcatccacatcatcaagatttttccatccccagtacaaagctgttagctcattgtaatgcggattcttttttgaaatattatctccggtattatcaccctgaaatgtatgattaacagtcgggtgaatctctttaccaacaaaaactggtaaatacattggatcatctggcatccgataatttttatggacagccactaagattttaatattcactattgtactcctaattattgtttttaaacataatcattaaaataataccagtaattcccaatcttggaaagttattattggaaatcctgcgcagctagccagctctgcacgtcatccagatcaaagcccttgcgatacattgtctgcttaaaatgctgctcacgctcgtatccttgataacggagagcacgacgccattgcttcgctgcttcttttgctaaaaggtcgttctcttgctccagatcaggttgtggaacaacttcatccttaatcatttcatacacactactagagaagccttttgtcatgagcccctgttgtaccttttgttctcgtcgccgctctggctggttccgataacggcgaaatagttttacagctaacttctttgctaattctgcttgaacttcgggagtaaattgcgttaaagcatcatcaatatcgttttcgccaatccctttttgtcgtaagtgttgacgaattaccccaggccccttcaagtccgtgttaatcatcgtgcggacataagaagccgcataggcatgatcatcgattaactgttgaccccgcagctttttcaagattggctcaacaaactcttctggcgtatcaatttcttttagcttcttaacgatgtcgctttccgtccgcatctgataagaaaggtagtcaagcattcgtgaataagcctttgcttgctggtcagcagtcgcaatggccgcaatttgcttttcatctagctcagttcccttcatcaaacgaaactgaatcaaaacactttctgcaaccggaaaagcatacttaccatcaaggtatatattatatcgacccttccgtttttgcgtctcaattttcgaaatttttgccatttttaaatttctccttaacattctcaatttttaatcgtttataaaggtgtaagcagtggccgctacttaacaaatcaaattaaacaaaggaagtttttatcatgcaaatggttcgtaatttcaaatccgctaaaattcagcttaccctcaccaacagtgaacatcccaagggcgttaaacatccctttaacaacattattgaggatgtcactaatgagcaggtagcacaatttagtgcggcaattgaaatacttactgctgaaagatgccttgatacagacattatcgttactagtcaagttgcaatgaacaactaatttcaaggaggaaattaatttatgcgtacattaagcttaactttcaagggtagtcttggtaaaaaacattcattaaagttgaactatgccagtggtgatctcgatgccgaaaccgttcggaaggcaatgcaagaaattgcgcaaacccacctctttactaaggaaggcgaagatatttatcagcaacctctttctgcaaaatacattgatactgtttctaccgttatctttaacgacgagcaaaagtaattaaatatcgagttctaaagatcttcaacatttggaggctaggaaaaattcctagcctccatttttgtttgtactctttctttctaccagttgccaaaagtgtttcttggcatgcaactcaccttcatgacattcttgtagagcagcatttagcgccgcccccagcatgatgatatagccagaaaagtcaagccataccatcatggcaataaaagctccaattgtcttgtaggaaattaccccgtgactaaataataaggtatagaacgagaataaacgtgataatcccatccataacaaagacgccaagaatgacccagcaagtgcatagcgcaaccgaaccttcgcattaggaacaaagtaatacaaaagagcaagagcaataaacaagacgccaaatgttactggccaccttaatgagctaaacaataaaatgtagtcacgccgaaaattaaaaatcggctgaatactctttaggacttgttcaccaaaaccgtacaaaataataataataaaaataattaccaataatacaatcatccaaataaacgagacgattcggttcatcaccggattctgattttccgcaatcccatacgcatgattaacgctgcgttgaaaagcggcaatcccctgactggtcgaccaaagagcaatcaaggccccagttgtcagaacaccaccactcccccgtcgtaagaaatcataaatcaacggctggataaaatcatagaccgattcaggaattgcagttgagaggtaggctaaaatcgtcttagcgtcaattccaatcatcggtaataaatttcctactaccatcacggcgggaaaaatagataataaggtatagtaagctaagacagcagcagaacttgaaatctgggccattgtaatatgttggattaataacgcaataaaagtcttccctttgcccggttccttgtccataataacctccgaaaacattttataggtttaattataacaaactgaacacccgacaaatattacagaatagataaaaaagcggctgggagaaaacttttgttttctctcagcctcaattacttattatgaataatagtaagataacgtggaactagcttcgcgtcgccacaaggctcgagtctaagtacgaacgataatcagcccgtgccgtgctaatcatcgttccagcttagcccaccgccttgtcgagaaggttatttcccacttccttttttatcaattacccttcaacatggtgacgctttgcggaaatttgatagaagaccaacgcaacgattgcaaagaagattggtccagcaagtgtccagaaagctgtttgataatctttttgtaatagtggttgaacaaacgtaaagacgattccgacaattaaaatcaattcaacgaaacatactaatacatctgtccagaaacggttcttaaagacaacgaatggccggtcaaggtccttctttgccttaaagaatgggaaagccccgatcaagaaaacatatgggaaacaagttgaaacgttcgccatatcagtcaaaatcaagtagaactgttgagcagcatttccaccaaaggcaaccaagaaaacaataattgaaacaataattgcttgaagccacattacatttgcaggcatccccgccttgttaagtttcgtaagtttctttggccataattctggattagaaccaagaatgaaggccttgattggggagtaaagcagaataaacaacgcgcccaaaaagccaagggtctgtgcaaaggcaacgatccgcgtcatgataagtccaaaagtaagggcagcaccgtgcgaccatccaagcgtatcccccatggtaacccctaattgattaaagacaacataggtaacattaccaaggttaacgctgctcttagtcaaagtttgttgataatttactgaccaaccgagcatgaaaatcattaagacataagtaccaattgtaaagatacttgcgatgatcaatccacgagggaatgtcttttccggatttttcatactatcagtaacagaccctaatgattccattccaccgtaagcaaaaatagcataaacaacaaacgaaataatggcaattggtgtctggaattgtggattaggtgatgtaatgaaagttgaagcaccatgaattggttgctttaagattcccttatcggcaactaaaacaataacactgacaataacaaagataatgttaacaacaattgtaaaaataccaccaagtgaaccaactttagcaatggcggtcattccccgtgaactgcaccaagttgttccaagaatcaacagaatcccaaggaccccaatcaattgagtcgaagtcagaccaaatgcatgccattgttgggtagtatccttaccaaaaagcaacgcagaaaaagtaatccaaatccgtgatgctgttgataccatccatacaatccaagatgctagccatacgaaagtaccgacaaaggcgattcgttcaccaactgaaccggcaagccaggaataaatgccccctttagcatccttaaatgtggaaccgtactctgccatcatcaagccacagggaaagaagaaacaaatccctgctaatgcgtaccaaataatactaccgtaacccatttgtaagtaggcgtttgaaacattcccaaaaccaaaaatggcggtaatgatcatcgtcactagtccaaaggtagtaatcatctttttattactactctgttcgtccaaaataatgcctccaaagctttaaaattcttaaataaaaataagaaattatttaataattattagtatagtcgtcttttaaaaaaataaaagtcttttaaataatttcacattacttttatactaccttttgtatttttacgccaacttagcaatctttattcgtttatttgtatattttgttataagcgatgtatactattttcattacttaataatcgctttcacatttaatcttaatgctatggatagcgttttccgacgctgctataattgagttaagaaaatttatgtgattttcactctaatatataagatcgtgaggtggagtaaatgagtgagaaaaaaggtattaatacgacggaactaacccttttaatcgtgggatcaacaattggttcgggagtatttggaattaccagtgatttagctaccgcggcggctcccggaccagcaatcattgcctggataatagtagggattggcgtcttgactttagttctctccctaactaatctttcgcaaaagcggccaggccttgattcagggattttcagctatgcggcagctgcttttggtccgctgggcgaatttatttctggttgggcatactggctttcagcgtggctcggcaatattgcttttgcgacgattatgatgagcgcccttggaacgtttttccccagcctatttgccaatggtcaaaacttattctcaattattgttgcaattattttaacctgggttttgacattcttggtaaatcgagggatcgaatcagcggctttcatcaattcaattgggacaatctgcaagattattccattagtcgtctttgttatctgtgtgattcttggttttaaagctaagatttttactgctgatttctggggcaatgtaacacagaatctcagttcaaaaatcgaaactggttcaatctatgaccaagtaaaggcctcaattatggtaatgatgtggctatttgtcggcgttgaaggtgcctcggttctttctagtcgtgccaaaacacggactgatgctgaacgggcttccatcttcggtcttgtaagcctactcgttatctacattgtggtttctattctgccatacggggtaatgacccgcgcccagttagcagctggtggtcaaccggcgcttggggcgatcatgcaacatctggttggaacgtggggtgccgcccttatcagcattggattgatcatctcagttttagtttcatggctctcgtggacaatgctaccagctgaatcattaatgctaatggctgatgatgaaacccttccaacatcatggggtaagctaaatgacaaaaaagcgccaacacaggcattaataatcaccggggttcttcaatcaatcttcctcttctctttacttttcactacctatgcttacaactttgcatatacgctttgtacggctgcgattttgatctgttacctccttgttggcatttaccagatgatgtacagttggcaacaccaagaatggggacaatttgttattggactaatcaccactctctttgaactgatggcaatggttctctctggctggaaagaaataatggtcgtttcagtcggttttattcctggattcttcttttacgtccaagcatgcaaggaattccatcactcaatcacagtaaaggaaaaatgggcaatggggattatcgctgtctttgcggttatttctttagtattagtaatcaacggaacaatttcaattaattaaaggaggaaaagatcatggtagaaatagcacattttggtgtcgaagcatggctaaataagtgggaaaagagcgcgacttatgatatttcacaaagtacaatcgcctctttgagtatgcacgatctcttaaatttagatggtaacaatggtgaagagttttatgagatgcttgataagcagcaaatgaactacgggtggattgaaggatcacccgagttcaaagaagaagttgctaaactatatcatcatgttgatccggaaaatatcttgcaaacaaacggtgccacaggagcaaatattttagctctctatgccttgatcaatcccggtgatcatgtaattgccgaatacccttcttaccaacaactctacgacattcctaaatcattaggtgcagatgttgattactggcatattcatgaagaagataactggtacccacgaatcgatgacctaaaagcgatggtcaaacctaatactaaaatgatttgtctaaacaacgcaaataatccaacgggaacggttcttgataaagagtttctcgaacaagttgttgaaattgctaagtcagtcgatgcttatgttcttgttgatgaagtctacttgcccctcgatcaccccgaaaaatttgcgcagattattgatctttacgataaaggaatctctactaattctctttcgaagacttattcagttccaggagttcgaatcggttggaccgcgactaacgctgaagttgccgatatcttccgtaagttccgtgactacaccatgatctgtggaggagtctttaacgaccagctcgccacctatgttttacgtcatcgtgatcaagttctcgcccggaaccggaaattagttcttggcaacctcgccatttataaggattggattgatcatgaagaccgagcaagtgtcatcatgccacaagcagtctctacttcctttccaaagcttgacgtgccggttgatattcataccttctgtgaaaacttacttcatgacgaaggggttctcctcgtgcccggcgatgcttttgatactccaggtcacgttcgcctcggctactgcgcaccagaggcaactttaaaagaaggcttaaagcggctttcaaagtatatgcatcaatatgattagcgttacaaaaaaggatgttagaaacatgcaaaagttttctaacatcctttttactgctagcgattaattttcaaactgcttagcaaccttttctgcgatctcacggtaatggtctaagtacttagcataattatcatcgtacatgtaatcagcatctgcttctggatcttgagacgtcaaaatcttcggaccatcattcgtaataactaaggtatgttcgtattggcaactccaaccaccatcagcagtcttggcaagccaaccacttggatcactggtatcagcttcccaagtaccagtgttaatcattggttcaacagtaatggtcatcccgttacgaagacggattccttgaccgtgttcgccgtaatgaggcaccattggatcttcatgcatcgttggttgaataccgtgaccaacaaattcacggacatccccatagccattctcatcttctgtgtagtgttgaatcaccgcaccaatatcaccaatccggttaccaggaacacattggtcaattcccataaacagtgacttcttagtaacgtccattaacttttggatttcaggggaaacttctcctaccgcatagctccagcaagaatcactgaaagcaccgtcgacactgacaaccgtatcaacctttactaagtcgcccttctttaagattaacttcttacgagggaacccgtgacaaatttcatcattaacactaacacaggtagcgtacttgtatccttcaaagccaatttgttcagcttttgctccagcagccttgaagtacttccgagcgaattcttcgatcttccaacttgagatgcctggcttaataattttacgaaggccaaggtgcattgctgctaaggctgccccggccttttccattgcatcgatttctcgaggtgattttaaactaatcattttcgcgatctccttatttacaatctaacataaatagtataccacttgtctgccctgatatcgcaaaccgtgctatactatatgaacgttatagatttaatggaggttataaaatggcaaaagcacttgtagtatacgcaaccattaccggtaataatgaagacgttgcggacattattactgacgctcttgaaaatttaggagtagaagtcgatgaagttgaaatgacaatggctgatccagctgactttgaagaagctgatatttgtgtgatctgtccttacacttacgatgagggagctcttccagaagaaggaattgacttttatgaagacttgcaagaagaacaactagcaggcaaagtttacggagttgccggctctggtgatactttctatggggatgacttctgtgtcgccgtcgataaatttggggatgcccttgccaagacaggggcaactaagggcgctgaaaatgttaaaatcaacctcgcaccagatgaagaagacattcaaaagctcgatgccttcgctaagcaattagtagaaaaggcggctaaactgaatgattaaggatctgtgggtaaaatataagtcaatcattgcctaccttttctggggcgttgtcacaacggtggttaacttagcagtattccagattttgagtccgggacttcactggaatgttgcccttgcaactgtaattgcgtggtttgcatccgtattagttgcttattttaccaataaagtctgggtatttggttcccattacactaccgttagtgactttattgttgaaattttccgatttttcttttatcgtggattgactttatttatcgatttaataattacgtatgtaggtatcaaagttttgaaattcgatacacctctccaacaatttatcgttaaatttattgataatgtcattgtggtaattgctaattatattttctcaaagtggttaatcttcaaagataaccgtgatattgcagataaataaatgataggattcggactgtaaacttacagtgcgaattttttatttatcttaaaaattccaactataataaatacgaagaaggtattgacctaaaatgatgaaaaaattcctaccaattgaaaaaatattagaagcttatacagcaattgctgacggtcacgttaaacttgaaaacgatcaagcactcgtaacctcttctaatgaagcgaaaacttataccgtcaccctttcacgacaatacctatacttcaaatgacaatgcctcatactggcaaggctatcttggctatcccggaattgctgtcctgatgcttcaaggaaagttaccttatgataaggaattagctcaacaatttgctggagttgattggaataaaatcaatcaagaatataagcgtaattatgcgcaagctgctgatgctgttatgactgttaaaggaattgataagaagaaagcagagacggaacttcatcatgtttacaatgtcctaaagcaattaccaattatcgttaaacgtggatcattacgatcacctaaagcaaactaaaggtgaataagagactactcttttacataaaaagctctcttattcaccttttttattgttgtgataagtatttttcaacaattttaagaatcttttcgcttgcgtgcccatctccaaatggtacttccgctagttccatttgccgatacttcttctcatcatttaacaattcaaaaaccgcttgttgaatcgttgtcggatcagtaccaacaatttttacgccccctaggctgaccgcttcttgacgttctgtttcatcacgtaaaagcaaaagagggcgatgcaatgctggagcttcttcctgcaaaccgcctgaatcagttaacagaatcgaactccgggcagcaatatttaagaaatcatgatgatttaatggtgtaataagatgaatccggtcatgatctcctaaaatatcattagccagtaattcttcttctggatgaggatagacaggaaatatcaggtcaagattgttgttagtttccacaatatcacgcattgtatggaaaacacgcttcatgggggcgccgaggttatctttgcgccgcattgtcattaataaaatccgattatctgctgggatggactgcagtaaaggatgcgtaaaatcttcttgtaaattatgcttcacgctatcaattgaagtatttccagtaacatagattcgttttgctggatggtgctcttgcaataaattatcgcgggcacttgtcgttggcgcaaaataaaggtctgctagattatctgtaaggcgccgatgcatttcatcagggaatggcgaataccgttcataagtacgcaaaccagcttcaacatggccaagtgaaatatgatgataaaaactaatcaaactggcagccaaacttgtagtagcatcaccagccacaaggatcatatctggttgtccagcattaatcacattatttaagttatgcaacagttggctcaatagttcaacttcatttgtacttgttacgttcgatgaatcaacactgaaatcaatttggaaattcaaatatgccaacgtgtcgtttaataattgtgaatttcccgttgcaacaagaactggttgccaggtcgcaggattttgatgcatcaatctaatgatcggcgccaacttcaaaacctcagcccgcgtaccaaacaaaaacataatcttatatggtggctgcattaatgactctcccttcagcttttaataaaaaagacgtaatcactaaacaaagcaatcacgtcgacagtgcattatcaaatggtcccatccggatttgaaccggaatcgaccgcttaggaggcggatgtactatccaattatactataggaccaaactaaagaatattatcgcatttacgaaggatttcgtaaagacggtaattattcttttttagttttcgttatttttacgacgatgcttcaaacgaattcctttatttttgcgattctttttctttcgccgtttctttggcttagagaatccactgagagtttgattcatctttttatgggtttccccacttaattgttctttttgcaagtgacgactagcctgctgtttgattgaaaccacccgttgaccctcttctggtttctggttggttaatttattatcaccaatgtagagcttagttagttcatagtcactatcagcaagcaacttcttaaggtcacgaatatcatgatcatcacctaaactaagtgctaatcctggttctccttgtcgcccagtacggccaacccgatgaatataggtattgagcgatgtcggcaagtcaaagttaataacggcaggcaatttaggaatatcaatgccccgggctgccaaatccgtcgtcaacaacaacttgatttgccgcttccgaaacatccgcatcgctttttcccgttgtacttgtttttgtctaccgcccaaggtatctaccggaacatgttcgtgtcgcaaccgacttgcagcatagttaagggtgcgggtactgttgaagaagataagcgcccgaaaatctttaatacttgtcagccgacgtaaagttgctgttttttgcgcattggttcgtgcacttaagtaaccatgttctaccggtccctgagaagtatcctcatcacgaacatcaatagtttcaatatcgcgaccaaacatcacattcaattcatccagaacaggagattttgtagcagaaaagaatgctagttgagtagataacggggtcgcacgctcaatatcttctacgacagctaaagtatcgtcttgaagcatgtcatcagcttcatcaataaccattgtcattaaatggccgagttttaagtgatggttatcaagcatatggagtacccgtccaggtgtccctactacgacatcagggtgttggtgtaaattcataacttgtcgccgtaaatttgccccccctgtcagggattgaacgctaacgccaattaaagttgcccattcacggattaccttggttgtttgaattgccaattcttgtgaaggtgcgagaaccaataattgagttccctcgcctggcataatcttaggcaagagtggcaacgtaaaggctagggtcttaccagagccagtcggtgctattccaaggacagattggtcagtttttaatgccggcgcaactgctttttggattgcagttggttgcttgtatttttcatcaaagtgtttttgaaattgttcgatcaaattaaatcatcctattcttgatcgttatcagatgggaaaactagttgagcagattgacgaagggagtacataactgagttgaccgtcttagataattctaaccaatgcttgtacttcttcatttcttcttcatcatcaggattgttaaagaggtctgcgaaatcattcatttcatcagtcattgagttttcttcaacgggcgcttcgattgggtgcgcattttggtcagcatcataataagtaacctttcgcgtatcaaaaatactatcaaagactaaagtatctttcaagccgtaaacttcagaataaaggtgggagttagctgtcttaccaaagttgagagtgacagtaaatttgtcatagttaagaattgcaacccctttaccatcaaccccagttttagtcagagttgggaaataaactacagattctggttcaccgtaaatagtaacggccccatatacagcatatacaccgaggtccattaaagctcccccagcatacttaagggtaaaaatatttggatatggttcactgccattaagaactttatcaaaacgtgatgagtatttcattacagtgatggttgctccttgaatataatgttccttcatctcatcaactttcttcaaggcagcttgataaatcttggtatggatatgacgagctgcttcaaccaaacgtgccttaggatgggctgccaataatgattcaatcgcactgtattcacttggatttacgaaagctggcttttcaacaataataaatttatcgttttcaattgctttccgtgcttgttggtagtgcaaactatttggtgaagcaatataaacgacatcaaaatcgccctcttcaaagaacttatcaatgttatcgtaaaattcagttgccccatatggcttgccaaacttctcagcatgttctaatgtccgagaatagacagctgtcaattcatattttcctgttttcttggctgcatctaacatctgatcagtaataatatttgttccaataacaccaagttttaacataaaatcaactcttccttttcaaatatttctttgcttacatctaattttaacaattattgcgcgtttttaacagaaatgaaatcttctgataatagaaatgtgtgtataattagttatgttatagaatgacttatcacttaattgaggagactgataaaatatgagaaaaaaaggaatgttacttttcggcgcgggactaatggctggactcaccagtactttagggttcagtcgtgcgaagaaaagcaataatacgatctcgttacctatcttttatgcgggcacatggcaatattatgataaagaacgagatcgctctcataaaataaccatctctcctgaattaaagctcggtatcgataaccagatcattccggcaacggttcaacaaatcaaacctgataagttagttttccttgatcgatttggttatcacattactattcgggcaaatgaacaacggccagtttcattaaccgatgaagctgatgaccaagtttatactattcaaccattaaaataatgttggcgctgtaagacagcgttttttatttttaaattatttttgagcgtactgacgatgtgccggtgctttataattttgcataaatgccaaaatctggtcaaactggtcactaaaacagatactatttagataaggatcttctacaaagcccgccttattcatttgcttaaataggtcgtttaacgaatcataaaagccattaaagttgtaaaaagcaactggcttatgattatccccaactgttgtccatgaggcggcttcggtaatttcctctagtgtcccaaagccgccgggaaaagctaataacccatccgcaagatccatcatcgtttgcttgcgaatatccatattagggacaattcttacatcttttaattcgttataaatggctccacgttcagctagctcagtagttattaccccgtgaacaacgccgccattttttaagactgtccgagcaagggttcccatcaagccaaacgcaccggcaccataaactaattcaatatcgtgttggaccagccattcaccaaatcgttgtgcttcatgattaaatgccggattatttccatcacgcgcaccacaataaactgcaattcgtttaatcatacaactactcccctttaatattttttagagaatctaattgatgcttaattgttgctgccgcactcttaatctcttcttcttccaatgggtaaagttttaagagaagaaggttgccaattccttgccgaccaattaacgctggaaaactaatgtaagtggaatactgcggctgataaattgcaaccggcaacgctaattgttcatccgcaaaaattgccgtaataattcggagagtccaagcagtaacagcactaacattgtaccctaatccatcgagagtgtaccaattactaaggttcgccttaattttaagctgactttgatctaagtgatgaccattgattgccgcagttaagggttgtccattcacacgaacagttgaccaagcaaatacctgatgaccatcgtgttgaccatagacaaaaccagttacattggcagcggcgacctttgcggcttctgcaattgcccgataaaggcgcgccgtttcaacaaccgtgccaatcccaattacttgcttttgcggcaagccaactttttgctggagaacagcagtaattgcctcattaggattagtaaggttgattaagatcccactaaaatcactcttaaaaatcttattaccaacttgtaaggcctgctgatagctggtctcaagctcagccattggttgttgcttcatcaaagcactctttccaaaggcggtaataaggatatccgcatcggctaaggcagcgtaatcttgaataattatttttgtgtgggtcgccaagaccgtttgggaatcatttaaatcagtctgaattgcaatagctagttgatctttttcatcaatcaaaactaattcatcaactcttccgttcattactaattggttggctagcatttcacccacatgaccgaggccaataattccaatctttctcatttttagcgcttctttctatttcccgggaaataacgaaagtgaaaacaaggttattaccctactttaaaaagatagagactaggaaataatctcctcagtctcttttttacttttcctgaaaatcctgaacttctggaaaatcactaagaattacatcacgggcaccctttgagaaatcaaaagttgcttgagcattatagctttcttgatgatctcctacatataatactacttgcgttggttgcaagtctatttggacacctaactcaatggcagctttaaccaattgttgaacatcatctgagtaaacatcgctgattgcttgcaatggatgttggaaattaatatttttcgtgtaacgatcattggcaatttttaacccaaatgataataaatcaccattttcaagttgatctgctaactgaccgctaagagttagcgaaggatcatccactcgtcgttgtacaaacttcaaagcaagctggtattctcgcggagcattaaactcaacaataaagttttgcaactctgcgattaactgcattgcttcttcatgcatccacggtaattgttcctttggcttttgtaaggccactccattattccgcttttttgcttccgctaatcgttcctccaagttatcaggtaatggtgaaagaatactatttaaaagcattaattcaaggaagttaatcgtatcgtcactaattcctgttcgcgacaacgggtcaaggtcaaaattacgaaattcaagataatcaattcccttatgtaaggccccatcaatatcatgcatatcatggttatgccgccgtaaccgtaccgggccaaagaattccttcatactatagtaagtgccattgtccatgaagtgctttagttctgcaaaatactggtcgtatgaagtataggtaacttgctcattggtaaagttatcatccccataatcactacaacgcaaactccgaactggcagctccaaatcctctggaatactatgtggcatatcttcagaaaccggacttgctccatataagtacgtaaataaccattgataaaggtagaacttttgcgctaatttaaagtaaagatgattttgaaaatcaatacggtttggataccggtccgcataaaagcggtgataaatctcgttgattaattcaccatccaaactaaaattaacatggacatcccctaaaatttcttgaacaataccatatttcttccctagataatcatgagtctcttggtcccatttcttagtaaatgcagtttgtaaatattcaaggtcatgctgataagtcggtcctggcgccatacttaacggccataatcgttcatcactccgtaaatgtgagataacaatctgctctaacatttttagttgccggactgcatttttagctccaacaactggacccgtttcaaagtccatcatgtcatccgtatagcctgagttcaaataaatattatattgccgtgaacgcagattttcaggatatggataacgacttgcccgcccattggtcaaaattcggtgcttctttgcctctaaaccaaactgtgaagaaaaaagtttggcatttaatgacggttcttttaaagctgctttaagttgatcataatcggttcccatccaagaatccctccaatcaatcattttaattttattcaagttcaaccataacacgtttggaacataatagacaataacaacttaattatttcactggataatcacttcaaaatagattaacgctttctgtccttaattataccaatctccgccaccaaggaacataaaagtgctgaaatgctttattcttagcaaagaaatgattaattccgctatttttacactgatgttcttttaatgaattgacataatcagcataaacttctattcgctgcgaatctggaacgccccgccatgcgataacatcctgcatattttttactaagtcagcataattaccgccatcatcataatcaataggtgcctgccaatattttttagcaacccttcgaagctgactatcggtcggttgagtaatatcaagacgttgatgagtgtgacgatatttaccagttacataatactccccatagggaattccatagttaaaagattctgtatcagcgatttgccgtaattgattggtcgaataatgcgtggggtctgaatcaactcttccttggttatcaaagcgataaatattccattgactaacaaactttcctgtttcgatatcaacaataaattcaatcattcgggctggattagcataccgacgatacgaattacgaactaattgaaccttcatattagaggggtaagcaaatttatgatgataacgattatggtaattagcaccagttttaaagtctaatttaaagtgattatcgtgggcataggaaagcaatcgttgaaaatctgtcgcttctggtgaaagagagggacgctgatattggcgaataaaagtgatgttttgccgatcaagataactgcgaaataaatgaattttgcgtcctaacaaatctgcttttagccctttcttccctgaataagccgtcacaactagatcacgaaaataaggatagaaaaaactggtaggggctaactgaggtgaaaattgatatacagttggtgaaaattgaagaaatccatagttatcaatataagcttgtaaatggtgattaataattaaatcaagctgttcatgagcgttaagaccgctttgtttcaaggttcttatataattaacggaaccaatttgatttgcttttatcatgttatttgtcataaatatcatttaacggttcatgaaccatcgtaatatgctcgcgctcggcctccataaaatggtcacccacagattcaaaaccatattttttgtaaaagtcctcaacataggcttgggcatgaatagttatcttaaagttggggaaattcactttgattccacttaataaatgttcaataatctttccacctaaaccaatcccgcgtgcttgtggagccacaactacgcgaccaaaagttacaacatcattctgaataaaataacgtgcataggcaactacttcaccattagtagttgcaaaaacatggtgcgcaagtgggtcactatcatccggatcaggataggaactctgttgttctccattaaaaacttgtgctcgtaacttaagaatggcaaaaagttcattaactgttagttcagtaaattgtttatcaaaccattgcataatttatccctcctataattttatatattatacaaaaactagtaagttagcataattttcccgcaaagcaattttattattaaatttatggaatataataaaggtaaggatttatttatgaagggagcgttcaataatggataatttttcacctaatcgtcgaaacgttgttgatattaccgacttaaataagtttttaacaaaaatgtatggtttaatgaccctggcagtattgctttctgccttaaccgcttggctcgtaatgactgttttcgctcagcaatttactgcttttatggtcaataaccgctggggaatgtggttaattatcctcttgccaattatcctaacgtttgggattaattttaatgctacttgtagtcctggtctttgtctgttcctattaattttaacagcgatagtctacggaattacctttgcttttatcgcaggcgcttatgctggtactgatattgcaacagccttcgtttcctcagcgggtgtattcttaacaatggcgattattggtactttttctcaccgtgattttacgcgacttggttcttatgccagtgcggccttaatcggcttgattatcgccatgctggttaacttttttgtgcaaagtccaataattaattatctgctttcaatcgttgcggtaatcatttttacggcattaacagcttgggatgcacaacgaatgaaaaatatctataccgagtgtaatggtcaagtatcatccaatgggctagctgtccttggtgcattacagctttaccttgattttattaatctctttattagtttcttagacatttttggatcaagtaatgaaagttgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtaacacttatattgcaatatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcgtaaaatcgtctaattgccgtggaactaacactttattatgatgatcccaggcgatttcctgctgggcctttaagaaccgacgactacgcaatttctcccaacgatacaactttttacggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcagctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacagcttttagaaccattattttctcccttgactttcaatatatcgttttacaacttctaaaagcgctccaccagtgctaattaagcaatatctttgtgtccaaaaggctgattcccaaagatattgcttgatttctggaaattgttttttgaccattctggagctagacgatttgtaatcatttaaaaatttagccatttccgtatgaggcgttgctctaaacaaaacatgtacgtggtcctgatcatgattccattcttgcaaattaatgccgtatgcttgtctcacaactacaaaacgatgtttaagatattcagatatttcatcgttaattacttttcgacgatacttaaccaccattaccaaatggtaattaggtaagtatactgaatgctgatttctatctaattctattgttatcaccacattttatagatatatactaaatatatcatagaacaaaagaaaaagcactaacgtgctttaagagagcgattcatcccctacttatagaagtgggggtattctcgcaaatttatggataaaatcaatagacaaaaaagtattaagagagtcattaagcatccctcctaatataaatataagatagattttaataactctccactattacacttttaatcgtctaaagtaattattttttcaaagcgaaacatttcattattagtatcatcctgagtttcatagttaagatctagatggctttggttataaaattctacagcagcaaagccacaacgattgatataaaaatgaatatttcgtttatcaaaatacggggtacatgtctcccaaagaactgtttgtggatatttctgctctaatgcagtccaaattttataaccaattcctttattttggtgtgcagtatcaacgtataaaaagtctaaatgattgtgatgtgtttgatcatcgatttgtacaattgcgccacccacaatctcatgatctacaaccgccttaaatccatgggcattatcacaagtaagagatacataaatatcttcagtcggtaatacatcttctaaggagctatcctgtacttgagctgcttgattaaacgaatctttcattgcaggaacaaaaattggtaaatctttttcattaagtggcataagcttaaaatccatcgttttacctcctaaaatacataaaactaaacaactaataatttaaggaattttaccatttgctgcaaatttttgaccacttattacatatacaatataagcggtgacaaatataatatacttagattagaaaggaagtgggaattatgaaagtaaactgtcatatcgaccctaatattgaagaggaacacctcgatttatttgtccgtgaaatgaatccccaaattaataacctcttaaaaggttttacaagtaccgaaccagtattatggtgttatgacgccgatcaaattatccccattaaattctcggatatctttgaactaactgtcgctaagactggtactaaaatttcaacaaaagatcatacctacttttatcgtgaacggttatcccacttcaaaagcaatcttccgaatgattttattgaagcatctgtcagcactatttttaattatcattaccttgatcaccttgagttattagataatggtttgatagatgcaattttaacaaatggtagccatattcagatttcgcgacgaaaaatcaaaaatttgaaagcgaggttaggactatgaaaaaatatgtcaaatatacgattggtttctcaggaattggtgttctaattggcttagcaatctctttagttttcaactatcttaacggcagtaccacttactacccatcatcccctaattttgttaaccaattcgctcatccccttaacggcgtaactgtttctgttattttatggatgctaattggctgtgtttttgggtttggcagtttaatttttgaatttaaaaattggtcactgctaaagaaaacgatcattaatttttgtgcttactatgctggctttgcgccattagcaatcctatgcggttggttcccattgacttggattaattttgccattttcacgcttatctttattgtaatttatgtcataatttggcttcttaattggtactcaataaaaaaagagattcgctcaattaatcagcaaatcaaaaagtagttttccctcacatttgattgtaataagcctggactaattcaacaaagttattaatattataagttgttccaaataacttacgagccgatgtcgaccaataagaaattgggtcttcatgatcagttccaccaagataacttgaaatcattgcatgggtccaaacagtgccaccaccatctttggttcctttcgtcacgggcaaattattctgttttaagatataggctgtatagtaagcagcattgccaagctggtttgcaaaagaagctgcggtatattcatgaggcatttcaaactggacaaaatatggattagcatatggccctgctccttctgccatatattttgtatccgcaatattaataatttgttgattatcaataaatgtatgaacaaacactctagttgaactataattttgcttcatgtaagatacttcactactaatcgttgaattttcattcccagtatcatgaattacgaccccacgaggatttccagatgaagtactatacccgcgttgttcaaatatacttgaaatttgtttagtaattttagcgtgtggaagaccagattgagtaaggtaactattgatttcgttattcattttcaactcaatatcggtggcccgaacaaaataattttttccattatagttaatccgtgcgtaagtatcatcgttatcattagaagtcagatagtagcgattgaccttaactaaggcttgatcaggcaggttggcgcgttgaattgctgaaagtgaattatatactcttgcgccactgcttaacgtagccatttcactaacagcatatgaattactaacctcccgcgtatgatgagaataaaaccaactcccaccgattattgccgcgacgattataataagtgatagatatattaaattttgttttttctttctctttgccatactagttattgtaacgaataaatttgaattttgtaggaaaaaactaattatttataagtaaagttaaaaatcccttgccttcataaatactgaaagcaagggatcatttttatttactaattattaatcagcctcacagcaaacatgatatttacgtgattaacacctatgcaagtggtattgttaaataaaaatatttatgatattatacacttacaaaaaataagtatgaggaaggagcaactaattatgaatgtcgaattaggaatctcaacatttggtgaaacgaccccactcgaaaaaactggtaaggccattagccatgatgaacggattagaaatcttattgaagaagtagaattagccgaccaagtaggaatcgatgcatatgctatcggtgagcaccaccgcaaagactttgcagtttcggcacctgaaatcattatagcgatggcggccgcaaaaacaaaacaaattcatctttcaagcgccactactaatttaccaacgattgatccaattcgggtttttgagcaatatgccacaattgatgcaatggctcctggaagaattgaaattatggctggtcgcggatcatttactgaagcttttgacttatttggttacgatcttgataattatgatgaactatttaaagaaaaattggatatgctagttgaaattaaccggaacgaaattcttgattggccaaaaggaaagttcacgccaaaagttgaccacattggaatctatcctcggccaaagaagcccttgaaaatatcactagctactggcggcaatcctaactcgaccattagagcggccgaaatgggactaccaatcgtttatgcaattattggtggtcagatggatgcctttaagccattagtacagctctatcgtgttgtggctgaaaaaacaggtcacaaattaagtgaaatgccagtttcggctcactcgtggggatggctaagcgatgataaggaaaaggcaatcaaagaatatttctatccaactaaattacttgttgatacaattagtaaagagcggccacaatggactggcatgacatatgaacaataccttgaaagtattggcgaaaacggtgttatttttgttgggaatgccgatacggttgctgacaagattattaaaatgatggaagtgcttggcttgaagcgtttctacctccacttgccaattgcctcaatgccccataaagatgtattaaaagcaattgaaatttatgggaaagaggttgtaccaaaagttaaaaaatattttaaggataaaagtaaattgaatgacttttcaattaaatggaaagaataaaaagatagacgccgatgagaaaagatttttctcacctgcgtctttttattattagggcttaatattctcagttgaaagtctgtgccgttcaaatggaactagggatatgttgaaggaatatttcccaggaaataatcatttaacggcatctttaattggaagataattaggattaagattattctcttcagaccgatcaacaaattttgcttcagtgattccatattcatctgcttaaatttcaatctttcctaaaggcgacgagtaattaaaccttgcaatcattatgccgtttctatttagtcaaaatgcaaaatttcatttacaggacgacgctctgaatggtagctattaattgtcgtatcagccgaataaccaagcgagataccaacaataaaccgttcatcctctggcacatctaaagtttggtgaagaatcgctgggaaacgaacgctgttataggttggaatcgttcccaagccataagcagttgcagctaacataatattttcagcaaataagcccgcatcaaaaatcgaccaatctggtgaagctttaggaatagtaatataaagaattacaggcgaatcatataaagtattacaggcgaatcatataaagtattactagcatttgtcatcttttcatgagcttcatcaaaattagcaaaatgatgaacaattccatgccgccattgcttcatattatcttgggtttgcggtgcccaatcttcacggctcatcactgacaaatctgaatccccttggttacctgcaatatcttgatcacgataagcattcttaatttcttgtaatgtatcgcccatcgcacaatatacttgccaaggttgagagtttacccatgatggagcacgttgagctaattcaacaattttagtaatcattttcttttcaacgggtttgtccgtaaattgacgaattgaatggcgttgattaattgcatcttgtaattccattagatgactcctcctaaatcacatactcttactaaagtttagcatatttaggtttactttaataagatcttgtattggtcactttattttttcgccgcactgcttctctaatcttgggatagcgaaccattaagcaagcaccataagtaaaactagttgcgacatttaacacccagatgaaccaggcgttgtgactacggaaaaatgcgattgtggataagtctttaagaacctcttcaaacagttcatgtgatatttccgtagcattaatatgggccccataaaacacttcaacactgatgccaattgcaaatgaaacaagccagcccacaagatacggccaattccttttaatcttcagaatcggtcgttgatgggaatctagtttattagtgtctttaatctgcgttttacttgtctgtagaaagccaatcgtagctcctaagattagaagaataattgtaagtccagctgccgttaaagatcttacgttttctaagctcaagaccatcataattgcagaatacactgggataattattagctcaaatcgtgttaccttttcatattcaaatgttcctttaatgaatttatagattaatagaattacaaatatagtcattgataataccctaacttttaagtttgtatttgtattgtactatatgactaagatagtgaaacggccaatttcaggaataataatctgagatagctaatgttagcaccaacatgtcccgtaacaatagaccattttcgtgaataggttgtccgtaatttttaacaaaaaagttccttttaatctcagtaacgcgaaaacctattttctggtaaaggtataactgcttaaagctcgtactcccagtgccaatttgcaattgttgataatgatgtacctttgcaaagtgaacggcatcctgcaatagcctggttgctattccgtgattttcaagccgtggatcaacagcaatattctttatttctaatttatccgatgtaagttcttgcaaaaccattacagcaatgggatgaccatctttagactgtgcaaaaagtatccctgattgcagataattttgaactaatttcttacttggatcagcactgagaagcaaatcccaatgttcaggagttactgtcgttactaattctatccttgtatcgttattagtcatttgacaatccctcatccatactattgatagttagaaactgctgatgaagctgttttgaaaatttcattactcaaactcctttttctattaagactgtttgcacacactttcttattaaggagactaattcccacttacattacttaaggcaacaatccagcaaccttatcgcctaacgttggataaatcgccattactttttggcgatactcatccccattaatcttcaaaccaataattggcaagaagttattaatatcatcagccgcataatcgccaatttcacttgcccctaccaattgctgatccttaaagactaaagtaagggtactgatgtgatcgttttggcctgcgtaaaggctaccatattttagcgcaactgtcttaacctgatattgtgagtcaccagtgacatcatctggattaacaccggcacgggcaacctctgggaatgtaaaggctgcttgaccaattgtcgggtaaacaatatcttgatccgttttacctattaaataatcaaaaagatattgaccctcaaattcagcgaccggtgttaatttaggttgtttccgattaataacatccccaattgcatacacaccgtcaaccgttgtcatcaagtgaccgtcgacattaataccatgacgatcatattcaatatcagtattttcaagcgctaatttttcgatatttggatgacgaccggttgcatcaagcacatagtcagcctgtacttcaccatgattagttgtaacgagcaagccgtctttcccttgagttactttttgcgtatcagtattaaagctaaattttattccccgttgcttcatcgcattaactagcgcttcatcttccgccttggtaaattcacgaaggacgcggtcagaatgaacaacgattgttacttcagcgccagcagctgctacaagggttgctaactctaagcccacaaagccagcaccgattatcgtaatccgttgtggaagttcttttaacgagaggaggtcataactggtatgaagatactctttacccgaaatattcagaatatttggtgtttgccccgtcgcaatgataatacgatcggcctggtattgatgaccgtttacactaatagtatggttatctacaaaacttgcgtagccgtcttcaatatcatgacttttcttaataatatcgcgagtttcgcctggccatggatcaaaccgcttaagcttagtctgcattaatgcttcccaatctaattttgctggttgactaatgcctcgaccaagaagttgctgagattggagaacagtccgggcagctccttctagaaaaatttttggttcgcacccatagttagggcaagttcccccatattcgaaaccctcaactaccaatactttacggtcggttttagccaaaagattagccattttataggctgctggccctgatccgatcagaatatcatcatactttttcatgttcatccctccagattcttacattattgagtcaagtgtaacttaagtaatgaaaagagtacaaacgttttgtttcgtcgtataaaaatattaatcaaaagtcaattaatacttatcctctttcattatgaaagcgaattcaactaatgatttaacagtattttgtctaacctattgtatgatccattcaagaatgatagattagcctttaattattaggaggtggtctacatgttacaagttaatacattatttatcatgatcgccagtattctcgtgttattaatgacaccaggactggcttttttctatggtggtctagtcaatcggcgccatgctaataacatgttgctaactgtttttatgatgtgtggcttagccgtgattctttggattacagtaggctactctctttcattttccggcaaccattggggaatagtcggaaatttaaataatacattaatgattcatgtgccaatcgatgctatcactaaaactggcattccaattggcgattatgcaatgttcatgatgatgtttgcaattattaccccggcaatcttttgtggatcggtcgtcggccacggacgctttaattttttaataatgtttaccatttgctggtctatctttgtttactacccccttgtgcatatggtttgggcaccatatggactattggcaagattaggggcagttgactttgctggtggattagttgttcatgtaaatgcggggataacggccttaatcctttcagcctgggttggtcgacggaaagatgttcattctcaacgcaataatttatcgtgggtattaattggaacagcccttttatggattggttggtacggctttaatgctggttcggccctcgccgttaatgatacggccgtacaagccatgttaacaacgaccatctcatgttcaagtgcaatggtaacatggatgttattggatcgttatcagtttaatcatgttaccctagctggtgtctgtaatggtgcaattaccggtttagtagcaatcactcctggagcaggctacgttacactaggtggttcaatgattattggaatagtcggtgcaatcgttagccaatactttattactaagatcaaaccacaactgccaattgatgatgttgttgatgcattcggttgccatggggttagtggtatctggggaagtattgcaactggtatttttgctagccatcagatcagtcatctagtacctaatgggcttttatttggtggtggtttgcaccttttgcttgttcaaatcttcgttaccttattgacaattatatttattggtgtgatggatattatcttaataaaactgctctcaattgttttaccggtttcgattgataatgaaaaactggcggcgattcaaagtaagtgaacttaaatttttactgcaaaattagattatttacgtatatattccttttagaagcaaaaatacataaggagtaaatttatgaataatctatcacgagaagaacaaattgccttaatctatgacaaatggcaaaagatgacaattactagtgatccaatgtttggactagtaatgcaaaataaagaaatttgtttagagttaattaatagagccctgccaaacattaaagcaaaacagattatccagttagacacccaaaaagatattaatattgttagtgcccatcgtgttcgctttgacgtttatgttcgtgatgataaaaataatatcattgtcattgagatgcaagttaataatcaaaataacataccagcacgcttacgttattaccaagaacaggttaatcatgagctattaagacctgaaaataattactcagtactcaataattaccctacttatattattatgttttgtaattttgattattttaagcagggatgggcactatatgaatttaatcttacttgtactagagaccataacttgaaatttggtgataatcggacagtcgttatcttcaatgctcttgctaaaaaatttgataaaaatgatgaaccgattaagaacttccttgctttaatgtgcaatcaaggcgacaataagaatagatttattgcacagattcaagacgaaattgataaagtcaaacaagatccagaaaggagaaatggctttatgaagtacgaattaaacttgatggacgctaaaatggaagcacgagaagaaggaatggcaaaagcaaaaagggaagatattaaaaagttaattgactctctttatgaacttaatattaaaccagagatcattaaacaaaaagttatggaaaaatataatttaactgatgatgaatatgataagtttctcggttaataaagggagcgagacagaagtcactcgtgacttcgtttttcgacgcgaagctagcctctgggagcccccgcaagcaacaataggccttcagcgttcgactttgccggacgctgaaggccattgttgtactgcgctgttcgtattttatggaagtgacctaacttatgtcacagctcttttattgatgggtccgatatccagctgcctgagcatcagctaatgaatcaaaataaacgacattttcaggagcaatcccagaatatggatattgccccggtaagtagcaatacattgttgaacgatcaccaataattgaatttggttcatagttatccggatcaacccacggctctggttctttaccactcgcgggggctgtatttccatcattaggctgttgagttgttgaaggaatcgttggactactattatttgaatagctcttctcatcattcggttgctgagattgctggccgattatcgaagacccccgttgactttccttaccgctggaagatttgatgacagaactagttttttctttatttttagattcttttgtcgattttttcttcttatccgattctttagttgttttaactactgcatcctcttgagtctcctgtgcctgattacgactactaatgaaccatccgccaccaattaataataaaataactattatccataaccatggtcgacgataaaacggcttccgatgttgatttctgttcataactggcctcctttatctttgaactttcgatttttaacaaaaacgtttccaaattcattatataaaatcaccatagcgatagataggtaccttcaacgggattaattattttttagagaattggttataggatattcataaaagataaacattcttcttaaaattattaactataattaactaaatactgaccatcatcaagtaaaaattgcttaaataatggcagcgtaaattttagctttccatatcctgctggtgttatgagttgactatccattaaccgccgacgatacattccaatataaccaggctttttctttaattttgttcttaagcaactagttgaaacagggtactcagaagctttagccatagtaataacaaattgctgatccataatagataattcttcaagcatcttactataagcatttcgacttaattgggcttgatactctggctggatactatctatagttttcatcgtaatgtgtttatccggtgattcccataaaagataaccaagcaattgaaaggcatatgcatatccgtctgaaagaagagcggcgcgacgaaccacttctggcgaaatttccggatctcgtactttcaatgcttgttggtattgcgctctgatatcatagtaattcagtggagaaagacttattcttccactacgtaataagaaagttaatacatgattattttgcaattcttgaacatttttgggtaatccagtcatgattattgagattggtaacccctcactaatcatgacttgatatactgatgctaattcaaccattcccgttacctcttgagcttcatcaatcattaccaatactttctggttatttttgtctaatatttttaacattttttttaatacaagttgaaaatttgatgtttgtttatcattaagagtgaattttaagcctaatccgcctatttcaaaattaatatcggagagttggtcgaatacttttttgattttatttgttgattgttggtaaatcatttcagccaaacgtcccaccatattatctccaataattaagtgaatagttatccacgtcggatcttgatcaatctgctttccaacagaattcataaaaactgtttttccaactccacgatttccataaatcaaagtagttcgataaggagtatcaagcgctttaatgtctttaaccaattttgattgtacttcttcgcgatctaataacacagttggttgaataccaaaacttggattaaaaggatttttcatattcttttcctctattttatatttctaatttaattttatatctgtttatatctttgctcaagttttatatctgtttatatcttaaattttatatgtgtaaaaagccaggtaactcccttctctaaaaaagttagaaattacttggcttttttatcaatctaattttctactctaataaaagtgatacttatttcatcatatttgatatttagaactagtaatctttttagctaattcagtatttactaatcgaatagctgatgaattcttataagaatttcccccaaagtttaaatcaccataccaacaaattttttgatcaaaaacacaaatattattaccaatttgttcttttaacttaaaatcgactttatttgataaaagtttatagtcacaatttctctgctttttacccaaagtaagggaaatctgactaaattttaccatttcattcaacatttcaatttgtttttgattaatcctttttaaacaaataaaggctttcttagcattagctagatcttgtctccatacctgcaaatagtcatttttagtatagtaagcagttgaataactattccattgcttactatggacaaaactatatccttgttgcttatagactcttaccctcttccgatacatctttgcaaatgtctcatcagcaatatcaacataatcatatacacgtaattcgtcttttttatctaggcttcgttctaatcgaccaagatattgctttgtattacctttccaagaaaaaggtaacgttaaaaataatgtatctaaacttggtaaatcaaatccttctcccacatatttgccagtcgacaaaagaatatatgggtctttaatttttgataacttaatggataatttttgtgttccagtagtcaaatatactttgctatttttctgctttagttttgcgtaaagttcattaagatgtttaattcgttcactcaacaataaaatatgtcttccttcagacaatgcttggagtgcgtcctttactatttgatcattacggtcattattttcagcaatcaaccttatcttttgcgcataagtatcacgttctaatttacttttagcttcaagaaaactattataacgcggatatatataacgagaaatcaaatattctttttcactatcttgagcttggtagataatatttccacaacgataatacataaaattttctaatccatcttttctttcgggcgttgctgttaaccccagaacatatcgtgtgtttgcttctactaaagttttttcaaaggttaccgcagaaatatgatggcattcatcaacaattatttgttcatagtcttgaaatagttttgtacgctcaatagctgataaatggattaatttacgaatattaatgatatcgactaattttgaaggatgattacgagttccagaaataatttcaatttgttttttcttaacgcatcgtccagtcttagttaattctttatatggcacatccttaattttcaaaaatcttaaagcagcatctcgccattgattagcgatgttaacggtagacacaataatcaatgttcttgctttacgccttgcaattagcgcacatccaacaactgtttttccaaatccagtatgagcacacagcatccccaatttatttttatcaattttatttactgcttcttcttgttgtggccgtagggtacctgtaaattcaacattcaacgctttggacagagtaaattgttcttttaaataactatgacaattatcttttaatgacgactctactcctcgtggcaatcgtaaatatttaccatcaatttttgctgctgttaaaattgatggaacatcccacacaggcatgcgcattctttgtctcttaatatattctggattactaaaagtagctaagtttaataatgataattgctcttgacgcgttaaattttgacgattaataaatatttccccagcaataaagccttcaacttttttaggaaaattttgcaaaaacgggataattaatctagagttttcgccctttagaattttcagatctttagtaatttgactaatgaaattttttacttcttcttcactatacttttttgtgttttctaattggtcaaataactgtgacagtgctaaaggctgaagattattatcagtaaaaatagactttttctcttttacatcactccattttaatggcaaagcaatcaaatttccaaatcctttttcaggtaatcgatcttgattaggaatcatacgatcaaatgatgacaaatcaagactttcactagtaatcatcgactctactaaaatcaatttaccaagaaacctagctgtacttgccgcaattggttgactaaaaaatatccacagatgataactattaccagatgatgatatttcaggaagacagttaagatcatatttttggcaagtcttaattactgccttagtcattttataaggttcagcggttgattgatgtttatcaaaatcaaaaactaataactttgttttatcatcttttaataaaggatagatcccgtaacgatgatatttatctgaagaagaaatctgctcataaattactttcctagaataaggaagatattgtttcttcaattttgacaatgcttctttattatttcgcaattgataaaagcttcgccaattttttaatgctggactatatcctttaccattactccacttttgagcaaatacatcaggacgacctgcaaaataatcagcatataatgctagtttttcaccagttgttcttttcttagctataagacttaataatttctgttcactaataatccaatccgtccctttatcagtggtaattgagtaaaatttttctttagtttcgtaatgccaatatgcttgagtaacggtaatgatatcaccgttatttaacgcgtattctttacctatttccatgtagtttaactccatttagctagctgctattattacccatcaagattctcgaaactttagattagccaaatcgtttaataacagtattaatatcatctcttaattctttactgaggccggttaaatcttcatctgtaattacattctctgataacagctgcaataaagtctgaaacatggatcttttcgatacttcaacaagcacctcgggcgattttcgatccgcctttatttgtttttccagcttccaaaatttattcgctgccgaaccatcaccatctaatattcttttgtattcctgattaaggcgattcatatatctttcttgccattttggaagcagcttgttgaataattgccaatcgcttttagagatatcattcatttcttcttacctcgtttttactttaattatacgataaatcgttttatgaaattcaacttcttttgcgccttataccaacaccaaagcctaatcctactctaacatgaatccacattcaaagatggtattaaagtttacatagcactcagctcttcgaatttgggtgttatttttagttaaccataattgcatttcatattcatatattaaccacttatctttctatcaatcacaaatattgtttttactgatatattcacactatcaaatatattaggaggcattttaatcatgttaattaaggcaaataatcttactaaaagatacggaacaaaattagctctagataacataaatttacagatcgatcgtggtcaattaattgcttatctaggtactaatggtgcagggaaatcaactactatcaatcttcttactggtttaatgacgccaacctccgggatgatcgcacgccgtcaaggaataaaaattggcgttgtcttccaagatagcattctcgataaagagctttcagttaaagataatcttaactttagatcaaacttatatcatgaagatcatactgaatgggttcaccagttaattagcctaatgggcctcacccattttctaaatcagcgctatggaacattatctggtggacagcgacgcagggttgatatcaatcgtgccttgattaccgacccagatattcttttccttgacgaaccgacaactggattggatttacaaacgcgacttgttatttggaacctccttcaaaagctacaaaaggaacatggtctaactatttttctaacaactcattacttagaagaagccgaaaatgccgatcaaatgtatatcttagaaaacggcaaaattttagtttctggctcagcaaccgatattaaacaacattatgcaccaactaaattagtggttacaacaaatggacataagctacaaactaactactctgagaaacaattaacacctcaaaaattttcttttgatggccttaattgttcagaagttattacattactacatagcaatcaagagtatatcattaacttctcatatacccccggttcaattaacgatgcttttgtcaaaattaccggaaaggagcttcaataatatgattgcgttaattaaaaaaaacttaaagatttactttgctaataagattggtgtcttgatgtcttgccttggtgctttaatttcattctttatttatattggttttttgcagcaaaacctgatatcttcatggcaatcattgcctcatacaaaggaaatgttaggtttatggatgattagtggaattgtcgccatcgccggcattaccacttcatttcaagctcttggacaattagtcaaagatcgagaaagccgaacatgggatgatttaagtctaactgatttgacaccgttccaaattaattgtagctatttaactgcaacaatatttattagcacattaatgcagattattacattcttcatcatggcagtttactttattttagtagatagtattactattccaactactgcattgcttctcggattattttttattgttttaggtgcaattggcgcaagtgctgttaatttaattattgttgacctaatccattcttctacgacttttagccgcctttctgccataattggcgcagcttccggatttatgatcgctacttatatgccctatggaacattatccaaatcagcacaatttgtagtaaaattatttccaagtagttatgaggctgctagcttgcgaagccttctgctaaataaactaagcaaaaaatttttaccgccatccagtcggtaccaaatgattgaatatctgggtatccacttcaagattcatggttatcagttaaataattatagtaatgcattaatgattgtgggaatgtctatagttttaatagatcttggagctgtttgggcaaatcgatatcagaggaagagttaattgtgcaaattcattttcagtcagatccattactaggtcctgacgatcttaatattactgtgaacgctgttactaaaaacgacaaagttattaacctgcttaattatttagataagtatgatcaaaaaagtagctctttaatcccaataaaaacagaagataggattttaactataaagcaaatagagcttatcaaggtagaggtaaccaaaaacatcctctctttttatacaaaaagcgatgtaattcaagcaaacggacgactatatcaagtattaacaaggcttaacgaaaattttgttcaagtatcaaaacacggcattattaatttaaatcatttactttccctagaagctggatttactggcaatatgattgctaaattaaattttgatcaacgtgccgatgtttcacggaaatatctaccagagttagaaagaagattgggactataaaatgataaatttaaaaaggggtatccgttactttattcgcgggatgggttatggatctattacttatctcgcaattattgcatttctcacacataatatgactgtttctactactagtgtcattacagtgttcattattagtggattgatcggggaattaagttttgtctttcaaacagaactaccgtattcgatcgctctcgttattcacctaatcgggacctttattctatattctgtaatgatgctaatcaatcactggcctcttaattggcaaaccattgtaattttcattatcgtctatatcgctatttggctttttattcgtttgttagaagagcaacatattaatcgaattaataagcaaattagaaacaggcaaaaataaattttgtatcgcaatcatcgcttcgttactaaaatgaggtgatgatttttgtataggttaatgtccatacaatcagatgtttgataacttcttagtttcacatttgcttgtcgatctgtcattttgctgcctcccttaacacttttcttttatataaaacgttaagtacacgattaccctacaaacgcctacttgactatcgaaatagaacatagaatactcgactagttagttcaaaatagaaagaatcaccatctttcaacgttacataaagttcacgttcaaagatggtgaagtggttaatttaactatttaaggttaagttttcaatgcaatgatcgccattattatctcattgaaggctgacaaagatttccgtatatctgttaccttacacctcttacaaaaatagtgaggcgaatcatttaattaactggtttaattcgttgatgtccacagtatcaaggtcaattggttctccacctaaccagtctaaaaagtcaggatcaacttgccctttttggtaatcatcataatactgctctaaagcaccgacaccaccaacatattcaataataccgtaaccacgggctttttgaacatgtggtagctcctcattagtaactggttgaattttttggacatgaagtttaaactcccagccgtccccatagtcataatgaatagttaatttatctttttcatttaataatgagaccgttgctagatcaagcttaacttttgtcatcccgcctggcacaaaatcttctgactgagtataaaattcctgagtctgttcattaattgcatcatacaagtgtcccaagttaccatgaaacatcaaaatcactgtttcagcgagttcctcaattgtactactacccttaatcacgaacgtacggcttgctagcggtttaaaatcagctaatttagcagtaattacatacgcttgaccatagttttgcgggttaatcaactgacggttgccaacattcgttggtatatctgcttgtgctggagctagttcgtcaagcaactgctgaataaatttatcttgatagtcatcttctggcgcagctaattccggttctccatagataatatcgtagcttgtatctagatagtctgcaacatccctagcagctgattgactcacgatccctgtgtgacttagacaaacataaaaattggataacgtaacagaaagaagatcctcatcaatttgatctaacgttccagcgaaaaagatgtttggcgcagctaggttagtagtgaccgtgcaaattttatttttaacatgaagtggttcaaaaattggtccaagatacgacgagcagtcttatcatctcccattaactgaccatcagcactggcgataaactggtcaatcatttgctggttgttttggctaatcgcttgaactgttgctggattatctgctgaggcttttccttcgtcatccgcccaaatacggggatctttaaattgtggcttgatcgtacaatattttgcccccggtcgtggagctttcacctttaccggatattcttcattaaccaattggcaaaatttcattaatacttcctgatcatttccagatagagctaacaataagtagacaagatcattgaaatcctcagttgatgaaaaatcatcattatcgttaagggtttccttaaattctgcttggtggctagcaattatctgcaaataatttttaagtttttcgttttcagcagatgagattggccggtataaattaaatgaaaaaacattctgcattaaccaagtacgttgtggatcaaccaaaaaaggcatttcatttagaaagttaatggcaacttgactaaacttaccctcgcctaatttgtcagtaaagactggcaaaccagtttcctcttctacataataggtagtatgttttattatcaatctttaccagactaagccgccaccgtcgtaaaggtttttggctaatcttaccagtattattataaggtagtcgatcagccaggtcaggactataaaataactgtgccatgatgattgctcctttatttttgaatgtgtgagaaatgaattttattcgcgctctataaaagaaagcgaagggaatatcatctatagtttacagttgtaagaatgtccaagcaagttatgatccctgaacattaatccacagttttagcaattttttgatagtattaaccattttacttaaatcgatattgggcaattttttgcaaataactttggcggcgttgcggggatgaccaggaaatcccgccaaagttaagccacttccgatgctcaaagccaagttgtttcaaggttgtattaacaaatactcgctgaatatcatccccacagaaaaaccgcaagtaccaagttggcgaagttgaagtagttaatacatagcaatgctggacattcgtcaatagccctttaattccggtcctggttaccgtatgggagagatcggggccctctttcatcaccttatcaataaccccttttaacattccgggaatactattccaccagcaaggagttataaaaatcactgtccgacatgattttaagagttctaaatatttgcgcaccaagggatcaactgtccctccttgatgatacaatgaaagttcttccgcagaataagtaggatcaaaatgttccgcataaaggtcaattaattgaaccaattagtcgaaaaaagttagaaattaacgtttgaccatcgagttcatgttggatttgagttatactttttattgtgcaagacccctttatactttgtttttggttatttaaagtatagtccaaaggggcttgcttttttaatttttcgtagaaaaaactgatagcctcgcctgtttgacatggttatcagctttcaagtttcagttataaatgaataatttggatcgttcgcaaatgacgcgtgagtttactatccgcttccaattgagcaagcgtccgcgataatgtttcgggggttgtcccaaggtatgaagaaaggtccttgagtttcaagggtagcttaactttcgaactctgttgatcaaccatcaattgtttcagataagtcactacccgttcttcaatgtttggcagtcccatcagccgtgtttgctgacgaagactttcaatcattgctgcctgtcctgccattagttttaaggtaatttcgctttggtggtgaatcaactggataaagtcttgccgattaagactacagatatcactgtctgtagtcatttctacataactactatggttggcaacccccaggagccaggtttcaccaacataatcacctgtcttcagcattcgttgcacccgttcttcaccatcttcacttagttggtacattcgaccatggccactttttacaatcactaaccggtcatccatgtctggactcacaacaattgttccgcgcttaatacgctggtgatgaaccagctgttccacttggcgctggcgttctaaactcaactgattaaagagcggaaccaggtgaacacaaagttcttctttcattagagtatcctccatcattcgggtgttagaagtcatcatcatcttcttcagtatacaaccccgtccgtaaatcatgccccaagaagcgctgggttaaagcaatttgctttttgatccatgacaataattccgttaaatctactgctaattcgggccactcttctttattgccaagagcaatggccttcgtgataaagagaatctgcgtgtcaaaatcctttaccaaggcaaataattggtcatcccctggcaaatacttatcagcacccctttcttctagcatggtaaattcacgaaactgatccgtcgtcgttggaatactctcaccattctgaactagcagctgattcaggtgattaaatgcttcctgttcatgcgcaatccaatcatcgccatattgggataaaaacaatgccgcattccctttcgtaaacagctttgcctgactaatctttagtgaatgaattaataagttggcaatgatatgacccgtcatcgcccctgccgttggtgtatggtgatcaatatcgctctgttttagttcctgttgatactgttcttcactagtcatctgatagctcctttaccttaattccctgaaccgtgtatcccattttttcaatatttgcttgaacatcatcgggtgaagctttggccaaatctagtgtaaatttaacctttcccgcattgaacagtaccttcacgtcatcggtcccgtcaatggtttcaacacttttttgaatcttagttaggcatgatggacaagttaaaccatcaagtttcatcattactttttccatggttatcactcctttgttattttcattgtaatttagccaccgtaaataaaaattgattatcatcaattttgagaaattcgtttcatcaaccgcatactgttcaaaataacaatcagaatactaagctcatgaatcagcattcctgatgccatttcgatataaccaacaaaaagtccaataaacaatagcactaccgtcagtaaggcaatcaagatgttttcattcatattggcgatggttcgccgtgccaagcgaaaactggtgactagactattcagatctgatttcacaagtactaggtcggctacatccattgcaacatcagtaccggaacccattgccactgcaacatcagctgcggagagtgccggactatcattaatcccgtcaccaataaatgcgatccgatgaccgtcagcctgttgttgtttgagatagtcagctttcccttgaggaagcatcgctgcgtgaacttcatcgattggcagtttagctgcgatctgatgagcggttccttcattatcgccagtcaacattatgagtcgtttgacccctaacgcttttaattgtcgtaacgccgattgtgcctgtgatcgtaactgatctttgataccaaagattgccaattcatggtgatccatgctggcaaaaataacaatcgaatttccatcactcgtcagttgatcaatgagttggtcgagagttgaactggtacctaataagtctttaatcagggttggattacctaataagtactcaccttcaccaatttgcgctcggattccctgtcccttaatcgtttgaatatcggttggctgataatcgtgcttcctatctagcttgccaattgcttgtgccaacgggtggtccgatcgttgttcaactgctaccgcttgatcaataatcgtctgtcggtctccgttcagaacattgacactagtaacaaccggcttcccgacggttaaggtacccgtcttatcaaaggcaatcgtgtcaatatgcttcatccggtccatgacatcggaacccttaaagagaatcccctgacgagcaccattaccgattccagcaacagtagatgcagggacaccaatcacaagcgcacctggacagccaagaaccattacggtaattgctaaccgcacgtctcgtgtaatcaagccaaccataattgctaccaatagcacaactggcgtgtaataacgggcgaagcgatcaataaagcgttgcgtcttcgtttgcgaatcctgagcttcttccactagttcaataattttaccgaacgtagtatcttcgcctgccgcggtagtattcaccgtcaccgtcccattctccaaaatggttcccgcaaaaactgcatctccaggatgtttcttaactaaccgagactccccagtaatactggcttcatttagaacggcagtcccagtcttgatcgtgccatcgactggaacctgatttccagtcttaattaagaccatgtcccccggatcaatgaagtccacatcctcatcactggtattgccatcttcatcaatcaccaccgcggtttgaggagcaagttcggttagctgcttaattgccgaccgtgtcttccttaaagtagcgttttctaatacctcaccaaccataaaaagccaggtaacaatcgccgcttcgttatattcgccaatgataaaagcaccgatcaccgcaatactgacgagaacatcaatcgatatcagccgtacctctaatgatgaaatggctgtgaacaaaatcggcaatagaccgatgacccctgcaatggccattaggatctgatacattaagttatttgagctgataaagcgaaaagcttctgccagaattaataaaacggtcaagccgatcaccaatgcttgccgttgctcagtcaggaatcgttgtactttgaccatatcggcacctccttttactgtccttagtataagaaaagaagccagtaagttacttgaccgccatcaagtttggtaatttaaaaagcctcataattggattaaccaaatataaggcttgatacgtgtttctacttatttaatttgctaatgatttcattaattaaatatttgatttagtttgaatcagtccagcaagatatttaccatcatcaatactcattgtggatcgatgattcagccaaaagagaagtaacttgataatactgtccacatacagtgtttgaaaaaacttatagagagggaccttttgaatttctgctctagtcgtgttgaataagtacggagctcgttcaagaaattcatcgtttgccaagttaataatcgcatggtatagattaatatcgccattgtccgataataagacagccaatatatctttacgatcatcacaatatttaagggtcacattaaaagcagagttagctaattccataattttttgttctgatgcattatgagtatcttctagtgatgtccggtctttttgcagcgcatttttcaagctaatgaggatattcgtctctacccagtggataaaatccttcttatttttaaaataattataaaaggtcttcttactaacttcgacttgattaataatatcgatagttcgacattcacttaacttttgtgttgataaaaccttaattaatccattgaggattcggtttttagtattgattgtccgaacgtccatttatccttgccactcctattccatatgactaagcgttttcattatagacggtcggcaatattattacattaaatctcggttttcttacacgctcagtttacatttttactcatttattctgtaatagcgtccctaactttattaaacataagccaataacagccccgatgaaaagaactaattttaatattcaagtactggggttcttacttcatagcaggcagtcaaaattcattaaaccagcgtcgcacccagtgaattcttaaaatggtcaagcgcccactcctgaccatgcttggtaaaggtggcgacccccttaaccggaatcgtaatctggtagttcaaattataggcggcaattgcggtgtgcaggacacagatatcggtgcaaacacctgtaatccacaagttatcaatttttcgttctcgcaggtagttatcaagattagtattttgaaatgatgaatagcggttcttattaaactggtaaacccggtcactggcctgatgttgttcaaaccagtcattaaccttgccgtatagctgttgaccaggcgtaccgaccacgttatgtggcgggaagagtttagcttctggactaaaccggtccctacaatgggcatcagtcgggaaaattacgtagtcgccattttggtaaaaacggttggccagctgaaccaaataatcttctaattcctgcgctggcttgccacaagtaagcgcaccattgtcagcgacaaaatcgtttgtataatcaataattaataatgctttagtcattgctaactccttatttttgtgcctcatcaaccagcttttgttgcatgtcagctaaccgcttggttaaataaactgggaagcggtccggattaagcaaccgcttagtagccgccggcagctgtgctaattcggtctgcgcaaaatgctggatggcaaaagtgtcggtttcaattggcgccgcttttttcagtgtcaaaacttgcttaagcagtggcttagcaatgaagtcagttagaatcactttattccgggtgacgtgaatgtcagcattgattgccgcaatttcggttccaatctgctcgtcagccagggcaattacatcggcaatagcgtgttggggattatgcttatcgtagagccggtaaatctgcttattcccagggagcgtaatcttttcgcgactattactaatcttgatctttggcacccatttgccatcattttctagtgccgacattttataaacaacgcttaatactggactggatgaactggtaattagtcgctcaccgatcccaaagttatccagtggtgccccttcatcaagcaatgacttaacaatgtgggcatcaagggcgtttgaagcagtaatcttagcgttggtaaaaccagcctcgtccatcatcttccgagccttggctgccaactgggcaatatcaccagaatcgatgcggataccaaccggttcgtggccagctgcccgcaattccttaaagactttaattgcgttcggtactccagagttaaccacatcgtaagtatcaactaacagggcagcattgtcagggtaaattttggcccaggcacgaaaggccgttaattcatcaggaaagctttcaatccaggcgtgggccatcgtccccgccgccggaaggttaaacagcttggcagctagcacattggaggtactactgcacccaccaataatggcagcccgcgcaccatatattgcggcatcaggcccctgcgcccgtcgtgcaccaaattccattactgggcgtccgccagtaacgctggtaatctgccatgccttcgttgcaatcaatgattggtggttaatgatgtttaagatcagggtttcgagaagttggacatcaattagtgggccactaatactaaggattggttcctgtgggaagactggcgtgccttctgggattgccttaattgagcagcggttgtgagctgctgtcaggtaaaagagaaagtcgtcactaaagtggttaagggaccgcagataagcaatgtcaccagttgaaaagtgccagttcttaacttcatcaattacttgcatcaatccagcactaatcacaaaactgccatcatcgggcgccttacggtaaaagacatcgaagcgcgcctgcttatcgtggggaagcgtttgataataaccgttggccattgaaaactcatacatgtcggttaataattcatgtttcattattaaataactcctaacaagtttaggtaaaaaatactttaactactgcaaaaaataaaagtatattgaacttttattatcactaattgtagcacttttatttttagacgcaaggtagtaccagtttaaataactttggtggccggcctgaccgctttgttgcggcggtaccaacttccttaaacagcttttggtgggtctttttaaaattagaattatcaatttgatcgaccgttgtttggcggaaagtagcataaacttcgcgggcttgccgaagggtaaaagtcggtcctaagatctgtaaaatggttggctggtagtccagtttatttttaattcgtacaatggccgtattaataatttggtggtggtcaaatgcaagcgccggtcctgcagccaaactcaaaactaagtcaccattttgcaagataaacttcccgtggtcaaagttaagactaaaccacccgacttcggttgctccgtacccggccctcagttgcggcattgtcggtaagaaagtcatgtaggcaatcgccaaggcccgcccacggcttacccggtcgggatcggtgaaggttgccaactgttcggtagcactgtttgatagacgaacaccaattttatccttaatcaggcggatacaggcagcgtcagcactttcatcccgccacaatagggtttctggtaaagcccagtggccctcaaatggcggataagcccgtttgaccagcaggacttgtggtaaatgggtcaagggattaaaactccaaataatatttgcaatcgtaattagcggatgcgcaacaactttgtcagccatctctttcacctcacaaaatattatagcgcaatcaagaatcacaataataaaaaatcgacaactaaggacggccttagttattgatttaacctaaattaacttctttaattcagcaattgctttttcgtagtctggttcatcagttaattcagttacaatttgccggtaaacaaccttcccatccggatcaagaatccagactgaccgcgcaaggattccttcatctggtattaacagctttgattcgtaaccaaaggattcttccttgtcagaaaccaattccatgtttttgacaccttcagcagcacaccacttctgttgatcttcagtcgtgttagttgaaatggtcaggaaattaacctctgggaattggtccattgttgagttaaaccgctgtgtttgaatgctacaaaccggggtgttaatatctggaacaacgcttaagagagttattttgccaagcaattgccgggtcttaaccttgtcaccattcttatcaaaaaccttgaagtgtgggaattcgtcaccaacagctggtggattgcctactaattgccgcttttcaccattaattgtgatttccattcttagcaactccttttctaattttggttaggtacagtatatcaaaaacgcaattaaaaagcattgattatactcattgttttagaaaatttatgagctgtgtagctaggcaaggtatcttttaacctcgcggtttgtaaaattaagttagaaaaataaaaagccatttgtggtagacttttgaatacccatacatcaaaagaaaggacaccacaaatgacctaccatcatcttaccatagacgaactaacgatgatcgctaattttcgtgaccaaggagtaaaagcctaccgggccgccaaacttttgcaccggagcttagaaaccgtctaccgagtttatcgctttctggccgccggccacacgctccaagaatattaccaacactatcgtgaaaacaaggctcattgcggtcggaaggctattcaattgcccactgatgaggtaacttatatcaaagccaaagtggctcaaggctggacgccagacacaattatgggacgcgctgaacggccactcagctgtagtatgcggacactttaccgccttttcgaacggggcaattttgatgtgcggaccttgccgatgaaaggcaagcgtcgccccaatggttacgtagaacggcgggggaaggccggtcaacttggccaaagcattcaccaacgggctatcgactttcccaactttaaccgtgaattcggccaccttgaagccgacaccgtccagggcaaaggacatcagggcgccgttatgactttggtagaacggacttccaaagtcgaagtgattcttaacgtccatagtaagacggccaccagtgtgatccagcacttacaggaatggttggcaaagtttccaccccacttcttcaagtcgattaccttcgacaatgggaaggagttcgctgactggcgagcaattgccaaccaatttgacctccagacctactttgccgaggtgggggcacctaaccaacgggggttaaacgagaacaacaacggccttctgcggcgcgatgggctccacaaaggccgcgatctccgccacctagctgatgaagaggttgctcaaataatgagttaccggaacaacattcctcgcaagtcattgggctatcaaacaccttacgaggtattcatgaagtatgtcactgatgagcaactactttttttctaacttaaattgacatttcgggcctaaaataggcagcgttaccttctaaaaggacttaatgtgttaactaactgcctttatatttcaatacatcatactaaggtaaattctcctaaattttataaattatgcaactgcaaacacatagaaacaatgcctataaatattgatataccagtcatttgaagtataacagaaaaattagacaaagttaaatagttaaactcgtaaggcatggttccggtattcaaccggtgtcatgccttttgtttttaaagagattcgttggttgttgaaacgatatacatagtttaaggaaagctttttgaactctccaaaatctttacatggcgtaaatccattaaacagttccgttttgtataggtgaaagaaactctcaatgggcgcattgtcatggcaattgcccttacgggacatgctttgaacaaaatgaagattagctagtgttttggcatagtaaacctgctgatattgccatccttgatctgaatgaataataggatgggcattatcaggtaatttttgcagtaattcatcaatagtacttttgaccagttgtagattgggatgataacttacttgaaaagccagtacttccttactagcttcatcaaccatagctgaaacataagcccactgttgattagctagtcatatctgagtgatatcgatgtggatgacttggtatggtttcgttgctgtaaaggattgttggagaacattctgtgcaatttttctaacagtaccgcgatatgatgaatatttaccattacggtgttggttatacatacttacttggacgcctagctgacgcatgatgcgggtagctgtggcgtcggctaagtgaatcccgtcttgatcaagtaaagctttcacgcgacgataaccgtaggttcgtcgtccgcgataaagcccctgcttgctaatcgccaacactcgttgtttaacttgagcgtatttatcgtaagggttagcgatgcgcttccgctcatcgtaataagttactctcgataatgagattctttggaggagcttaccaaccgagtgacgctgtttcttaggaagcttagcttgatgagccctgatctgatccactatttgtgttttttgtcgagctttgagggtccgaacagggccaacgatttttttagaatatcccgatccattttgacgtcatacaattcttgtttggtttgcgccaattcttccttaagtcgttcaatctcatttttattgacttgtttctttagcgctttccggtttttctttttcactttaggtggcctacctttaggatgaggctttaatgcctggtaaccgccttgatgaaaatctcgtttccaatgactaatttgattaggcaagagatcatatttggctgctaccatcgccattgattcctcatgagtttgatagtagtttatcacgctcaatttgaaatcagcactaaaggttcgcttcacgcgacgatgttgaaggctggtgattccttgaagtctggcttgttcaatccaatactgaatataatggtgactaagatgatattttttagctaactggtatgaaattaagccatctgttgcccattcacgaacaagctttaccttgaattcagaactatatttagtcacgcggtttttcaagttccataatttttcctcaaaatcatcataaattctatttcgagtatactactgtccagataatttataatttttgaatctaatatttaatatttaatgagtagtattatactaatcaactcaatcgtttcacctaaaatccaccatttcttcatctgtcataattccgctcatatcaactgttccaactcttttcactaccctaatcaacacgacctgccaaaatggacattcgtacacaccactatcgaaataggacattgaacactcgacctgccagctccaaatagaaaagtgtactaatcccaatcttcaaaatcagaatttgtacactttcaatcagctatagatgccgtcatgccggcgtttatcggctatttttctgtacgttccaggacagtaacagattcaacatgcgtcgtctgtgggaactggtctactggctggattggctttgttacatggtagccttggtcagcaaaacgcttgatatcgcgaactaaggtagcaggattacaggaaacataaatcactttctttggtgccatcttaccagtagcttcgatcagactttcagcaagccccttccgtggtggatcaacgataataacatctggtttgagcccttctgcttgccacttagcaaattgatcttccgccttaccaacaacaaatttggcattcttaataccattccgtttagcattatgtttggcgtcttcaatggcggcgggaacaatttctactccataaacttgcttagcgtgcttagctactgccagggagatcgtgccaattccacaataggcatcgatgaccgtttgattgccgtccaagccagcattatcaatggccgtttggtaaaggcgttcagtctgttgcggattaacctggtagaaggacagtggtgagattgcaaaatcaatcccaaggagctgatcatgaatttcatcagcaccccataacgttttattcttatcaccaagcaagcggttcgttcgcttatcattgatgttttgcacaatactttttacttctggcactctggcaacgatcccgtcgacgatttgcttttccattggtaaccgcttcgtattcgtgactaagactaccatcatttcatggctgtaatatcctcgccgaaccattactgtgcgaatcacgcccttaccagtttgttcatcatatggcgtaatgtggtattgccgtaataagtcacgaacaaccgcaatggctttatcaatttctggatcctggatatagaaatcttcaattgatactaaattgtggctcccccgcttataaaaaccggtttctaattgaccgtggaccattttgactggtacttgggccttgttgcggtaatgataaggcttttccatccccatcgttggcaaaacttcaatctcatctaagtgtgctttggccaataattcttgaatttggtgttgcttgaatttcaactgggcatcatatttcaaatgaccaagcggcgcgattcccgtttgaatgtattttttatccttaacatcaacgcggtctggactcttcgtctgccagtccattacccgtccccaagcaaagtggctggttaccttggtgatctttaccgtaatctcttcaccaggaagggcattaggaacaaagacgggaaaatcatcaatcttaacgaccccattgccctcgtaagataaatccactaccttcgctggatattcttcatttttatgtactggaatgtttaatttcaaagttattcctccattaatttcaacgttacaaacttctcctattataacaaaacaaacggccaacttcctctttgcgaagctgaccgtttatttattctatttctttttgcgatctttataatcgtcaatgccattcataaagtcttcttcgacccgcttaaaatcagctgaggttgtaatcgcatcttctggaatctcatccaagttagcaattacttctaggtgctgcttaaggttatgaaatttcattggcgcgtcgccaccatattccccgtccaggttaaccatcaagcggtcatccttgtttagcggaataacttcaatatcggttgctttagcataaataatacgcggatcatcaaggtgctttccttgaagcgccttcgccattaagctgagcatatcgatcacactgctcttcttaacgataatcatcgtaaactttccatcatcaagtgatgcatccggcacaatctgttcaaaaccgccgaccgaattagtcaaggcaatcataaacatggaagcaccgccccggtattcctgattatcatacttgattagcatgtcgactggcttaatccgcggcattaactctgctcccttggcgaagtatgctgcgtaaccaaagagggacttcatttgcgaagggacctcataggttaattcagtcatcgttccaccagcagcaatattcatgaagtagttttcaccagcccgaccaatatcaatcttaaatttcttattcttctttaagattaacttagccgcggcgatcggatcatcacgaggaatccgtaatgcccgtgcatagtcattagtcgtccctgctggaataatcgctaatgttggccgatgttctaacccagcaattccattaaccacttcattcagagtaccatctccaccagcagctacaatcaaatcaaaaccgtcttcagcagcacgagtggcttcgttcttagccgagttaggcgcaggagtagtcgcaaaagcactagtttcatatccagctttctcataaattgcgagaatatcaactaaatcacttcgcaatgtttcacggcctgaggtaggattataaattatccgagcacgttttcgcacggtcatccctccctactctatttagccttcaaagacttcatcaataattgagtaacaacttgtgggttagccttaccacgcgtttgcttcatgatttgacccattaagtagccgacagcccggtctttaccattcttaaagtcttcaattgattgttcgttgttatcaagaacttcatcaacgattggctgtagttgcgcaggatcagataactgaacaagaccgtgttcctttgcgtaagcatttggttcttcaccatctaagattcccttgaagaccttcttagccatcttagaagaaattgttccgtcttcaatcaacttcaccataccggcaaggttagctggagtaagcttggtatcttgtaagtcaacttgcttatcgttcaagtatgagtttacatcgttcattaagtagttggctacccgcttaggatcgccaccgttcttaacagcttcttcaaagaaatcagacatttccttagtctgggtaagaaccatcgcatcgtaatcagttaagccaagatccttaacatagtgctcacgacgctcaccaggcatttctggcatttcgctttcaatttcgctaatccattcatcgctaacgtttactggtggcaagtctggttctgggaagtaacggtaatcatcagaaccttcctttgtccgcatcagaatagtctcaccagtcgcttcatcataacgacgtgtttcctgaccaatgtgtccaccagccatcaatactttttgatgccgtttttcttcaaatgcgagggccttccgaacatagttaaaggagttgatgttcttcatctctgtcttggtcccaaacttatcagaaccgattggccgaattgagatgttggtatcaacccgcatggacccttcttccatcttcacgtcagagatccccgtaaattgaatccgttgacgcaatgcttccaagtaagccactgcttcttcaggcgaggcaatatctggcttagaaacaatttcaattagcggtgttccttgccggttcaagtcaacgtatgaatacttgctggtgtgagtgttcttaccagcatcttcttcaatgtgcatttctttgataccgatctttttctttttaccatttatttcaatttcaatccaaccgtcatgagcaattggagtatctgattgagtaatctggtaggctttcgggttatcaggatagaagtagttcttccgatcaaagtgcatgtgatgggcaatttgagcatgaagagcaagtccagccatgattccgtcacgaacgacacccttgtttaagcttggcaatacaccagggtacccccagtcaatgacattggtgtttgcgttaggctggtcaccgtattcaacgggggatggactgtaaatctttgaattagtctttaattcaacgtggacttctagaccgattgttgtttgaaagttcatcttagttttgacctcctaactttggtgtcttcttgtggaaatcagttgtctgttcaaagacatatccagtgttataaactgtttgttcgtcaaatgcttttccgatgatttgcagaccaactggcatgccatttttagcagagaaaccagcaggaatagacattgcaggaaggccggccatattaacgggaacagttaatacatcgttcatgtacatggtttgtggatcatcaatttctgcaccaatcttaaatgccgttgaagcaccagtagcaccaacgattacatcatgatccttaaatacgtcttcaaaatcttgggcgataagacggcgaactttagcggccttattaaagtaagcatcatagaaaccagcagagagagagaaggtccctaacataatccgtcgcttaacttcttcaccaaaaccttccgaacgagaacgaacataaacgtcttccaggttcttaacatcagcagctcggaagccataacgaataccatcgtaacgttggaggttagaagatgcttcagatgaggctaaaatgtagtaagcaggaaccccatacttggtatgtggcaaacttacttcatcaacaattgcgccgagggattctaagtggtccaaagcagccttaattacttcttgaacatcttcgtctaagccatcaaagtattcctttggcacagcaatccgtaagcctttaacattcgtattttcgtttaattgggctgcccagtctggaacttctttaagtgaggatgtcatatcccgttcatcatttccactgatgagggcggtcaacaaggcattatccttaacattttgagtcaaccagccgacttggtcaaaacttgaaccaaaagcaatgatcccccaccgtgatacacgaccgtatgtaggcttcatcccaacgacaccgttaaaggaagcaggcatccgaatagaaccaccagtatcagtaccaagtgcacctaaaacatccccggccgcaacagcagcagcagaaccaccggaagaaccaccaggaacccgggtaagatcccatgggttatgagtcgtaaagaatgctgaattttcagtagatgaccccatagcaaattcatcaaggttagtcttaccaacgttgatgtaatcagcggcatttaacttttcaaccactgtcgcgtcatatacagggttaaagttttcaagcatcttagaagcagccgtcgttgtgaggcctttagttaagatattatccttaactgcaagcggaacccctgcagttaattgatcagcactaatgccctttgcatcaatctcagctgcccgcttcagtgcttgatcttcatttaagctgatgaaagctttaacttgatcttcattacccttaatgtggtcaaaagtttcctttgttaattcagttgcactgattttcttatttaccaagtcatcgtgcaattgactcaagcttgtttggtaaaaatccattattcgccgtcctcactttcgtcaagaattgctggaaccttgatgtagccaccatcagtttcaggagcattgttaagcaaggcttcttgttcgtctttagaactcttaattgccttatcttcacgcattacatttacccgatcggttgctgatgtcattggttcaacgccatcggtatcaaccgcttcgaggtcttcaaacatatcaataatgtttcctagttgagtggtaaacttaccaagttcatccttagggaactcaagcttagcaagttcagcaacgtgttctacttgttgctcagtgattttactggccattctctctacctcttttccagtaatttaaaatctacatatacatttaacaattttagcacagaataggttcctatttcatccatgtagaaataaaaaaaggagttatcggttcgcattttctagtaacgaatcgatattctccttttttcatctttaataagaatcaaaaatatgcgactggaagttatcagaaccagcattccggtaaacaaccgcttgaatttcggaatcagattgaatcttaatatcaatcggaatcccattaggtaggtacttctttgctgcccgggtaatatattgggtaaaactagtaatttcactttgactatagaactgagtagtaacagtaatgtgcatccccgataaagtcccattttcatattgagcttgtgctgtaactccactcaagttagggaagaaactttgaatctggctcttaaagtttgagaaactatcatcatcagtttgatcagaactattagttgttgatgcactagcctttggaaggactacattcttgtaatttaacttccgccagctactaattgtattaccactattcttactataagcaaagaatgtaccaccaactaaactatcatccggtgcttgtttgtatagtgcaatcacgattggaacatttccaacgcctgattttttccgtactcgttgaagaaccttttgtgccgcgatttcaccttgacgacgaacctcactatcactaatcttcttagttaaagttggtcctcctgtcttagtttggtagttgtattcggaatttattccaatcccaatcgtaatcccccgcaatttcatggaattaccactttcttgcatataatcttgctcttcaatttgttgaatatagactgggttaggattgctcttctttccttgagcagggtttagcccttcaggattactctttgtttttcgaccaagccagttttcaatcgtcccactactaaggtattgaccttcttggaaaatatagctttttgttgaaaagactcgttttgaaacctgggtcaaaccactttcaaagcttttaaggttatattggttatcattttgtgagacatttataccccgagctttacttgttcggtaacgaccatttttaatcacaccttgataagtaccattacttgaaccagtcgttgaatagtttttcgatgacgactttcctccaaaaccacatgatgcaagcaagacagtacacatcaaaacggcagcactaacggctattttttttgcctttcgcttcacgatttactgttcctccttcattgcttggctgaattgctgttcattccatacgtcaatacccaagtcttgagcttttgttagcttactaccagcatcagccccagcaatgacaatatctgttttctttgagacgcttccggttaccttagccccgtggttttcaagccatgattttgcttccccacgagtcatttcagttagcttaccagtcagtactactcgccgaccattccattcactatcaggattagcatttgaccgtgagccaagataagcaaagtttaccccaacttctcgtaattcgtcaattaatttaataacctgttgattagcaaaataagttacgatactttcgccaattgttggaccaattccactaatcgcagaaatttcatcggcatcggccttcattaagctatcaaggtcaccgaaatgttccatgataattcgagcagcctttgcacctacatgacgaattccaagaccaaataataagcgctcgacagaattattacgactattatcgatcgatgtcaataggttagaggtcgatttctcgccaaatttatctaaagttaataattggtcatgattaagtcgatataaaccggcaacatcatgaatcaattctttatcccatagctgttcaatgattctaggaccaagtccatcaatattcatggcattccgggaagcgaaatgtgctaagccttctttaatttgcgctggacacattggattaatacagcgtaacgcaacttcaccatcaagatgaactaattctgagccacagaccggacacttcgttggaatctcatattcaactgaatctgcagaacgtttagttggatctacttttgaaatttcaggaataatgtcacccgctttatgcaggtaaacagtatcaccaatccgaatatctttttcacgcaagtaatcaggattatgcaaagaagctcgactaactgttgtacccgccaattgaactgggtccataactgctgttggcgttacattgccggtccgaccgacagtccagacaatatcacggacaatcgttgcttgctcttcgggagggaatttataagcaatttcccagcgtggcaccttaactgtattcccaagggcaacttccgtatcaaggtcgtttactttttcaacaattccatcgatcccgtaagtgagcttgtctcgttgagctgtatattcttcaatatacttctcaatctcttcacggttatgaacaactcgattattaggattaacattaaaccctaattctcgcatacgatcaagtgcttccgcttgggtcttcacccccaacttttgatattcaggaacataatatataaatgtatctagttcacgttgcgccgttactttcggatctaattgccgcaaacttccggctgctgcattccggggattagcaaaaaccggcaatccttctgcttcgcgtttagcatttaactttgcaaaagccgctttgggcatataacattcgccccgaacctcgatcgataatggttctggcaattctgcgggaactgacttgatagttcggacattagcagtaacatcttcaccaatcgttccattgccacgcgtagaaccttgaactaactttccattctcgtaaacaagtgaaagagaaagaccatcgatttttagttcgagattatattcgggttcaacttcaacatcccgattttcctgttgtcgttggttaaagtccatcaattcttcaatcgaaaagacatcccccatcgataacatcggaatttcgtgccgaacttttgttaattggctttctgttgctcctcctactcgttgggttggcgaatcggcagagagcaattgtggaaattgttcttccagctgtactaatcgctgataagcacgatcatatacatgatcctctacagttggattgtcttgttcataatattcttttccccacttaatcaattttgctcgtaatggcttaatctcatcttgagcttcttgaagggttaattcttttactggcgtctgtttttcactcatctcatccgcctcatttcattattttcgtactttcgtaattggggcaaaacttgccaataaccgctttacaccctgacttggaaaggcaatatctaattccatatcattaccactaccgttaactttgaccactgttccttggccccactttttgtgttcaaccttatcgccagttttccagccaaccttatcggccccagttccggtgttagtaattggtttaacccgcttgccagcactgcgatatgttcgcttttgctgatcacggtaggtagtagcggttgcggcagcacgatcaaatggcagtttactatctttaatgctattacctgatgggctattttcaaactgtaacaactcagaatcaatttcttctacaaatcgtgatggttggttacgttggatacgaccataaagcaagcgtgaaaaggcattagtaagataaagctttttctttgcccgtgtaattccaacataggctaagcgacgttcttcttccaattcatcatcttccattaaagctcgcgataatgggaaaataccttcttccattcccacaaggaaaacaactggaaattcaagtcccttagctgcatgtaatgtcattaaagttacagctggtgcttgttcatcaacatcatcttgatctgagacaagggccaaatcagctaaaaagttaataattttttgcaagttaggatcatcatcgtctttatgctgctcatcatattcttgtgtaaccgacttaaattcatcaaggttttcacgacgagcttgtgcttcaaggcttcgatcatcacttagcattttgttgtagccacttaactctaaaatctgttcagttaaatcagttaatgtgagatattctgcttgtttagtcaagttagccattaattgaccaaattcatcaattttatttcgtgttcgtgcagtaatttcactagcagtatcaacattttgagctgcctttaataatgtccagccattttcattagcgaaattgcgaagatgttccacactagttaaaccaattcctcgtttgggcgtattaacaacgcgttcaaagctcattgaatcggcaggattaacgattaaggtcaaatatgctaaaatatcacgaatttcacgccggtcatagaatttatggccaccaaccatcgtatagggaatactactcttcaagaaagtttcttcaaccatccgtgattgtgcattagtccgataaagaattgcaaagtcattaaagtgatagccatgcttttcttgttcttctttaatcttcgaaacaataaactgcgcttcatcatgttcattttgcgcgcggtaatacgaaattttgtccccttgaccattttctgtccacagattcttcttttttcgataaaggttattagcaataacttcatttgccgcatttaaaattgtttgcgttgatcgatagttttgctcaagcattaccgtcttagcttggggataatcatgttcaaaattcaaaatattgttcatattagctccacgccaaccataaatactctgatctgcatcccctaccacacacaaattttggtacttttgcgctaatagattaactaaccggtattgggcatcattcgtatcctggtattcgtcaacatggatgtagtggaacttatcttgataaaattcaagcgtctcttgatcactttccaataactcaatggtcttcataatcagatcatcaaaatctaatgcttgattagtttctagctcttgttggtaaagcttatatgctcgcgcgaccatgttttcaaacatactattagcttctttgctatagtcatctggcgtcaacaaagcatttttagcattagaaatcgcacttaaaatactgcggggatcaaattttttagtatcaatatttaattctgcacaaatccgcttcattaacgtccgttgctcacttgtatcagcaatcgtaaaggcgcgattatagccaattttttcaatatcacgacggaggattcgaacacataatgcgtgaaaagtcgatacccaaatctcattagcactttcaccaagtaatttaccgacccgctctttcatttcgcgcgcagccttgttggtaaaagtaatcgctaaaatattccatggtaatacaccattttcttcaattaagtaagcaacccggtgtgtaagaacccgtgtctttcctgatccagcaccggccattactaataatggtccctctgtagttaatactgcttcggattgcttatcattcattccttctaataatgcttgcccgttattcacgctgttccatcctctctaaattttcatcggctaatattataccaaattaggatctcatttggtgctaaaatcgaacgtatgttaggaaaaataaagagactgcgatttcatccccagtccctcgtaatcttgtacgcttaatttataatttcgtgatcaagcttgttcgttccaaacttcagtatcgtcaacctgattctttaaggctgccaagttatcgccgccagttacccagacaaagcctagaattgcctgatcgtcatccccaacatcattaaagaacctaaattgccagttattctttagcaaccattgccgttgaattgctcgtgattgataattgcgaacgaccatcaataagccaatttgtaatggtgtaataacatgtaggggcattccaacagtgcttcttaattgttcttcatactggtcaacatttgctgtgacatcataaatattagcaatcgacgttaaccctggttcaatattctttacataaagagtaccagtagaagtaacataaaagttaaccgaaaataccccccgatattcaagagatgccgcaacactttttacaatccgttgcatctcttttaacatatcatcgtgaatatttgctggtgtcgcaacagaaatcaattggcgcttgtcattgtaatgaagctgagcaagtgggaaaatctctgtatcttttccatcagttgccgctgtcatagtatattcatttgtatgttcaatccacgattctagtaaatatgtacccgtatcaataaaatcagcggcgcgagtaatatcagattggcgctcaatcagcattgaattttccccaattcctcgttgaatgggttttaacaacgcaggatagccaatggaatcgattgattggtaaacatcatctaaactaaccaccgtcatatatggagcaatattaatatttacctgatctaagaaagcacgttccattaatcggtcttgaacaatctcaagagcattaatcccctgaggaatcactgcatattgactcaaaaagtgcatgacgcgagaatcgacattaggggtttgataaataattgcatcacatgcttcaccaaactgagttagttttgtccgatcgttcattgcccctacaatggtaaagtcagccattttagttactaatggctgagaacgatccacatacacaccaacgttaaagcctgccttcttcgctgttgcaataagtgctgccccattgcgattaattccaataattcctaaagtactacctgggtaaatagcatctctgcccattttatcacttcccttattagtcttttacgaattcaactttattatcactcaatgattgaattcgtgccaatgattcgacacgaattccacgttcttttagttcaccagctccaggttgaaaactcttttcaataactattcctgcacccgctacttgaacccctgcttgatcggcaatttctaataatccctctactgcttgaccattagccaagaaatcatcaatcattaaaatcttatcattagcatctacatactttttagaaattgaaatccgattggttgttttcttagtatacgaatatacatcagcagtatacatattttggttaagagtaagactcttatgcttacgagcgaaaataactgggagattcatttccaacccagtcattacagctggagcaattccggatgattcgactgtccaaatcttagtaatgccttcattagcgaaaagcttggcaaattcttgaccgatatgcaacattaattgaggatcaacttgatggtttaaaaaagcatctacttttaaaacattacccggtaaaacagtcccgtattccttaatcttttcttctaactctttcatttttgtccccctctacattactcattacttatcataattatataatttatacgccttaatcaccgaaattaatttttgtgcataatcaggatcagtcgcataacctgcttcttgcaatccccgagctgcttcttgataattagtcgcatggacaactcgatcataattttgctgattggtgtctgttccatttaacatcaagcgcgtatggtctttaatagaatcactccaactatcataaacgcggaatcgtcccttagtaacgatccacttaccattaatatattctttagttgtcattactcgtgaatttgctcccgttcccttaattccaaataaattatgatattgtgacgctaactgactcgttccccattgagattcaagaatcgcttgggcaatcgtaattgatgcatagatatgataggtattttgcattgcctgggcttcaggagcaacttgctgaataaataattgcttcgctcggcgatccttttcacgtgcctcttgttcaattcgttgctgattccagattcggtaaaaatggtgcccaacgtaaacacccaaaaagataacaataacagcaagaatgctaataatccaatttctacccgtatggcggtttttgtttctccgcttccgttttgccacaagcttagcctcctcttttctactagttattaattgtagcaaaatccatctcgtttgggttaatttatcgtaatatttttagaagaagttaaaaaagcacaactgaaaaattttttccagttgcgcttgctgctactagccttaagtattaatggaattgcattccaccatcaacaataattgtttgtccagtaacgtaatttgaatcaggaccagctaagaaacttaccacattagcaacatcctctggttcagaaagacgcttcattgcaatgttcttggcaaaggtttccattccccattcatcacttttaccagcattttgaccaacttgatgtgcaatatcatacatcatcggtgtcttaacgattcctggtgcaaaagcatttaccgtaatatcttcagttgccaaatcttgagctacgacctgcgtaatgcctcgaatagcaaattttgttccagaataaagtgcaagattaggattaccaacaacaccagcttgagatgtagcattgataattttaccaccatggccaagctccttaaatgccttgtgggcagcttgaattccccataaaaccccagcaacatttacaccatatactttttcaaattgttcaggtgtaattgaatcaattggggtagtaggacctaatccagcattattaacgattacattaagatctccaaaatgttcgactgtcttctcaacagctgcaaacacttcttctctatttgctacatcggctacaagtggtaatgcttccccaccattattagtcagttcatcaacaacttgttggagctttacctcgtttaatgctacaagagcaactgcaaagccatccttaaccaatctttctacaattgccttaccaattccttggcttgctccagttactaatgctacctttttagtcattagtaatccctcctttatattagttatcatttattataccgtatattaaattccgtttaaatataaaaaagacaccagcaaaatactgatgtctctggaagcgataatcgaaatattaacgcttactgaattgagcagccttacgagctttcttaagacctggcttacgacgttccttcatacgagggtcacgagttaagagaccagccttctttaaagcgtcacggaagtctggatcaacagcgagaagtgcacgggcgataccgtgacgtactgcacctgcttgaccagagaatccaccaccattaacgttagctaaaacgtcgtattgaccttctgttttagtaacagcaaatggttggttaacgatagcacgtaagttggcaaatggaatgtagtcttcaattgccttgccgttcatcgtaatcttacctgaacctggtactaagcgaacacgtgcggttgcatccttacgccgaccagtaccactgtattgtacttgttgagccaattccattccctccttagattaagttagtaatgtctaaaacttctgggttttgtgcagcatgtttgtggtcttcaccagcataaacatgtaacttcaaaccttgcttgtgaccaagagagttgtgtggaagcatacccttgatagcagtttccaataacttctctggttcctttgcaaggaagtcaccagcagtccgttgcttcaaaccaccagggtagtttgaatgacggtagtacatcttttgagatgctttcttaccagttaacttaacttgcgcagcgttgataacgataacgtaatcaccagtatcaacgtgtggagtaaatgttggtttgttcttaccgcgcaaaattgatgctactgcagatgctaaacgacccattgggacattcttagcatcgacaacgtaccatttgcgttcaacttcaccaggttttgcgatgtatgtcgttctcacgattaagtcctccaattttgtttttcttttacatataatagtgtaccgagttattagatggaaaagaaataccaatggctagtataccttcttctagtactttcgtcaatccttttcatcatttgttccataatctacattaactaaatataaaccacttgctggagccgtcatccgtgccaatgtccgatcctttgcctcaaggactctagacacgtcatctactggccgctgattgctcccgatttctaaaagaaaagccaccattattcggacttggttatagagaaaaccattaccagtaaaatcaaagacgacttcatttcttaattcatctcgtttaatcgtgatactctcaatcgtccgaacattgctttttgcttgactccccgacgcaacaaaacttgtaaagtcatgagttccaactaaatcattagctgcttttctcatcttttctaagttaagaggatatttaaaatgagaagtatagttgcgtttaaatgggttcacaaattccccctgatcaacccggtaacgataagtcttacgatgagcactgtatcgcgcatggaaatcattatccactaattcggccttcttaattaaaatatccagtggcaaaatactattgagggcttttctcatagattcattacttaaatgatagggaatatcaaagtgcgcaacctgattaagagcatgcacccctgcgtctgttcttcctgagccgataacaggaatagcaggatttgggtgcttagcaattttatttactgcattctttaatgtttgttctactgtccgcttatttggttgaatttgaaaaccggaaaaattggttccatcataagcaaaggttattttataacgatacattgtttacttccttattaatttagaaaaatattcgaatacaaactagaccaactgtcacaatcaatagcgccaagccagcccaagcatcatttttatgccaaactaattgacgataatgagtccgtggtgcattaggatcataccctcgtgcttccattgccgttgctaattcttcagcacgcttaaacgagttgacaaacaatgggataagaatcggaactaaatgtttaatccgtgtcaaaagatttccagcgttaaaattaatcccgcgggcccgctgagctttcataattttattagtttcatccataatagttggaacaaagcgtaatgcaatggaaagcattaacgtaatctggttgacaggaactttaatcacttgtaatggtttcattaaccatgccaaggcatctgcaatttgaaaagtttgcgtagtggcagttaagacagttgaggcagtaataatcaaaataaaccgataaaaaataattaatgaattaataaggccgtcacgggttattgccataattccccaatgccaatacgtctttccgccactactaaataaaatttgaaacgctactgttatcaaaataattaaaaataacggcttaatcccttgccaatattgtcttaaaccaacattacttaacttaattgccgcaaggagcgctaataaaagccatatagcagctaaaaaattattcacgaagaaaattaaaataacgtaaataatacacatgattagttttattcgtggatcaagacgatggaggatcgattttactggtacataactaccaaatacgattttactattcattttctttttctcctcatcgcttctgctatttcatctgctaacacatcaagcgtaagcggttctgtattttttaaggttatcccatctttactaaggaattgcgcaacctcgacggaaacaggcaaagtcaatgatagtttttttaatcgttgagcatccctaaataattgctgaggagtagtatccgcaacaatctgcccattgctcattgcaattacgtggttagcataataggccacctgctccatttggtgagtaaccattataatcgttgttcccttctcgttaagatctttaataagtttaagtaaatcattagttgcttgagtatccagtcctgctgttggttcatcaagaattaaaatttggggatccattgctaaaacgccagcaatcgctactcgcctcatttgtcctccagaaagtgcgaaaggggagtgtgactttaattctaagggcaaatccaccatttttaatgcttcatcaactgctttttcaattttttttgcaggccaccctaaattatgaggcccaaaagcaatatcctccgcaactgtttctgcaaatagttgctgttcaggaaattggaatacaaaaccgacttgatggtggattttacttaaatattcagtttttgtcgttgcattaatttctaaacctgctacattaagttccccactactgggctttattaatccatcaattaatgaaaccaatgtcgactttccacttccggtttgtccaataatagcaacaaattcttgctctttaattgttaatgagacattatgtaaggcttcattagtagaattaggatatgtatagtggagtttttttactgtaattgctgctttagccaattttttagctcctctaaatttaaatatctatttggaacattaattcctcgttcaaccaataatttctgcagttgctggcttgcgggaattcctactccaatttcaagtaataattctttatctttaaggatttccgatggagcaccttgttttacaacttgcgaatcatttaatacaactattttgtctgctaattcaatttctttaagatcatgtgtaattgaaataattgaaagattatattctttttttaatttttgtaataaagctaaaatttcttgtcgtgctaaaggatcaagcatactagtggcctcatcaaggattattatcttaggcattaatgcaaggattcctgcaagtgctacccgttgcttttgtcctcctgagagattaataggagctgtgtttttataatcactcattcctaccatctttaaggctttatcaatcttttcctccattttatttcgatctacttgtcggttttcaagtccgaatgcaacatcgtcagcaacggttgctcctacaaactgattttcagggttttgaaaaacgaatccaatatgctggtgaatcttgcctaaagaactttcgttaacttgtatttcgtcaacttcaatcgatcctgcagtaggactaagcaatccatcaattaatcgggctaatgtactctttccactaccattatgaccaataatcgctgtccaagaaactggttcaaaatccagattgatattttttaaaacggggtatttactgtctggatatgtaaatacaagttttcgaatctttattccagtcacagtatttcctcttttcaatattagttaataagtatattttagcaaagtccacagaattatctatcaaaattaaatttaaaataaaaaatcacttaccattgaagtgcacgagggtttcccgcattcaagctagactagggtttccccaccatcgtaacgctctatactatcaatgatagtgattctttattacgtatttaatttatgtgaacaaatcaattagtccactaattcaagaataaccattggtgcaccgtcaccacgacgaggcatagtcttcaagatgcgtgtgtaaccaccgttacgatctgcatactttggagcaagttcttcaaaaaggttttgaagagcagattgtacacgaatatcatcgccatcttccttaacatcagcaacaacattacgtacaaaagcggcagccttacgacgagaagctaaatcaccatgcttagcaagtgtaatcatcttatcagcggtcttacgaacttccttagcacgtgcttcagtagtggtaatacgaccattaacgattaaatctgtggttaaatcacgtaataaagccttacgttgtgaacttgtacgtcctaatttacggtaactcataaagtggttccctcctttgcaattggtatactaattagtcgtcttggcgaaatgaaacaccaagatcatttaatttaagtttaatttcttctaacgacttttgtcctaagttccgaaccttcatcatatcagacactgttctatcagttaattccttaacagtattgataccagctcgcttcaaacaattgtaagaacgtacagagagatcaagctcttcaatagtcatttcaagcatcttctctttgtgtgtttcttctttttcaaccatcacttgagcattttgagccgtttctgttaaatcaacaaacatagctaagtgttcagtcaaaatcttcgcacctagactaactgcttcagttggtgttaatgaaccatcagtccaaacatccagcgtcaacttatcataatcgttacgttgaccaacccgtgcattttcaacagtgtaatttacacgttcaattggggtatagatggaatcaatcggtaaaacaccaattgctaaatcatccatccgggccttattatcgttagcagaaaggtaaccgcgacccttatcagcagttaacttgatgtgtaattctgcgccatcagcaacagttgcaatatgcagatcaggatttaagattgtaacttcattatcaccctggatatcacttgcagttacttcagcaggtcctttaacatctaattcaagattcttttgatcctcagaatcaagcttcaaagaaactttcttaagatttaggataatctgcgtaacatcctcagttacaccttcaacagtgctaaattcatgtaaaacaccatcaatttgcatactcgtaatcgctgcacctggtaaagatgcaattaatacacgccttaacgagttaccgagagtggttccataaccgcgctcaagtggttctacgacaaacttaccgtagttatctgtttcttcaactttgtgaatatttggcttttcaaattcgatcattctatccttgtacccctttcaaaacgtggttcgtatttgagacaaaaaggcaattgatggaaataattgtctccagcaatgtcaattaaacacgacgacgctttggaggacgagaaccattgtgaggaacaggtgttacatcacgaatagcagtaacttccaatccagttgcttgaagtgcacggatagcagcttcacgacctgaacctggacccttaacttcaacttcaacagtcttcataccatgttccatagcttgcttagcagcagcttctgatgccatttgagcagcaaatggagtggacttccgacttcccttaaagcctaaaacaccagctgaagaccatgctacagcgttaccttgaacgtcagtaatcatgatcaatgtgttgttaaatgttgagtgaatgtgcgcaacaccagtttcaacattcttttttgcacgacgcttacgcgtaccttttttggttgccatatctagtactaacctccttttttataaagttaaactacttcttcttattagcgatagctacagccttacccttacgagtacgagcattgttcttagtgtgttgaccacgaacaggtaggccacgacggtgacgcataccacggtatgatccaatttcttgaagacgcttgatattcattgaaacttcacgccgtaaatcaccttcaacttgaatttgatctacttgtgcacgaatcttttcttcttgatctggagttaaatcacgaacacggatgtcttctgatacaccagcattttcaagaatcttcttagcagtagaatcaccaataccaaaaatatatgttaagccgactacgattcgcttgtcacgaggtaaatcgacacctgcaatacgagccatgagctacacctccatttctctataaaataaattacttaccttgacgttgcttatgctttgggttagcagagcaaataaccataacacgaccgttacgcttaacgatcttgcagtgctcacacatctttttaacagatggtcttactttcattctaaaatcctcctattgagagtaattgatcaataactacttgaaccggaaagtaatccgaccctttgtaaggtcatatggagacatttctactttaacacgatcccccggtaaaattttaatgtagtgcatccgaattttaccagaaacatgtgctaaaatttctgctccgttttccaattcaactttaaacattgcattaggcaaagtttcagttactttaccttctacttcaattacatcggcttttgccacgaaatagtacctccttgcctattctagatattacgtaaaaatggtggaaagtataaaacttcccactactcagatagataaaccttgcatagtttagcatatgtttacaaacttcgcaagagataactattatctagtttaggtttgttaatactttcttgatatcttcgtaaactttatcgatatcttgttcaccattaatttcgtgcaaaacacctttcttttggtaatagtctaccagtggtgtgttcaacttaatattaacatctagacgattcttaaccgtttcaggcttatcatcatcacgctgataaaattcatgatgaccacaaacgtcacatgtgccttcaactttaggaacattgtaaagcttatgatacgttgttccacagttacggcaaataaaacgtccacttaaacgttctaccaatacatccggttcgacgtgaatattgatcacagcatcaagatgccgattactctctgctaacatcttatccaaagctgctgcttggttaagattacgaggaaatccatccagcataaagccatctttagtatcatcttgagctaaccgttccttaacgataccgttagtaacttcgtccggaacaagttcacctttatcaatatatttcttagcttcaattcccatgggagtttcattttttatggctgcccgaaaaatatctccagttgagatatgaggaattggaaaatcttcaacgatcttttgagcttgagtacctttaccggcacctggaagacccattaatacaagattcatactcattagtcatttcctcctttaggttctcgaataaatccaatatattcgcgcttcattgttagtccgtttaactgccgaacaacatctaaagcaatttgtacgataatcagtaagcttgtaccacctaaaccaattgactgacttaggttccatacgttacttgcaattaacggaattaaggagatcaatcctaagaataatgaacctactgtactcaatcgcattaacaatgaagaaatatagtcttgtgtaccctttccaggacgcactccagaaatataacttccttgcttttgcaaattctcagcaagtttttctgggttaacctgaacaaaggcatagaaaaaggtaaatacaacaatcaaaaatacatacagtgcgatcccaggaccagattgcatgttaaaaatggtcgtcatgatttgataccaactatccccaccatggttttgctggaaagccataagaatagtttgcggggttgagataaaagaaccagcaaaaataacaggaataacacctgatacgttaatcttcaagggaagataactactggatggtgaagtagtggttcgtcttgtgtattgaattggtagacgtctttctgcctgttgtacccatgtcacaaacgctacaataattaaaattgcaacaataacaagagtaacaaatccaattcccatccacaaagcagaaccagattcaccagcaatttggtcatcccataactgacgaattccacctggcatttgcgcaacaataccagcaaaaattaacatggaaacaccattacccaagccacgttcagtaatcatgtctcccatccaagtagcaaacattgtacctgcagttaaaattaaaccgattgttaaatacgtttgaacaccaggatgattaaccaaacgaatagtactcaatgcattaaacccggcggtaataccgattgattggataaatccaagtacaatcgttaaccatcgggttgcttgattaagttttcgccgtcctacttctccttgtttactccattcaacaaaacgcggaacaatatccatttgtaatagttgaacaacaatttgcgcagtaatatatggagaaactcccattgcaaataaagagtaattctccaatccaccaccactaaaggtattgaggattgatgctaaaccggttgaggagatttcctgcaaagcagcagcgttaactccaggaacggtaatcgctgccccaatccgatagacaatcaatacaaacaatgtaaagaaaatctttttacggatatcttttaccttgaatgtatttttgacggctgtgaacaaactacatcacctcagttttaccaccagcagcttcaattgcagaaactgcagaagcagaaaacttattagccttaacagttaatttcttttcaagcttaccgttaccaagaatcttgatgccgctcttcaagttcttaactaagccactttccatcaataattgtggagtaacttctgtaccatcatcaaacttgtttaatgatgccaagttaacaattgcgtattctttccggttaatgttggtaaatccgcgctttggaatttgccggtaaagtggcatttgacccccttcaaatcctaaacgggtctttccatgagccttttgccctttagtaccacgtccagatgtaaaaccgtgtcctgatgaaagtccacgacccttacgaagacgcttagaacgagaaccagcagctggcttcaattcgtttaacttcattagtaggcacctccttattatttaattttaattacttaacttcttcaacagaaaccaagtgagcgatcttaaaaatttgaccgcgtgttgccgcattatctggtaagataactgagctattgatcttacctaatcccaatgccttaacagtacgacgttgagtaggttgtcggtgggcaacactgtgaattaaggtaacttttacttgagccataatttagtgccctccttattctgctaagtggtctactgaaacaccacgtaactttgcaacttcttcagcgttctttaattgcttcaaaccttcaaatgttgcacgaacaacattaacaggtgtgttagagccaaggcgtttagaagtaacgtccgcaacaccggcaaggtccataacattacgaaccgcaccaccggcagcaactccagaaccttcaacagctggctttaacatgatctttccaccgccgtatacaccaataacttcgtgtggaatagtagttccaacgataggaacagtaatcaagttcttttcagcagctgcttgagctttacgaatagcttctggaacttcttgagccttaccagtaccaaaaccaacatgacctttacggtcaccaacaattactaaagcagcgaaacgcatacgacgcccaccttttacaaccttagtaatccggttgatggctacaacttgatcgtctaaatccaactttgttggatcaatgaattctgatgatgccattgcaggttattcctcctttttttagaatttaagtccgttttcacgagcagcttcagccaaggcttgaacacgtccatggtaaaggtatccaccacgatcaaacacaacttcagtaatgttcttttcgttagcgcgtttagcaattaatgctcctacaccactagcttgttcagtcttagtctttccacttacttcactatcatttgtggaggcacttgcgagcgtcacaccctttacgtcatcaattaattgagcgtaaatgtttttgtttgaacggtaaacacttaagcgtgggcgctccgcagtaccagaaatcttaccgcgaacgcgtaaatgacgacgttgacggatcttgttcttgtctggtttagaaatcacaacagtcacctcttattatattaattatattaaataaaagaatgttaaataatcttctcagattacttaccagtcttaccttccttacggataatgtgttcgttttcgtaacgaatacccttacctttgtatggttcaggtgaacgtacagcacgaacttcagcagcaaaattaccaaggtgttccttgttaattgagcttaattcgatagtagtattgtcaggtacgttaatttcaacatcttctggcttatccatttcaactgggtttgagtaaccaacagttaaaatcaacttgttacctttgagttgagcacggtaaccaacaccaacaagcttaagaaccttcttgtaaccattaacaacaccttcaaccatgttgttaacattagcacgagtagttccgtgtaacatctttaacttattagtatcagcatcacgatcaaactttacaacgttaccatcaatagtcattttgattaatggtgaaatttcacgagataaagtacctttaggacctttaacagtaactacattaccatcttgagaaatttcaacaccacttggcaaatcaatttctttgtaaccaatacgactcatctttgcacctcctatctaatattcgttttttaccaaacgtaagcgataacttcgccaccaattttcttggcacgagcaactttatcagtaacaacaccttcagatgttgaaatgatagcaatacctaatccattaagaaccttaggcacagcatctgacttaacgtatgtacgtaaaccaggcttagaaatgcgctttaagccagaaataacacgttgaccgtcattaccgtactttaagaacacacggatgatgccttgcttgttatcatcaacgtattcaacatcgcgaatgaaaccttcgttttttaagatttcagcgatgtccttcttcatctttgatgcaggtgcttctactgattcgtgttgagccatgttagcattacgaatacgagttaagaaatctgcaattggatcactcatagacatcgatgttttcctccttttgtcggtttttttgtttaccagctagccttcttcaaaccaggaatttgtcctttgtgggcaagttctcgtaagcaaatccggcataggtggaatttacggtaaacagagtgcggacgtccacaacgtgcacaacgcgtgtattcacgacttgagaacttagctggacggttgcacttagcaatcattgattttttagccaatttgtggaacctcctttatttagcaaacggcataccgagttgagcaagtaattcgcgggattcttcgtcagtttgtgcagttgttacaataacaacatctaaaccacgaactcggttaactttatcataatcaatttctgggaaaattaattgttcatggataccaagagtgtaattaccacgaccatcaaatgccttgttacttacaccatggaaatcacgaactcgtggcaatgccacattaactaatttatctaagaaatcatacatacgttcaccacgcaaggttaccttagcaccaattgacataccttcacgaagacggaaaccagcaattgatttcttagccttagtaattaaaggcttttgaccagaaatcaagccaagttcttcaacagcttcatcaagattcttggagttagtagttgcatcaccaacacccatgtttaaaacgattttgtcaatctttggtgcttgcataactgaagagtagttaaacttttcaattaatgctggacgaatttcattttcgtatttagctttcaaacggttttccattagaagttattcctcccttccttaaaaattagtcaagtgtcttacctgacttcttcgcaacacgaaccttcttaccatcaacgaacttgtaacctacacgagttggttcatttgttgaaggatcaatcagcattacgtttgaagcattaattgcagcttctgtatcaataacgccaccattagggtttgagttgcttggtttttggtgtttcttaacgatatttacaccttcaacgataacgcggttttgagaagcaagtacctttttaatagtaccttctttgcctttatccttaccagcgattacgcgaaccttatcacctgttttaatgaacatgttgattgtgcacctccttattttcggtaaaatctttagagaacttctggagctaatgaaacgatcttcatgaagtcgtctccacgaagctcacgagcgattgggccaaaaatacgggtacccttagggctcttgtcgttgttaattaaaacagcggcattttcatcaaacttaatgtatgaaccatccttacggtgaataccatgtttagtccgtacaacaacggccttaacaacgtcaccctttttgacaacgccacctggtgttgcctgctttacagtagcaacaatgatgtcaccaatattacctgttttaactcgggaaccacctaaaatcttaataactaagatttcacgagcaccggagttatcagcgaccttcaaccgactttcttgttgaatcacggttaatgtcctccttccatttacaaataagaattagaatacgaataatttttagagttatctgctaaattaaagggtagcagctttttcgacaatctttacaagacggaaacgcttcttagctgataatggccgagtttccataatttgtacagtgtcgccggtcttagcttcgttgttttcatcgtgagcatagtacttctttgagtacttaacacgcttaccatagataggcgcactcttgtaagtatcaattacaacagtgatagtcttatccattttatcagaaacaacgtggccttggtaaaccttacgtgcattacgttcttcactcatgcgctaatcctccttttcgtattcttatttgtttaattcttgttgacgaagaactgtcttaacccgtgcaatatctttgcgtacttgcttaagacttgcagtattttccaactggccggttgctaattggaaacgtaagttaaacaattgttccttcagttccttttcacggtcaagtagcttatcagtggttaatccattcagttcttgtacataatctttacttttcattagattgtccacctacttcctcacgttgtacgatcttagtgcgaactggcaacttgtgaccggcaagacgtaaagcttcacgagcgacttcttcagaaacgccccctacttcaaacattaccttgccacgttttactggagcaacccatccttcaggagcacctttaccgttacccatccggaccccaacacctttactagtgtatgagagttgtgggaagattttaatccaaactttcccaccacgcttcatgtaacgcgtcatagcgatacgagcagcttcaatttgacggttgctaatccaatgtgaatcaagagcttgtaaaccaaattcaccaaaagtaacagttttaccacccttagcttcaccgcgcatatgaccacgttgaaccttacggtgctttacacgttttggtactaacatgtgttacttccctccttgttcatcattgtttgagttcttcttagtaggaagtacttcaccacggtaaatccaagtctttacaccaagaacaccgtatgtagtgttagcttcgtcccaagaataatcgatatcagcacggagtgtatgcaatggaacagtaccatctgagtatgattcgatccgtgacatatctgcaccgttcaaacgaccagcaacttgagtcttaatacccttagccccagcacgcatagcacgttgcatagccccacgcatagcacgacggaaagcaatacgagcttctaattgccgtgcaatactctcaccaacaaggtgagcatctaaatctggcttcttgatttccacaatgttaatgtgaacacgtttaccagttaatttgttaagttctttacgaagtgcttcaacttctgaaccacctttaccaataaccattcctggcttggcagtatgaattgatacgtttacgcggttagctgcacgttcaatttcaacggttgatacagaggcatcagcaagtcgcttttcaatatacttacggattcgaaggtcttcgttaaggtaatcagcaaagtccttgtcagcgtaccactttgcagtccaatcacgaatgaccccaacacgaaaaccattaggattgatcttttgacccactattcattcctcctatcgttctgtaacaaccactgtaatatgactagtccgcttgttaattggagaagcagaaccctttgcacgaggacggaaccgtttaagagttggtccttcgttagcaaaggcttcacttacaaccaatgaagcacgatctaagtcgaaattgttttcagcgtttgcaacagcagattttaatactttttcaacatctgaagcggcaccacgaggggtgaacttcaaaatagcaaatgcttcggcaacactcttgccacgaatggcatctaatacaagacgaaccttacgagcagaaacccgtaccatcttggcagtagccttagctgacgtaatgttttcagccatatgttatttcaccctccttacttacctgtcttcttgtcatcagaagcatgaccatggaaagtccgagtaggaacaaattcacctaacttgtgaccaaccatgtcttcttgtacgtaaactggcacgtgcttccgaccatcatatactgcaaatgtgtaaccaataaaacttgggaaaatggtagaacgacgtgaccatgtcttgatgacagtcttcttttcagaaccttcttgctccttaaccttcttcagtaatgaagcatcagcgaaaggtccttttttcaaactacgacccatttagtgtacctcctctcgggtattagaacgtatataaatattaacgagtatgtggaccgcgcttccgaccacgaacaatgaacttgtttgaacgagctttgtgtgaacgggtcttcttaccaacagtcttcttaccccatggagaaagaggagatggtaaaccaactggttgcttaccttcaccaccaccatgtgggtgatcgttagggttcataacagaaccacgaacgtgtggacgttgaccagcataacgagtacgaccagccttacctttaataatcaaggcgtgttcatcattaccaacagtaccgatagtagcacggcaagtagcaaggaccatacgaacttcaccagaagaaagacgtactaatacgtatttttcttccttaccaagtaattgagctgaggcaccagctgaacgagcaagttgaccacctttacctggttttaattcaatattgtgaataacagtaccaactggaatgttctttaaaggaagagcattaccaaccttgatatcagcatcaggaccagattgaacggtcatgccaaccttcaagcccttaggtgcaatgatgtatgatttagtaccatcagcgtaaacaagtaaagcaatatttgcagtacgatttggatcgtattcaattgccttaacagttgctggaacatcatctttaattcgcttaaagtcaataatacggtattgacgctttgtaccaccaccacggtgacgaacagtaatatgaccatagctgttacgaccagcagtgtgctttaacggagccaataatgacttttcaggtgttgtcttcgtgatttcagcgaagtcgtaaccgttcatattacggcgaccgttagtggttgctttatatttacgaattcccactgttttttcctcctttttttaatgattagttttcgttgttgtcgttaaacaacttaatttcatttgagtcggcagataaagtaacaatagccttacgacgacgcttagtgtatccttcgtaacgaccttggcgctttaacttaccttttacattcataatgttaacttttacaactttaacgccaaaaatttcttcaacagcatttttaacttgtgtcttagttgctcgtaaatcaacatcaaaagtgtaacgcttgttgtccataccagccattgaagcttcagtaactactggacgtaaaataatgtcgcgtgcttccattatgcgagcacctcctctacttgagaaagagctgacttagtgataacaatcttttggttatcaacaacgttcaagatgttaacacctgctggagtaacaactgtagcattagctaagttacgtgctgataaagcagcattcttgtcgtcatcagtaacaacaactaatgtcttttcagcaacgtttaagttacccataacatcagcgaattcctttgtctttggtgcatcaaagtttaatgcatcaactactacaaagctgttatcaagaaccttttgggaaagggcagacttgattgcaagttgacgaaccttacgaggaaggctgtacttatatgaacgtggagtaggtccaaaaacaataccaccaccacggaattgtggagaacggatagaaccttgacgagcacgaccagtacccttttgacgccatggcttcttaccaccaccgctaactgcagaacgattctttacagcatgtgtaccttgacgtaatgaagcacgttgacgcaaaattgcatcaaatacaacattttcatttggttcaacaccaaatactgcatcgtttaattcaacagtaccgttttggctaccatcttgtttatataaattaacgctagtcattatttacttcctcctttcttcttatttattgtgttgtttgctaagactcttcttagtattagccttaactgagttcttaatagttacgtaagacttgtttgcaccaggaacattacccttgatgagtaatacgttgttgtcaagatcaaccttaacaacttgtaagtgttgcatggtaacagtcttgccacccatacgaccagggagcttcatacctttgaaaacccggttgataatggcacccaatgaaccaggacgacggtggtaacgagaaccgtgtgccataggtccacgagattggttatccttatggatgttaccttggtaaccatgacccttggtagtacccgtaacgtcgacagtttcaccttctgcgaaaacgtcagccttaacttcgtctccgactttaatgtcccctaattcagcgtcgcggatttcaccgatgaagcgcttaggggtcgtgtttgcttttgctgcatgaccttgttcaggcttgttgctcaaaacttcccgcttgtcatcaaaaccaagttgtacagcactgtaaccatcgttttcaacggtcttaatttgcattacaacgtttggtgtaacatcgataacagtaactggaactaattcaccattgtcagtgaatacttgagtcattccaacctttttacctaagattcctttggtcatgagtacacctccaattttatgttttatgtattattcttattctaataattaaagcttaatttcaatatcaacaccactaggaagatcgagcttcattaatgaatcaacggtcttaggtgttgggtcaacaatatcgattaaacgcttgtgtgtgcgcatttcgaactgctcccgtgacttcttaaatttgtgtggtgaacggataacagtatagatagtccgttcagttggtaatggaataggacctgaaatttgagcacctgtccgcttagcggtttcaacaatcttatcagcagattgatctaaaatacggtgttcataagcctttaaccgaatacgaatcttttgttttgccattatgttccctccttcgtcagatttgaaatttgactagctccgcggaaattaccgccacatcctgtggcaaagcggccgggtgtgtcgcaaccttccgcatcaacgcttcgcagctttcacttaatagggggtaaggcaaatctacctccaaagctcaagcacttatccataatactaaagaaacgtaattagatcaagggaaattttcgaatattttcaattgaaatatttttgtaaaattttcttcctaagttagttaaaaattagcgatactaaaataccattaatttttctgatgtattaaaaagtaatttatttgttttgacgaaattcattaaaatgctttttgaatttttatcatcaaacaaaaaagaactacagtaatcaaactgtagctctttgatggacttgagatcacaatgtcaataattagttattgccaccgtttttcttaataatatcttcttgaacagacttaggaacagctgagtagtgatcgaaagtcatagtgaaggtaccacgaccttgtgttgctgaacgcaatgcagtagcgtatccaaacatttcagaaagtggaacaaatgagtggattaattgagcattaccacgttcttccataccatcaatggtaccacgacgagctgttacttgacccataacatcacccatgttgtcttgtggtacaacaatgtcaaccttcataattggttcaaggataacaggatctgctttcttagcagcattcttaagtgctaatgatgcagcaaccttaaaggcggcttcactagagtcgacttcgtggtaactaccatcataaagtttagcatgcatgtcaacaagtgggtaacctgcaagaacaccattttgcatagcttcctttaatccttgttcaacagcagggataaattcacgaggaacaacaccaccaacgatggcatcttcaaattcgaatccttccccttctttaagtggtgtaaattcgatccatacatcaccgtattgacctttaccaccagattgacgaacaaacttaccttgagcacttgcagtcttagtaaatgcttcacggtatgaaacttgtggcttaccaacagtaacttcagcgtggaattcccgacgaagacgttcaacaataatgtccaagtgaagctcacccataccagcaattaaagtttcaccagtttcaggattagtttcagccttgaatgttgggtcttcttcagcaagcttttgaagacccttgtccatcttatcttggtccgccttagacttaggttctacagaaacttggataacaggttctgggaagtccattgattcaagttgaagtggatggtcaggatcagttaatgaatcaccagtagtagtgttcttcaaaccaatagcagcagcaatatcaccagagaatacttctggaatttcttgttgttggttagagtgcatttgaagcaaacgaccgatacgttcacgcttgtccttagtagcattaagaacgtatgaacctgattgaagtgaaccagtgtaaacacgtaagaatgtcaaacgaccaacgaatgggtcagtagcaatcttaaatgctaaggcagcaaatggcttatcatcaccagctgttaattcaatttcatttccatcagcatcatgagcaacgaatggcttaacatcaagtggtgatggaagataatcaataacagcatcaagcatcatttgaatacctttatccttgtaagctgaaccagctaatacagggaaaatttgttcttccaaagtacctttacgaatagctgctttgatttcatcaacagaaatttcttcaccttcaaggtacttttccattaagttatcgtcaatatcagctaatgtttcaaccatttcgtcatgacgcttttgagcttcttccttcatatcatcaggaatctcaacagtatcccagttagtaccgagcttatcttcgtcataaacataggcaaccatcttaacaaggtcaactaaaccgataaagtcatcttcagcaccaattggcatttgaataggaagaggagtaacattcaaacggtctttaatagtttgaactgagtaatcaaagttagccccaatcttatccatcttgttcgcaaaaacgatccgtggaacgttaaattggtcagcttgacgccaaacagtttctgtttgtggttcaacaccagcttgagcatcaagaactgttacagcaccatcaagaacacgtaatgcacgttcaacttcgacagtaaagtccacgtgtcctggagtatcaatgatgttgatccggttatctttccaaacagcagtagtagctgctgacgtgatagtaataccacgttccttttcttcatccatccagtccatttgtgaagcaccatcatgggtttcaccaattttgtgaatcttaccagtgtaatatagaatccgctcagttgcagtcgtcttaccggcatcaatatgtgccatgataccgatgttacgagtcttagcaagtgggtattcacgtttattagccatcttaaaagagtatctccttccgaaatatggttatccttattttaccattattttcaaaaaggggtgacgtaatcgatgtttgaacgtcacccccttcactgaaactagttaaataaccagaatcaaatgacagtgattattaccagcggtagtgtgcgaatgcacggttggcttctgccatacggtgcgtatcttcacgctttttaactgaagctccagtattgtttgaagcatcgatgatttcacgtgcaagacgttcaaccattgtatgttcaccgcgcaaacgtgcgtattgaacaatccaacgaagacctaatgtagtacgacggtctggacgaacttcaatcggaacttggtagttagaaccaccaacacgacgagccttaacttccaagacaggcataacattttccattgcttgttggaatacttcaactggatcattaccagtttcgttcttaatttcatcaaaagcagcgtataaaatcttagtagcagttccacgcttaccatcaatcattaagtgatcaattaagctagtaaccaactttgagttgtacattggatctggtaaaatttcacgcttttgtacatgtcctttacgtggcattacttaactcctccttaaaattacttcttatccttaggcttcttagcaccgtacttagaacgtgattgcatacggccttcaacaccagcagtatctagagtaccacggatgatgtggtaacgaaccccaggtaaatccttaacacgaccaccacgaattaaaacaactgagtgttcttggaggttgtgtccaataccaggaatgtaagcagtaacttcgattaagtttgaaagacgtacacgggcgtacttccgtaaagctgagttaggcttcttaggagtcatagtacccacacgagtagcaactccacgcttttgtggtgatggagtcttaatttcttctttcttgaaagtgttgtaaacataaccaagagctggtgactttgacttgcccttgtggctcttacggcctttacgtaccaattggttaatggttggcattattttttccccttccttaatttaagtccacacatccaggcggttcttttttatggataaaaaaagtcctgtatgtatttatacaatttttgtgccttcgttgacgcatctgcccaacgacagacactccgttgctaaaaaagcaccttaaatagactatcatgctcacaaatgaatgtcaacgtatccttatcgatttcttttaaatcgttaatttaaaagtgaatttcattaaaaattacgtatttatttattgggaggtttttcatgttagttttattatttttatttggtgcttctgtcgcttcatttattacttcttgttgctatcgtctaggcaataattgctctttaatcattcctcagcggtcatattgtgacaattgccattctattttgcgatggtggcatctcatccctatttttagttttatcatccttcgcggtcaatgcttttattgtaaacaaaaaattagtttatatctgcctgtaattgaattcttatccgggattgcttttatcactttcatcagctatgaacctattcatgacttaatcattcttctctttctcactagcttaatcttcttaacttctactgatttttttagtcatgtaatctattcctattcactattgggactatttcctatttccttattatccattccacaaaattatttttacaatttgatttttgcctgtattctagcagtcagtttactattgttcactatttttactaagacactaggaattggtgatattgaatttttatttgtaatatgtctgatatggggatggtaccaaacactcataattatccaatggagttctttaatcatgctattcatctttttgtttacaagaaaaaagaaactaccatttatccccgcactagctttcactactattctgtgtcttcttatacaaggctgttaaaaaataaaagaccaggataccctagtcttttacaatatttaattagtatcatcttttactggtttgagttttactacaaataagttttgcccaaattgagcgaggttttcaatattttgtagtaataagagcaaccaagaaaaagctaagccaaattcaaataattcgaatgcagttaaagaaagataatcagttaacttaaaaacaatatattcgatactcattgcggctccaatcgtataagaaatcaccaaaaattgtttagtgacttcgggtagaacccacctaataactacaatcagaattagcataatataaacaagccacattgaaattctgtcatgtaaaacgtgaaattctggattattgggaaaaagaccaatagaagcaatacagatagctagcataattaacagccaccgcaatacttgaattttataaccatgataccgacgttgaatatttacaaacaagtaatcaactaaagcaatcattagtaatccagtaaaaatcaaagttatattaaattgcaaactggtggaattttttgccgttcctaaaaaactaaaattataacgccaccaatctcgtttagaattcgtcagcattgaaaaaagcattccaccaatgatcattattgttaataaattggtgataactcccgatgataatgttaaagccaagttaatcataatataatttattgccgcaataattacaaatacaaaagcagttgctgtataaatatcaaaccgtgcatccttaaacatctggccaaataaccaaaaaattgccgatagtgagaatgcaatgattagtccacatgcaatcgtaattgttggcaaactccgccaatgaaaatccttgctgggcccttttccgagaattttagtaataataaaagttatcaaaaacgataggattccactacatactcctaagattaatgcaccattagcaatggaataatcatcacctgttatcgggaccgtgttaatttttctggcgctaaaaaaagctaaaaatattgcagctaaaataattgaaggaatcacataccagaaaatgttaattttaggtagttgatcactcacatttattggacggatgttaatttgtttatgattaacactaagagagagctcttcgttcgtagagaagtctgtctttttaaatgctgagtcaggaatttctatctgatatttttttgccaagtaatcacctcattttaaactaaaaaggcaatggccccttcacaggttaaccattgccttttttataaattagttttgcttatcttcttcttttaacttagcctcaatatctttaattgagtaagcagctacactaacttcttttggcttgatgttccggtaagcactcataccagtacctgcaggaataatcttaccaataataacattttctttcaatccaaccaacggatcgttcttaccacgaatagcagcatcggttaatacacgtgtagtttcttggaatgaagcagcggacaagaaactgtttgtctctaaggcagccttagtaataccaagaataacaggacgagctgttgcaggaatatttccagcaactaaggtatccttgttagcgtcacggaattgactgatatccatcaattgacccggtagaaggtcggtatcacctggatccatgacacgaactttccgcatcatttgacgaatcataatttcaacgtgcttatctaacaagtcaataccctgcatccggtaaacaccttgaacttgcgataagaggtaagtttcagtagaaagaacatcacaaacctggattaattccttaggatcaatcgaaccttcatttagcggtgccccacggtgaatgaaatcaccttcagcaactttcatccgtgctgtaattggaagggtgtaagttcgggtatcagtctcacccttaatcgtaatatccttcgtccattcagcaggattttcttcgatagacacaacttcaccagtaacctctgtaattgttgcccgacctttaggattacgtgcttcaacaatttcttggatacgtggaagaccttgagtaatatcatcgttaccagcaaccccaccagtgtggaagttacgaagggttaactgagtacctggttcaccaattgattgagcggcaacagttccgacagcttcaccagcttctacacggtcaccagtagctgcatttcgtccataacaacgttcacatacaccatgttcagtgttacaagtaaatgctgaccgaatagttactttctttacgccggcatcaacaatcttttgagccatttcttcgtcgataaggacattcttaccaacaatcttttcaccagtcttaggatcaaagacagacttcatagtgtaacggcccatgattcgatcataaagtggttcaatcatttcgttaccgtttgtaatagcagtaacttcaagtccgcgatcagtaccacagtctttttcacgaacaaccacatcttgcgcaacatcaaccagacgacgagttaagtaacctgagttggcagtcttcaaggctgtatcagtcatacctttacgagcaccgtgtgatgaaataaacatttccaacactgaaagtccttcatagaagtttgacttaacaggtaattccataatcttaccgtttggtgatgccatcaatccacgcattccggctaactgagtaaagtttgaaatgttaccccgcgcaccagagtcggacatcatgttaattgggttatggatatccatgtgttcaattaacttgttttgaacttcatccttagcatcgttccatgcaccgattactcgttcataacgttcatcgtctgtaattaaacctcgacggaattgcttagtaattaaagcaacttgcttttgtgccttatcaagaatttctggtttttctggtaaatcatgaatatcagacatagcagtcgttagaccagaaatagttgattcgtagtaacctaagtccttaatacgatccaagaattgagaagtcttcgtaactttgtaacgcttgtatacttcagcgatcaagtcagataagaagcccttcttaaatggtggaactaatggtgcattttcaaggtattcatgaatatcttgaccaggttcaaggaagaaacgatcatcaacaccattttgaatatttgcatctgttggttcgttaatgtaagcaaaatcttttggcataattcggttgaaaagaagcttaccaacagttgtcaccatgatcttgcctcgttgttcatcagtaaatggcttttcagggaatgcagatacttgaactccaacacgggtttgtaatgaaacatagtcattgcggtaagcaagttcagcttcatcagtatctttgaagatcattccttcaccttcacgacccttatcttcagtagtcatgtagtagttaccaataaccatatcctgtgatggtgaaacaataggttctccgtcacgaggactaagaatatggtgagcagcaagcattaacaaacgtgcctccgcttgagcttcatcagataatggaacgtgaatagccatctgatccccatcaaagtcagcgttatatgctgaacatactaatgggtgaagacgcattgacttaccagaaaccaagattggttcaaacgcttggatacctaaccggtgaagagtaggtgcccggtttaatagaactgggtgttccttaataacgtcttccaatacatcaaagacatcatcatcactgcgatcaatcttacgcttagcagctttaacgttagcggaaaggccacgttttaccaattcatgcataataaatggcttaaataattcaagtgccattggaactggtaatcccatttggttcaacttcaatgatggaccaacatcaataacggaacgaccagagtagtcaacacgcttaccaagtaagttttgacggaaacgtccttgcttacccttaagtaagtgagaaagtgacttcaatggacgattacctggtccagctactggacgtccacggcgaccattatcaattaatgcatcaacagcttcttgtagcatccgtttttcattttgaacaataattccaggtgcttgtaatttaagaagtcgctttaaccggttattacggttaataacccgccgatataaatcgttcaaatcggaggtagcaaaacgtcccccttcaagttgaaccattggccgcaagtcaggtggcataactggaattacatccataaccatccattcaggcttatttcctgacttaatgaaagcttcaagaatatcaagacgacgaatagcacgagtccgtttttgaccagtagcttctttcaattcttcttttaattcagcagcttccttttctaagtcaacatcggctaaaagtttttgaatagcagcagctcccatttcagctttgaaacggtcaccatattctgcttttttatcacgatattcagcttcagttaaaagttgtttcttttcaagtggagtatcacctgggtcaagaacaacatatgaagcaaagtaaataacttcttcaagtgaacgtgggctcatatctaatacaagtcccattcgacttggaattcctttaaagtaccaaatgtgagatacaggagcagctaattcaatgtgccccatccgttcacgacgaacttttgcactagtaacctcaacaccacaacggtcacaaacacgacctttgtaacggatacgcttgtactttccacacgcacattcgtaatccttggttgggccaaagattcgttcgtcaaacagaccttgcttttctggctttaatgtccggtagttaatagtctcgggctttttaacttccccatatgaccaactacggatcttatctggagatgccagaccgatctgcatactttcaaatttattgacatcaatcaaaggatgttcctccttctttcagtaaaccgtagcaacctaaatattaattttgattagttttgtcatcggtagttgttgaagttgcttcagacttgttttcttcttcgttcttcttatcgtctgttttatgttcttctgcatatttagctaatgcatcaacatttacaacttcatcatcatcttcgtccatgttctttaactgaatttccttgttgttaccatcaagaaccttcatatcaagacctaatgcttgtaattccttaacaagaacacggaatgattctggaacacctggcttaggaattggttgaccattgatgattgcatcataagtccgaacacgaccaacagtatcatctgacttgtaagtaaggatttcttgaagagtgtaagcagcaccataagcttcaagagcccaaacttccatttcaccgaaacgctgtccaccaaattgtgccttaccacctaatggctgttgagtaacaagtgagtaaggaccagttgaacgagcgtgaatcttatcatcagccatgtgagctaacttaaggtagtgcattgaaccaacagcaatccgattttcaaatggttcaccggtacgaccgtcataaagaattgtcttaccgtcttctgggaatccagattcacgaacagcatcccaaacatctttatcagatgcaccatcgaatactggagtagccatatgaattccaagacgacgagcagccattcctaggtgcaattcaagaagctgaccaatgttcatacgacttggcacacccattggactaagcataatatcaatcggagttccatctggcatgtatggcatatcttcttctggtacaacgatagaaacagtacccttgttaccatgacgtccagacatcttatccccaacctggatcttccgcttttgtgcaatgtaaacacgaaccattgtatttacacctggtgataattcatccccattttcacgagtaaagactttaacatcttggatgattccgccaccaccgtgaggaacacgtaatgaagtatcacgaacttcacgtgacttttcaccaaagatagcgtgaagaagacgttcttcggcagataattcagtcattccctttggagtaaccttacctactaaaatatctccatcatgaacttcggcaccgacacgaacaattccgttttcatcaagatctttcaaagcatcgtcaccaacgtttggaatttcccgcgtcatttcttcaggtccaagcttggtttcacgtgcttcagattcgtatgattcgatgtgaatagaagtataaacatcgtctttaactaatcgttcattaatggcgatggcatcttcgaagttatatccttgccaagtcatgaaggcaattaatgggttttgtccaagagctaattcaccttgttccattgatggaccatcagctaacacgtcatcagcatcaacatgttcgccaaccttaacaattgggcgttggttgtagttcttaccaccgtttgaacgacggaacttcattaacttgtaagtatcaagtgttccatcttcctcacgaacccgtacttcacgagcatctacatattcaaccgttcctggcttcttagcaatcatcgcaaccccagagtcatgggcagccttgtagtcaataccagtacttaccaatggagcatgaggattgatcaaaggaacagcctgtcgttgcatgttagcacccatcaatgcacggttggagtcatcgttttcaaggaatgggatacatgcagaggcaacagaaacaacttgcttaggagaaacatccatgtagtcaatgttttcaacactggtttcgatgtagtcatctttatcacgagccattacttgatcgtcaacaaatgaaccatcatcatttaatggcgtgttagcctgagcaatgatgaagttatcttcttcgtcagcagttaagtaatcaatcttatcagttaccttgtgatccttccaggaaacacgacggtatggagtttcgatgaatccatatttatttacccgtgcgtaagatgaaagactgttaataagaccaatgttaggaccttctggtgtttcaatagggcacatccggccatagtgagtatagtgaacgtcccgcacttcatatccagcccggtcacgagttaaaccaccaggaccaagagctgaaagacgacgcttatgagttaattcacctaatgggttagtttggtccatgaactgggaaagttgggatgaaccaaagaattctttaatagaagcaaccactggacgaatattgattaattgctgtggagtaacagtgtcaggatcttgaattgacatccgttcacgaacaactcgttccatccgtgcaagaccaatccggaattggttttgaagtaattcaccaactgaacgaatacgacggttacctaagtggtcgatatcgtctgtactaccaataccttcttgtaagttaaagaagtagtttaaggaagcaagaatatcagctggttcaatgtgcttgtattctaatgggatatgaccgttaccaataataggtacaactcgatcaggatcagtcttagaatatactaaaatcttttgtaacttaactggttcagttacaaccgcttcatctgatggagtgtaagtaatagtcttaaagtcatcacggtctaagtaaggttcaagcttattaagcaattccttagttaccgtatcacctttttgtgctaatacttcaccagtatcaggatcagctaaagtttcagctaaagtttgtccaagtaaacggtacttaagcattaacttcttatttgtcttataacgaccaactggtgccatatcataacgttttggatcaaagaaacgagctgttaataagctccgtgctgaatcagcagtctttggttcaccaggacgaagccgttcataaatgtcctttaaggcttcttcaacccgagaatcttcagcgttcttgtgaacatctttatccaaggttaatgataatgtctcactatcgccaccgaacatgtcaataatttcatcgtcagagccaaagcccaatgcacgaatcaattcagtcattggtaacttacgggtccggtcgattcgaacatatgaaacatttttagcatcagtttcgtattctaaccatgcgccacggtttggaataaaggtagcaccgtagtttggccgaccatttttatcattttcttcactatagtagacacctggtgaacgaactaattgtgaaacaataactcgttcggcaccattaataatgaatgtaccttggtcagtcattaatgggaagtcaccaaagaatacatcttgagacttaatctcaccagtttcatggttagttaaccgtaaagtaacatgaagtggtgctgagtaattagcatcgtgttcacgagcttcgtcaacagtatacttaggttctaaaagttgatagtcaacgaattccaaagaaagttttccttgaaaatcatcaattggcataatatcatcaaacatttcccgcaaacctttttccatgaaccaattgtaagaatcggtttggatttcaataaggtttggcaattcgagaacttctttaattcgcgagtagctacgacgggtacggtgtttaccgtatttaactaaatgtccagccaaactgttcacctctctaatttattccgcgagctcatttaaatgttacaatttgattacaatttgcctaaaatacgacttttgggcaaaaaaaatccaaaaacagttcaacgactgtctttggcttttatgcagaatctgatggacaatagatcaccaggttcaaatgaactcacaattacatactatttaagtatacaagttctattaaatttcgtcaacaattatttttatattttttaattttttccgccccaatttgataaaccgttaataatgcagtctaggattaattggtcacgttgttctggtgtaattgaatggccaccaattaattgcgaagtgccaaaaattggagttagtcctgcaataaataattcagcagcttctttaggaagaatatcaggacgtaaccctacatctggttgacggaaaaatgctgcaattggttctagataatccattgtaaagatcatattaagcttttgctgtgcactcttcgataataggcgcattgcctgattgtattggtcataaatacttaatggatgatgtttttttaatgccttggtgatttgccataattgttcattcggtgacaaatcatgtttacgcattactttattaatatcttggcgaacttttccacataaatttgtcattacatccagatataaaacctctttatcgctgaagtggtggtataaagccggttgcgtaattccaatctgtttggcaatatcccgtgttgaagtttcaccaaatcccttttgtaaaaataactttgtagcggtttttaagattgcttgtcttgtcttttctaattgttctgctcgcttcatttattgttcatcccctatttttaatcattaattatctgataaacacattataaggctataacttatcttttgacaaccgttttagaaaaataatcatcaaatgtgataaatgaatgcaatttggtagctttttcttctattatcattagatatcattagagaacaaaagttacaattataacatttttataatacataaaactcaaatattcggtttgtgtatttcaaatttaatgaaaccagaatacaaaacggtaaattactctgcactttcagaataatttaccgttctttttatctattcaattttaattcaacagctttatcttcatctggcttttttactttaaaagtaattttaccgtgatgcgcacctactgttacgtcatctccaacattgatttcaccactaagtagtccagtactcaaatcatcttcaacatgatcttgtaaggcacgacgaagcggacgagctccataagcaggattgtaaccaagctttgcaattacatcaattgcagcaggcgtaactttcaagttaatgccttgctcacttacccgtttatttaaatcattaaccatgagtttaacaatttgatgaagctctttcttttgtaatgaatggaagataatcgtttcatcaatccgattaaggaattctgggcggaagtataacctcatttgttgcttaatcgccgctgccatcgcattatagtcttgtgacatatcttttgccccaaaaccaacttctttttcatcctgaagctgagttgctccaaggttagaagtcataataataatggtatttctaaaatcaacgcgccgaccttttgcatcagttaagtaaccatcatctaaaacttgaagtaataaattaaatacatccggatgtgccttttcagcttcatctaataagacaactgaatatggatgttgccgtactttttcagttagttggccaccctcgtcataaccgacatatcctggagcggcaccaatcaagcgactagtactatatttttccatatattcggacatatcaatccggatcatattatcttccgagccaaacattgcagcagctaatgccttggcaagctctgtttttcctaccccggtcggtcctaaaaacataaaagaaccaatcggccgactaggatccttaagaccgcttcgtgcacgccgaattgccttagcgactacggtaactgcttcatcttgaccaattactcgttgatgcagaaccttttccaagttaaccaatcgttcactttcactcttcttcaattgagttaaaggaactcctgtccattcagcaacaacttgtgcaatgttttcaccagttactttcaatttgtagttatgagaatctttttgttgagtgcgttgttttttacggtcaatcttatcttttagtgctaactcctgttgacgaagagtagctgcacgatcaaagtcttgattatcaattgcttcttctttttgggttcgcaaatcttctaactgactttctagtgaaggctgatgatttttcttatcttcagcatcaattcgaaccatagctgccgattcatcaataagatcaattgctttatctggcaagaatcgatccgaaatataacgatctgacaatttaactgcttcttctagcgcttcatcagtaattttagcatgatggtgctcctcatactttggtcgtagtcctcgcaggatttgtagagtttggtcagtagtcggctcatcaacttgaacagtggcaaagcgtcgttcaagtgctgcatccgattctatatatttctgatattcatcaagcgtagtagcaccaattgtttgcaactcgcctcgcgctaaggccggtttcaaaatattggaggcatcaattgcaccttcagcaccaccagcaccaattaaggtatggagttcatcaataaaaagaatcacatgcccgtcgttttgaatctcatcaattacttttttaagacgatcttcaaattctcctcgatacttggtacctgcaactaatgatcccatatcaagcatcatcaaacgtttattagccaattcagctggaaccttaccatcaaccatccgctgagcaagtccttcagcaattgccgtcttccctactcccggttctccaatcaaaactgggttattcttggtacgacgactaagaatctgttccacacgtttaacttccttatttcgaccaattacaggatcaagctgaccattccgagcaagttctgtcatatcacgagctagtttatctaatgttggtgtaccagtttgctgaatccgtcgacgagatgattgacgattaggattgcgttgctgactatcagcaatccctaaccgccgtaaaattacttttctcatctgtcgtggcacaacatctagactatataaaatccgtgaagatagaacactttcatcagcgattaaggctaataataagtgttcagtgccaatcttcaatgcatgcatttgttgggcttctttacctgctaacgataatacttgctttgcttttggtgagtatgggagataatctgaagctcccagattttccatcgttccatagccaattaagcgttcaatttcttcacgaatatcatcgttcgtaatagaaaattgttcaaatattttgttagcaatcccatctttatccattgagagggcaagcagaaggtgttcagtccctactgcttggtgtttaaagtattttgcttgttcttgtgcaattgctagaacatgctttgcacttggcgtgaacatattatccatgtacaatctcccttttaactttcatagcgaagtcgattcaagaatgatactaatatacgggcgcgaagttgatcttcaatcttactatcattaactgctagtgcttgtttagataatgcaactagcattaagtctccttcacgtctcgtaatcacgtcttcttcatataacgttcgaacaatatcaaaagcatcacgttcacgaaccgagtcgccaattgcttgaataagtgagtttagcacatttacgtcatcaagtaaattaactcgctcgattcgaatatatccgccgcctccacgcttactctttactaaataaccattttgaatggtaaacctcgttttaataacataattaatttgtgacggtaccacatcaaactggttggcaatctcagaacgacgaatttcgacctgagctgagtcaccaagtatttcttttaagtatgcttcgataatatctgaaatacttttattctccattatatcacctcggctcttttgactaatcttgaccattattttaacacacttttagagtcagcgcctacttgtatgatcattcagttacacatttaagaaaataataaagactagcgaagcattcaagcgcaacactagtcttttagagaattaaatatgaactacttttttaattagtcgttatcgttgtgaacaaaatcaacaacattccgaccaacaaccttgttatccttaagttcttggatcatatcattaatttcgcttaacttacgagtcttaacaattgggtgaaccttaccttctgcaccaaattggaaacattcagctaagtcttgacgtgtaccaactaatgaaccagcaacaatgataccatcaagaacagtcttagcaatgttaagcttcatgtcaccttgtggaagcgcaacggcaacaagcttaccatctgggcgaagtgaatcaactgcttgatcgaatgcagagggagaaacagctgttactacagcagcgtgaacaccgccaaccttttcttgaatttgcttatcaacatcaccgtcatgacggttaattaaaatttcagcaccattcttcttagcggcttcaagcttatcaggattaccatcaacagcgataacatgagcaccaaatacgttgtgagcaaattgaatacccaagttacctaaaccaccagcaccaacgattgatacccattgacctggcttgatgtcagcaacctttaatgccttgtacatcgtaacaccagcacaagttaatgaagtagcttcaacaggatcaagaccttctggaaccttaacagcgtagtcagctggtacgatacattgttcagccattgcaccgtcagcagtgtaacccgcattaagaacattccgacaaagagtttcacgacctgttaaacaatattcacagtgtccacagcccttgaagaaccatgcaattgatacacgatcgccaacttttaatgaagtaaccccaggggcaaccttagatacacgaccaaccccttcatgaccgataatacgacctggcttcttaccaaagtctccagcagcaacgtgtaaatcagtgtgacaaaggccacaatattccatgtcaactaaagcttcaccgggctttaaatcccgaagttgaacatctttaacagtaacaaaaccgtctactggatcgttaataacagcagctttcataaggtaagatctcctttattaataaacaaattactttttacaatgcttatagtaccacaactcctagacaaatttaaagtgaaaatttgcacatttaacgaaattaataattttattttttatttaaaacactgatataacaatgataacgcccggaaaatcaattcttttaatattgtatagtaaatcacttactaattatcactaaaactttactgttacaattttagacgctctctattaatatggatgttacaatttaatcaattagacaaaggagtggtagctaagtgaaaatgtagagcggcaatatattcgttacaataatcgttatggaacggcaattgctgctgatatctacacccctaagaatctagaagaagacaaattgttatcagccatcgtaatcggggcaccttatggaagcacaaaagaacaggcagcagcaatttatgcaaatacgtttgctcaattaggttttgttacccttgcatttgatcaagtatacatgggtgaatcagctggcgaacctcgtcatgttgcttctccagacttatatgcggaatcttttagtgccgcagttgattatccaggtacaaaagcaaagcatgtcaatcgcggacaaataagtgttatcggtatcagtggaggggcaggctttgctcttagcgctgcggctgttgatacacgaattaaatctgttgtaacaatttcaatgtatgatatgacagatattcgtgagatggctaatcttgctcctgaacaattattccagcttaaagatcaattatcaaagcaacgttgggacgattttgaaaatgggcagcctgactatcatccttccttcccagaagaaccatatgatagtattgacgatttaccaaatcatgatgagttaacaaatgagtggcttcgtttttacgctcttaaacgtggcttccatccaaatacacgtggaactgcaacaaccacttctaatttagcaatgcttgaattttctgcgttagactatattaaagaaatttcaccacgaccaatcctatttatttatggagacaatgctcactcccgttcttattccgagagagcttattaccttgctaaccaaccaaagcaaagattgatcgtaaaaaactgcgaacatattgatttttatgataatatggaaaaaattccagtagatcaaattgcaaagtttataaaagacagtttcaacgcataatcaaacgacaaaatgccaatcagtgcctcaattatggaagcctggttggcattttccttttaaatattttcggaaattaataaaaaactgctatctcttctactatagaagtgataacagttttttaacttatcggaattacaagatttgaacttgcgacctctgcgtcccgaacgcagcgctctaccaagctgagctaaattccgaaaaaataagcgtaacagttaaactgtcacgcttactataattagtgcacccagaaggagtcgaaccttcaaccttctgattcgtagtcagacactctatccaattgcgctatgggtgcatataagcggaagacgggattcgaacccgcgacccccaccatggcaaggtgatgttctaccactgaactacttccgcatgtctctgataagttattccctatcaacgattattaatattacacgaaaatctcatcaatgtcaacaagaattttcaaaaaatattaaatgcggatgaagggacttgaacccttacatcaaaatgatacaagatcctaaatcttgcgcgtctgccaattccgccacatccgcaaactaatggaggatacagggctcgaacctgtgaccccctgcttgtaaggcagatgctctcccaactgagctaatcctccataaataggcttgctatataaatcagcctatttaatatatcatctatatgattttttgtcaaatcctatttaagatttaattcaattaatttttcatcaatcatggctaagaccttcttagcagcagccggatcttcaacaaaatcatatttatcaccatcaataaccatcttaggactttcattataatcctcataccattgaacataacgttcgtttaagtttttataatatgaatataatgaagaatcattagcaatttgttcaaatgaacgtccccgtttcttaatccgttcaagcattgtctcaaacgaaaccctaattgtaattaaaaggttgggggctttttggtgtggttgctctggtaattcttccatcatgttacttaataatgaagaataaatatttgactccgtttccgtagctcgacccatatctgcgtttaacttgaataataaggcatcttcaaaaattgaacggtccaaaacatttaaatcatttgagtatgaatctttaatctcatcaagccgcttgtttaaaaagtaaatctgtaataagaaaccatattttttaggatctttataaaaaagcggcaaaattttattgtcatcaacagattcatagaaggcctggctattaagatggtctgccaacagctttgtcaaactggtctttcctgcaccgattgtcccagctatagcaatcattagttatttccccctgtttcaaattcaaaaagtaacgaaaacaattctaacatttaaaataaaaaggagcgagtattttctcgttccctttttattttattaatcatcttccggttcgtacgattcaccctttgttcgccttgataaatcaaccttatcaagcggaatcaagtgcgtcttgtaacgaatcttgtagtagaagaaaagaattaagaataatggaattcccatgtaagtaattaaaatgttttgccagtccatttttacaaaagcatcaatgttttgaccacaaataacgacaatacatagagtaagcgcgaatactgggccaaatgggaaccctgttgcatgatacttcaattcagacagtgtatggccttgcttaagaaatgccttcctaaagcggtagtgggaaattgcaattcctaaccatgcaataaatccacacaatccagatgcaccaattaagtagttataagcttcgggaccaatgaattgggttgcataggctgctaatgaaacaaccatcgttcccagcaaagcataaatcggaataccatgccggtttacataaccaaaaatccgccatgcatatccttcacgcgcttgtgaataaagcatccgggttgaagcatataaaccagagttagcagcagaaatgacggcagttaagataaccgcattcattgcactagccgcaaatgctaatcctgcccgcttaaacacaatcgtaaatggactcattgtaatatttgaaacgtcttgattcaataagttcttatctgtgtaaggaaggatgcaggcaataacaaaaatagcaaaaatataaaaaagtaaaattcgccagaaagttgaatggattgcctttgagacagacttttctggtgtagcagcttcaccagcagtaattccaactaattctgttccttggaatgagaacccagcaaccaagaaaacactaataattgctggcacacctccaacaaacggtgcctgcttatagtggaagttgcttaatccaactggcttaccacccataattccaaaaataattgcaacaccgacaattaaaaatacgataactgtgacaactttgattaaagcaagccaaaattcagtttcaccataagatcgtactgataaataattgattaagaaaattaatgccatcactgttacactaaaaatccagcctggaacattaggaagccaataattcattacaattcccgcagttgtaacatctacggggattgtaatcgcccagttaaaccaataattccaaccaagagcaaaacctagtgctggatcaacaaattttgttgaataagctgaaaatgacccagttaatggcatatatgttgccatttcccctagactcgtcattaggaaataaaccataattcccataattccatatgcaactaacgctccgccaggtcccgcagttgaaatagcggatccactggcaataaaaagtcccgtaccgattgttccaccaagagcaatcatggacaagtgacgtgtctgtaatgtccgttccatatgacccgtcgacttagattcatctgccataaatatatttcctccaaatttgtgtgccttaacgtcaacattttcgaagaggataaattaaaagggtcttctgatcggtaaccccaccagaagacccaacttaatacctataattaatcgttgaatcaatttaggaagcgccccgcaattattgcgacagtctatagcctattgtgactatagcccaacatctaccagaaataagctaagtagtgtttcggcatattttccttttactaatactccggtgcttattcacctaatactagttactgataaaatatgcaacctcttcatcgaatgaaattataccccactcaaataaaaatgcaagtccgattatttaataatgcattgccataagtcatccttgtcataagtaaaaccacatttaacaagtactcgctgagaacgataattgctttgtttgcactccgcatgaatcgtaattttagatggcaaaatagaaataaatttttgaagtgcagttgtcattatgcctttattccattggttttgctgcaaaagataacctaattcataatgatgagcaattctttttccttcatccccataccaagcacttaatacaatcatccccactacatcttcatttagtttcactaccattacatgattctggcgaacaaacatcttaatagcttgcacacgtttttctctttgaagtggtaaaagcagtcccactgcttgtgttaagttttcattatccaacaatttaactattgctcctaaattgttattagtttttgctgattcaattataatttcactcatttttctcctatttcccgggaaataaaaaagagaagcaaccaaaaagattgccctccatcaatttcgattattaaatttcaatactacggaagaacggaatccgttgcaatcgtggtgcccaagcgacatagagccattcagctacttgtaaccatgcataagctaataacattgcaccaatagtatcaaaaggccagtgagcataaagatatacccgcgataccgccaaaaagaagactgcaaatattaataaaatttgcaaaattgtgcggacagatgctttttgaataagcggaattacaattaagaataaaattgctactaccaagaagaatcctaaagtgtgaccactagggaaactatagccatcatctgctgccaagtgttgtgcaggacggacccgcttaacgatgtgtttaataattgttccaagcacatcaccaccaaaaatcgttcctaatgaccataaagccgggatgcgatagcccttcaaccataaaacacctgcaataataaatacccatactaaatctaagaccggtttaactaaaaatgaaagtaagctcatcaaagcatgaaaccaaccaattccttccaggcgctgactagtaaataacgactgcagaacagcatcaatcattgttagcactgacgaattaaacataattaatagcatcaatgcgataaagaaaccaccgcttaaggcaaagcgccaccaccgatgatcatcacgttcaataaacataatcaaggattctcctaacttaaattaattaatcaaaaataagtataccacagtgtcaaaaattccatcgtgactttttgattaaatatttatgaagatagttcaaaacacgatttaaaagctctcccaaaccaaagccaagcgtaattgcaccaacaatgacaactacctggtagaaataaacattaacaagatggtaattaccaatagcaaaattacgaaccattttataagcctgtcctccaggcacaaatggaactagcgcgggcacattaaaaacaataattggcattcgttttcgacgagctgctgcctggcttaataccgaaattaagattgcagcaactaaattactaaacgcaaggccaatgccactgcaataatacattatccagtagactacccatacgcctccaccaatcatccccgcagtatgataggcacgtttaggaatatttaagaggataccaaaacaaactgtcgaaacatagcataagaaaaattgtaataataggttaccccaattcatctcctaccctcctaattaaagtgcagaacaattacaattgcactaccaatcgaaacggcagttagaatcgcctcaatccctcttgtaggtccactaattaagtttccggaaactaaatcccgtgccgcattagttaagggcaccccaggaaccagaggcataaccgcaccaataataatatcattaatattattagcaaggtgcattttaacaaagatcaccgccaaaatacctataattaaggaagaacaaaactctcctaaatattgaatcttaaactttcgtaaaaggtatgaaaatgctccgtaacctacgccacctgcaagaaagccagcccaagaatcagaaacattacctgtaaagacaatcattaatgcaccacttaaaatcgcagcagcaaatgattcataccagttttgccatcttgacatcttttggtgatcaatcctttttaatttagcaaatgcttgtggaacatcaattttgcgccgtgctagttcacgagaaacttcattgacatccgcaattttacttaaattgtttttgcgatgacgaatagtaattacttgggcatcaggttcattaatcgtcccaactacaattccagttacggttgtaaaagcctgaaagccatgaagtcctgcactttttgccattcgggataaggtgtcgttaactcgttccatatttgatccattttcaattaaaagtctcccagctagcaaacaagtctttagtgctagtgcttgtcgtcgtttcgttaacatcttttcgccttctctgttcaaagatatttattattatcctctgtttagataaggagctcaatacaaaaaaacggccggaaaaatccagtcgttttttgtatttagtctttaactacatttgcagcttgaaggccacgttcgccttcttcaacttcaaacgtaacatgttgtccttcgctcaatgacttaaagccatccccttgaatagcagaaaaatgaacaaacacgtcatcgccgctttcacgagtaatgaagccataccccttatcgtcattaaaccatttaacagttccttgttccatgttggaaatcctcctgtgcattaagcactaatataatttgtaattcgtctcaggtgaagagatccatttgcaatgaaacaatcgaaccaaccgcacttaaaaaaactacaaaaaccattgtatcacataagcaatcatttacataattaacctttattttcttgagctgtgtccggttcaataaaaatattatgtgaggccttatatgaaacattaatttcttggtcgttatcctctttttgaatcacaattggtccttcaaaaggctcatggcgaattacagttacttgttcctgaggtcgtaatcctaactcttctaagtaagtgagaagttcatgattatctaagaatcgttctagttcaactttttccccatcatcagcatctgctaataaacgatgtgttacatctgggaacttgccattagctgatggaattactccaccatgcggacaatgatcagggtgttgaagaaaagcatctaaggccgttgctagtcgatcacttgtctgatgttcaagaatttccgcttctgaatggacgtcggcaaaattgtagtgaagcttatccactaaaaatgtttcccataaacgatgctttcgaactaattctgcagcatacttttgtcccttttcagttaaagaaataccagcatatggttcatgaacaactagcccttcgtcagccaacttagaaatcatctcggttactgatccagcggcaattcctagtccaagggaaatctctttattagaaacttttttatgactaccacctaattcaaaaataatttttagatagtcttccttcattggagtcaaattgtttcacctctgggtattaaaatttggcctacgatcggtcattatgtgtttttatatattaacattgaacccaaattgattatagcatattattaaaagtgtagtttggaaagcctaacttttttgttataagctttttataaacccgcaatcgatctttacggaggagtaggtaaatcatggacgaaaaagtaacagggaaacgctttttagcagttaccctcctaaatgtattaattacaattgttgaaatcttcggaggtattctttcaggaagtttagccttactatcagatgcttttcataatttaggggattcgctttccattgtactaggctactttgcccagcatattggcgggcaaccagagaatcagcaacgaacttatggctaccgtcgagctgaaatcctctcagcattaactaatagtatttttttaattgttatctctgtctttttaattattgaagctattaagcggttagagcatccccagcatattaacgggggcattatgttaactgtagccgtgattggtctgcttgccaactttatttctgcagccctcttacatgccggaagcgaagacagcttaaatgtcaaagcaacttatctccacattctaagtgatgcactttcatcagttgccgttatcattggaggaatcattcttacctttgttaatgttccatggcttgatcccgccttgacaattggggttgccctctatattgcttatgaggcttggccaattattaatcaaaccattaaaattctcatgcagtcctccccagatcttgattataattccatcgaaaatgatttaaagcaaatcgacggagttgcggcagttcatcacgtccatgcatggatgatggatgaacaccgaatcattttctctgcccatcttaattgtgatgacttgccactaagccaggttgagcgaatctatagtcaagtagaaaaaatcttgcatgaaaaatatgggatctgtcacgttactattcaagcagaatatcaccgtgggaaagatgaaaaattattcaacactcctgttgatgaaaagaacgttattaataacgatttcaaagaggactaaaattaaaaggaagcaaaaagttgagcgaaaactcagcctcttgcttcctatttttttacatcgattaaaataattttccgactccatagtgaatcgtaatcgtaatcaaaccaataataatatttcgaataactgcaatttttacaagcccgttcccgagtttagaactgatataaccggttagagcgctcgtaaaggcaactgccaaaatcacggcataccacttatatgcttcgggagcaaaagtcatcgccatcaacggaattaatcctccggcagctgctgaaaaaagagaagaaaatgcagcatcccaagggttaagatagtgaccaagctcaacatcatacttaatccgaacaactgtctcgaggggctttttattaaggagatccttagcaattttgattgatgtttcaggagtaactcctttatttacataatagtcttttactgccgcaagttccccttcataatcgtcctttaagagttgctcttctttagcaacggccgctttttctgtatccttttgagtagatacagaggcatattcgccagaagccattgaaaatgcacaggcaagcaaatcagataagccagcaatgaagatagtaaaacggtcacttgtcgctgctgccaccgataccaaaacaccgacaacagtcaaaatcccatcatttgaacctagtacccctgctcgtaacgtattcagtttttcttccattgtttgcttctgatgctttttcaccttaatactcatttaatctcatctccctaccgcgcaaataattgtccaatcaggtacgtaacccccattgttaataatccagcagctgcattcctgatcatcgatttaatccggttagattttcctaaaaccgccgcaaaataaccagtaattaacaaggcaattaaaactgcaattgcggttgctaagattcgaacatttacgggagaaacggtaaccgccaccattggtaaaattgaaccagttggaaaggatataaaggaagcaatcgccgcagcatatggacttgtaaactcattgggattaaagccatagcgctcttgaacagctgtccctaaagcatctttttccattaattctttcgtcgcttgtttagctaattgcgaatcaatgtcttgagcttcatatttcttttgaacatagtcaaattcatgctggtattgattctgaagccgctgcttttcactaatcaaagccattttttgtgagtccttttgggtcgaaactgagacgtactcccccatacacattgagatcataccggcaagtgttccggacaaacccgcgattaagatggaacgggcattactcgttgccgctgccaccccgataacaattccggcaattgaaataatcccatcattagcccccatcacacttgcacgcagaacgtttaccttttgtgctagtgacatctttttcttggacacatttatcccttccctctttcagtttagaatcattataacatagagataagtaaaaacaaccaaataatcttcaaatgatattctatcttagaatcattaaaaaatatactttcatgtaaaaagcgatagtcctaatcagaactatcgcaataatcttaaaaattaaattatttattcataagcctgaacagtgtttgtccgaataacaaatactgacgttccagcatgacgagccatgtatgatgcctgagaaccaaccgccttacgattacccttcttaccaattgaaccaacaactaataaatctggctgaaaagcggggataacatgattacaaatccgctcagctggccgctccccacgatcaacaatcgccgtaatcttttctggatcaacgccgtaatcaattgctgcttggacatattcatttacccgttgacgtaattcgtcttcactgctatgaacataatccttatctaagatttgatatacatttacccggtcagtttctagaattgatacaattcctagctctgaaccatcacgtttcgccttatcaaccgcgtatgagaaagcggcacgggcatctggtgcatcgtcaacaccaacgaggatcttcttgaacttctttggctttatttcgaacattagtattctcctccctatgttctacactttaacggtgaagcattactcgctcctcttcgttaaatcatattcttcactccttatgttactacttatctcgattttgtaaataattattttggccttcctaaaataaaagtgatttattaaagaattttataattattttttcaaattcacttctacacaattctcattttgacgacttatagaacaatcgatataataaaagttacttacttcttgataatatcaacgaaatggggttaattatttcatgtcaatgattgaatttcataatgtacaaaaatattatggcaagtttcatgcattaaaagatattaatttaacaatcgatgatggtgaaacagttgttttaattgggccatctggctcgggaaaaagtagtttaatccggaccgttaatggtttagatcctattagagacggtcaattaatcgttaatgggtttgaccttgccgataagaaaaccaatgtaaatttaattcgaaaagatgtcggaatggtctttcaacactttaacttatacaacaataagagtgttatcgaaaacataatgctcgcaccacgaattgtattaaagcgtccggaagaagaaaaccgtgagttagcaatgaaactgcttgataaagttggccttgcaaataaagctgaaagtatgcctgctcagctatctggagggcaaaaacaacgaattgcgattgcccgcagtctggctatgaagcctaaatgcctcctattcgatgaaccaacaagtgctctcgatcctgaaatgattgatgatgttttagacgttatgaaagatatcgctaaaaactccaacatgacaatgttagtagtgacccacgaaatgggctttgcacgggcagttgctgaccgggttatttttatggcagatggtcggatcttagaagacgattcaaccgaaaaattctttggcgaccagccttctacagagcgtgctcgcgaatttatgagtaagatcagtggtcactaaggaggaattataatgaaaaagtattggcgattgattagtcttagcgccctcctctttgttgctctccttactctttctgcctgcggtacctcaattgcaaaaaaagatgttctgaccgaagatatgcgtagtcaacgaattacctggggagttaaagcagatactcgtctctttgggctggaaaatatccggacaggaaagctagaaggatttgaaattgatcttgcaacagctattacaaaaaagatcctcggcccacagggaaaaccaatttttgttcctgtaaccagcggaacccgggtgcccctattaaaaaatggtaatattgatgcgattatggcaaccatgacgatcactcctgagcgagaaaagcaagttgactttacccattcttactttgatgctggtcaatctctcctagttaaaaagggaagtccaatcaaaaacatcagcgatttaaatcgacgaggtgctgtaattcttggggtttctggatcaaattcagttaaaaacgttgcgaagtttgctcctgaagcacgtgtccttcaattatctgactatgctcaagcgatgacggcccttaaatctaaacagggggatgcccttaccactgataatgggattctctatgggatggcagctgaaaacccaggctatgaagttgtcggcggtaactttactaaagaaccttatggaatcgccgttaacaaaaatcaaacacgttttcgcaataaattaaactgggcgttaagagaagttgaaaaggatggaacctacaaccgtcttcttcttaaatggtttggcaatgttaaaggatttaattatcaggagatgaagcgctaatgttaaatttaattataaatgagtggcatccccttttaaccggcctctggaatactattctatgtagccttattgcactaatcgggagccttattattggaaccttttttgcccttctcgagatttcgcagcatcgggttttaaaaatcatcggtcatgtctatgtggaggtctttcgtaatatcccactattggtaattacaatggcttttttcctgattatcccaatgtatgtagtgaaaattaatggatttactgcgggaacaattggcttaactctttatacgtctgcatttattgctgaaactgtgcgtgctggaattaattcaattgatcctggtcaaatggaaggagcccttgccaatggacttacttatggacaagcgatgcgctacattgttttaccacaagcatttcgcgttgttattccaccacttggcaatcaatttatcaatttggttaaaaactcatcggtccttgcctttgtcgctggctttgatcttatgtaccaaggaaatctaattgcaaacgataccttagcaactatgcccacgtatttcattgtcgggatcatgtacctcatcatcacgcttccgttgagttattatatgcgacaccttgaaaagaaattagcctaggagggatgatcaatgcaaaactttattgacgcttattcatggattaatatccgtttcctcctagaaggactttggattacgattgaagtttccgtaatttcaattataatcagttttattttgggaacttttctcggaattattcgttacgctaacatcaaatacttatcagcaattgtaggattcattatcgatattatccgtaatcttcctctcctgctaataattttcttcacctactttggcctccccaatatcggaattaaaccagaaattattcctgccgcaattatggcgctttcaattttcgaatcggcaatggttgctgaaatcgttcgctcagggataaattcgattgattacggtcaaacggaaggggcattagctaatggattaactaagtggcaagcattacgaattattgtcttaccacaagcaattaagaatatgatgccggctctcgttagtcagttcatttcattagttaaggatacatcactagcaacaatcattgtcttgccagagttaatgtaccacgcccagatcatctatggtcaaaacacaaattatattattccgatgttcgttgcgttagcagtcctctactttattgtctgctactcattatcattggttgcacgttatttgcataaacacattgcataagtataaacagaggctgagaaaaaactgttgtttttctcagcctcgttttatatgaatattgttacgatatcgcggaaattaaccacaaggcggttaatttccactcacttatttaatactgaatcataaagtcaaaccgttgatgctctccggtcaagcgattaacatgccgttccatcacttgacgtcgttgtccaaacatcatccaaacggcgattccaataaatactactaattctattcccgtcccaatccaattttgaactgttactttgccagtcatcaacgttgaatcagaagcaataaatgccgtccaatctaataggaagtgcattaccattgctagccataattgaccagtataaacataaacggttgcaaaaaatagtccaatcccagctgcgctaactgcttgtaaaacagtcattgaccattcttgagggccatagttggtaagatgaacaattccgaataaaattgaactcgttgccaatgccaacggaaggcgttgcttaacattgcgccaagcatagaataagatgccaagaatagcaaaacggaataaggtctcttccattaccgcagcctcaaacgccgaaagggtaaaatcccaattagcacggtggagccttggcatttctcccgtatttaaggccataaagataatatcaacaacaactaatccagcaaatatcccccaattaaaatcaccgctccagtgtggttttaatcctggccatgataaatgccacgtccgcataacagttgtcgtaagaataaagaaagcaactgcgccaactgcaccagtcgataatgctaataataagaagtgattatcaaccaagtctgttggtaaggcaatcaatggcgtaaaaaccacctgagctaaccaggcaataaagattagccgttcgatgctccaatgcatgaactcaccaattacgcttgcaaatggtgcaaacataataaagtaataaaaaatcatcattgtcacaacgccccgggatggtaaatgtaatagaacaataatttctcgaaccattacatcccaagcaaacactaaaattatcggctgggcaattacctgcagccatgcattcaactttttaactaacaaggatacattaggtaagagttcaaagactaaaccaattcctaaaataataaccatgatcaataatgctaatgcaacagtctgacgattaaattcgtaattacgaatcatcatcattgccaaaatgaccagggtcgccccaatttgaacccggtaccagatcctaagataatcgtttccggtcatttttcctcatcctctctgggaaatctaaaataattgctaaatatgatcataccaaacaatctccttagttttaagaacaaatcttctttttttagtttaaaccacaaaagaacctgcaggcaaaaaaaccgcaagttcttttatcgtttattttgtgtttccagttgcaactggttgcttctctttactattcttctttttagaatgttgctgagagttccggtgggaatgattattttgtcgttcgtttttatgtgtttgattatttttattgtttggtcgacgatagtgttggttttcggaacgattattaccgttcaaaattgtcaccatcggaataatcactggacgacgaccggtgcgatcatagagtaatttttgtaaacggctgataattgtccggtttaatacccgttgatcaatgtgtttgtgattcttaaatgtattaaggattgcccagaatacttcatgattggctgccttaatcagctcttgtgattcatgcatataaacaaagccacgagaaacaatatcaggccccgcaacaatttgataatcctttaagtcgacaaccgcaatcgctgttacgacaccttcttctgaaagcaagcgtcgttcgcgaatttctggatttccaaccgtatctcccgcatcacgaccatcaatataaacatcactaacactatcaatatggtccgccactcgacaagagtctttcgtaagagctaaaacatccccatttgcaaggacaaagctattttcctttggtacaccagtcatttcagctaacttagtgtgaattttttgcatccggtattcaccgtgaaccggcgcaaagaatttcggcttcatcaagcggagcataaactcttcatcaacttgaccaccgtgcccggatgtatggatattgttaacataaccgtgaataacattagcaccgtcttcttcaagcttattgatcaaggcattaacgctagtcgtgttacccggaattgggttacttgagaaaacaacggtatcctcaggctgaatggtaatctggcggtgagttccgttagcaatccgactaagcgccgccattggttcaccctgcgatccagtacacatgatcaatactttttctggtggatagttattaatttcgttctggtcaatcaatgagtctttagggatattcagataaccgagttcttgaccagccgtaatcgcattctccatactacgaccaaaaacagcaattttacgcccttgagcaatggctgcatcagaagcttcacgtaaacgatagacgttagaagcaaaggatgcgaaaataatccgtcccttgatccgttcaaaaatacgccgaatgtgaatatcaacccatcgttcagacttagtaaattccggtcgttctgcgtttgtactatctgaagtcaatagcagaacaccatcatcgcctagtttggccatttgttgaagatttggaccaggtaaattaccaaccggtgtcaaatcaaacttaaagtccccggtttgaacaattgtcccttgcggagtatgaactgcaatccctaatgtatcaggaattgagtgggttgtccggaagaaactaacccataatttcttaaagtgaacctcatcaaattcattgatttcatgcaattcggcatttcttagtaagtgtttttcttccagttttcctttaattaatgacattgcaaatggtccagcataaataggtgcattgaccttttgtaagaagaatggtaatcctccaatgtggtcttcgtgaccgtgagtaataaagattcccttaatcttatctttattttcaatgaggtaatcataattttgaattacgtaatccactcctagtaattcatcttcggggaataaaactccacagtcaataacaataatttcatcttggaattgtacacaatacatatttttaccaatctcaccaagaccacccatggcgtaaaaggcaacttcattgtttttaatctttaattttgtcataatacctttccttctatagatttttatcatgttaattaacggaatttaagtaagccaaaagaaccgctttgttctgacaaggtcggttattgatattcattttattattggcacttaatcttaattatttaatccgtacgtaaaactaactactattttaccacatctacaaaattgaaggtagtaattgcctaattctttgattaaaaaagaaggtgggagaaagtatttatctttactccaccttcctttttaaatcccactagttgcttgcctaatcttcttctggtaactgttcctctttttgttcccaagccttcatccaatcaacaaccggttccccatcttcatgaaatttaacattagtcaatgcggttaaaattttttgataagctggcttacttagccgcgtgcttacattaactaattcctgatgacccataaaagcattatcgcacaagatttgattaattgtagccattaattcattagatacttgtgagctaaggatctctaaactgcccctacgatattgatcaacataaaaattaataaaggaattaagggcaacttctttagcatcctcgcttaactcactataacttaaacctgttgtagccaattgttattcttcctttctcaaattaatttactttggttatcctctacattttaaccttaacacaaagtttattatccgttaattttccttccgatcccgaatacgaagactagtattttcaccatcaatcactgcatatacttcttttgtggaatcttcagctaatgcacccagcttaacttctccactatcttctccagtttgttctacctctttgataccgtccgtaataaaacgggtaaaaatcttatgaagttcgcgccgtttacgttccttttttacagccatcgctaaagtaaagccttgatccaaaaatactttaatcgttaatacctgaaaaattgttggaaaactaaaatagtgatttttattctgctcatcttgttcagatttaatataaccctttttctcccaatatcttagttgactagtagagacaccagttacacgtgctacttcactcatattaatctttaattgtttactagcgatcatttttctaattttttcagaaagcggatccattatttcctccaaagtgtatatttcaatcataaattaccaaaaattcgatatctttgtcaaataatttgacaaagatatcgaatagtattatatttttcacattgttaaaaacgtagaggaggattctattagtgaatcaagagcaacaacctgttgatattaatggtcaaacttataatcgttccttaatgatcttcgtcctattaattggagctttttgtaccattttaaaccaaactattctttcaacagcctttcccgcattaatggatgcttttaatattagtactgccaccgttcagtggttaactactggtttcttaatggttaatgggattatgatccccgtaagtgcctatttaaccagtcgttttaatactaagagtctttttatcattgctatgtcaacctttgaagttgggacaatcttagcatggattgctccatcgtttgccgttttattagccggtcgtcttatccaagcggtcggagtaggaattaacatgcccctaatgcagaatattatgctgactgtttatcctcctgagaaacgtggcgctgcgatgggagtaaacggcctagttattggattagccccagcaatcgggcctgctctatctggatgggttatcgatagttatagctggcggtggcttttcggaatgatcgcccccattactgctttagttatcattgttagtttttttgcagttaaaaatgttattcctaataaaaagccgcatcttgactggctttctgttgttatttcaacattaggatttgggagcatgctttacggattctcaagtgtcggtgataaggggtggacagatccggttgtcctttcaaccattatcattggggtgattttagttggaattctaatcatgcgtcaaaacaagctagacgatccgttccttgaattcaaggtatttgaaagcaaagaattctcccttgcgaccattcttagttcaattgtaatgatggcaatggttggggtagaattcgtcatccctctttaccttcaaatcattcatggaatgtccgccttccattcaggtcttacccttttatttggagcccttttcatgggaattatgagtccaattactgggaacttatttgaccgtcatggtgctaaacgcttagcctttacgggaatgtttatcttaactgttggaacaattccttttgcctttattactcgtgataccccaactatttatattgtcttcttatatgcagtccggatgtttggtatttcaatggtaatgatgccagttactacagcgggaatgaattctcttccttacaatctaatttcgcacggtacagctgttaacaataccattcgtcaagtcgctacttctgtgggaacagcgatcatgatctctgttttgacaaatattaccaatagcaatcgacctgctcattcactgctgacacaatccccattacaatataaagcaaagatgtttgatgctactttgatggggtaccatgcagcattctggtttgcaatcgccttctcactcattggtttattccttacattctttgttacaagtggtaatggaattcacctccgccttgatagcgaagacattgcagaaccaactgataaaggagggatgaagtaatggttattattttaacttttctaggagcactcgccttttttgcttgcatgatgtttattcggcaaaaaagcctgcgaattattttagctacactcacgggaattatctttgtgggctcaactcttttgatgacactaaattacagtcaccattttggaatgcaaaaagttacgacaacaaccaccaagcggatttactctgcttcaaattcctcaatgcccctggcaatttatcaaccggttggtaaaagcggccgcgatgatgtttatatttataacaccaaagttaaacaaaaaacgccttaccatacccaagcaaacgaatacaccactagtcgaattaaatggactaatggttctacccctcagctcgtaacaactgagacgcgctggcaatatcgtaataatttttataaagtcctatatgcatggtcaggaatgaacaatgcattagttaagcgaactaacgtgttagaatatccacgaatgtatgttaaactcacaacgagtcaggcagataaacttgccagagttgctaaatctgctacgggtgccaaattacaagcacaagcagcagaacaaggacgcgcttttgttacatcaaaggttcaagcagcaatggctaagaatcctaacatgactgctaaacaaattcaagaagtatcagcacaagcagaacaagaatttcaggcccaaagcgttcaacaaattttaaaacaagttaagtaaaaaatagagactaagagaaaaagcaatctctcctagtctctattttatatttaatctaattcaaaaatactggtggcaattctgaggtaaatgtcctttgtttaagggtaaagggatcgttaaaactaattttacttgcatgaagcaactgatgatcatacttactagtatcgccgccataaagatggtcaccaattaggggatgaccaatagcagcaaagtgaaccctgatctggtgtgtgcgtccagtgtgaagtcttacccgtactcgtgtccattttgcgcctcgttcttcaacccaatactcggtcaaagctcgttgcccattctcgtcaattacccgtgcagcctgcccatcctttcttccaatcggcttgttaatctcgccatgctcgtccataacctgtccttctactaaagcggtatattccttcagcatttgatgttgctgcacttgctgactgatcatactggaagcgatatgatgcttagcgataagaagtaatccccccgtaaagcgatccagtcgtgtaattaaatgagggcggagatctgcagaattatttgcgattaagtatccctttacccgatttaaaaccgtatcattttgaacggttggtcctgggatagaagtcacccctgctggcttatctactaccaaccaattatcatcttcataaacaacatttaagggctcattactactttcaacagtatcatcagctaattctggttgagccttaatggttaaaggttgattaggaagaatctgggttgttggccgtaccttccgatgatcaacaaggaattccccttcaccgtttttaagatcgttaaataaacgatgccccatccccaatgactgaagatacttctttattttaatcggttcggttcctcggtatatccacgtattttccatcttaatttcctccatcaacattgaaaaagatacaaaaaaagagctgatgacctaaatcacagctccttaatattgaacggtccgtacgagactcgaactcgtgatctcatccgtgacagggatgcgtcctaaaccaactagaccaacggaccaacttgacaacaaataaaagtatacgagatttatcgaaattagtcaacaaaaatttgtgatttatttttgatttttcgtttttcctatctataccgtaaaaattatcaatagtttataatgaaagtactagctattattaaggaggagtttttaatgcagcagttgggcaagcgcctattaaactggtggtctaagtattcaaaaatcataaaagtagtgtttgtaacctcagtcctagtctttgttattctcgcgttaggtaacttttttaaaacagttaaatggcatgaagtaggagttggtttagcaaacctgtcttgggaaagtatcatcctgctactaattacgggatgcatcgcagtcatccctatgttggggtatgattttgcaatcactcatttattacccgggaaatttaagaaatcatatattatccgctgtggatggattactaatactttaacaaatattgccggatttggcggaattcttggttctactttacgagcatacttctatcgaaagaacgcaactaagaaagagattctacttgctatctctaaaatcgctgttttcttactctctggtttatctgttctttgttgggtagctttgatcatcatgtttgtgtttcacgatggcggccacttcaaccaatacgcactttggcttgtggggggcggattatattttccaatcgttttttattttactgttattcataatagtaaaatatttaagaatatcacgcccaaagtagggacctttttagtcaccagttcaacttgtgaatggctatttgtagcactttttttcttactagtcggttggtgcttaggcgttcggcatagccttattagcgttctgccattatacgttgttgcccaagttctcggggttctttcaatgattccgggggcacttggttcgtttgaccttttaatgatgttagaactgtcattacttggcgtttcccaaactacctctgttatttggttattactattccgaattttttactacatcgttcccttaattattgccggattcatgttcttgcactctcttgcatcccaagttaaccagtttttcgacggattaccattgctaatggtccgcaaacttgcttactatttaattacaacgtttatgtatgtttctgggattctgatgcttattactgcctcaattccagacatcacagcacaaaataagattatcgcgaacctttatccctataccttcttcttcctccaccaattgacaaccatcttatttgcactggctatgcttgcctgtgctcgcggtcttcaatcaaaggtgaaaaaggcataccttcctactttaatattattggtaattggaattgctaataccatttggaacctgggaacattgagcttaacaatttacctcgtcattgttttgatacttgttttactctctcgccatgtgttataccggaagaaattggaatattcaattggaaaattcgcaattgatagtcttatctttgctggagcatgtatcctctatgtaattgtcggggttattaatgctcctcaatattccagtaagcaccacatccctgattttctatttttccctggtgaaaagatttggatttccggacttttcggattaatcctcggcctcttattaattttcgttattctgcgctactttatggccgggactgatcctttcaatattccaaacgtatttgatgctgaacggatccgcaatgttattaaagaatatggaggaaatgaaactagtcacctcgccttcttaaaagataaaagtatctattattacagtgttgacgatcatgataagctctttttcatgtatcgccgtaaatatgatcgcttggtcgtaatgggcgatccagttggagataaggatagttggcgaccagctcttcgacaatttgtcttagaagctgataagtatggctatcagcttgtcttttatgaagtctccagcgatatgacaatgcttcttcatgaatttggcttcgactttattaaaaccggtgaaactggccttgttaagctggcagactttacgcttgctggtaagcgacaacgatcacaacgagcattgatgcataaatttgatcgtgaaggctataccttctctgttgaaaagccaccatttagtaaagaattaatgcaagagatgaaacaagtctccgatagctggttaggaaacgaaacagaaaaaggattctctctcggtttctttgactcctactacattaatcaagcacctgttggcattatccgtgataaagacggcaaaatggtcgcctttgcaacgtttatgccgacagggggtaaaaagattttaacaattgacctcatgcgtcatagtaaagatgccccttctggaatcatggataaaattttcattagtatgttccagtacgggcaggaaaacggttatacctactttgatctcggaatggcacctctttcgaatgttggcgaatatcaatttagctttattgaagaaaaagctgcacacttcatctatgaatatggatatcatttgtatggctttcaaggattacggcgatacaaagataaatatgcgacagtttggtattcacgttatactgccttccgcaagaagaattcaatcattgccacaatgatgattctagttagtgtcgttaaccaacgtgttgatcagcaaaaccaccgttcaatcttctggtggttgattaaataatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagttttccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacatgttaagagggtgaggaaaaacttttccgtttttcctcaccctctttacttttatcgcctatttttgatccattaaataatcatatagcatctcatgcttaatcttatcagtgttgtatcctaatacctctgcaatctgataagcaaaggctaaggcagttgcaggtccacgactggtaatgatttttccatcattatcaacaaccgtaatatcctctttaaaatttgctgttggggcaaccttagcaatttcctcgttaattcccgggaagcaagtatagttatgattatcaagcaacccataccgagccaaggcaatcggagcagcacacattgcggcatcccacttattttctgcattgcgtttttgcatcaatttcatcaacttatcattatcgcgaagcttttgggcacccccgcgaccaccaggaaaggccaccacatcataattgaggagccgatcactcattacctcatcacaagttaattcaattccatgagcgccaggaacatgaagatcctctaatccgaccattgtggtttcaatcctcattcgccggagaacgtccacaattgtaagtccttcaacttcttcacaacctggtgcaaacactacagcaactttagccaaaatatcaccccatcaattattaattgttgcaactacccgtttcattacaccctttgcttctggaatttgataaagcgggtaaatatgaaacagtccacgaccagtatatgagtttacagtgatcccagcgttacgcaatttttgaacaaacaaggtcacatcaggatatagtatttcccttgtccctacaaaaacagtcacatcgcgcaactgatcaagattcccatataagggacttaagcgatagtcttgatgatctgtatcaccggcccacatcgtaccaatttttcgtaaaccgttcactgctagtgtaacatctttatcctcatatttgctaatgaggggatttgtgaggtcaaggtcaagccaaggagaaaatagaatgaggtgaccaggctgtggaagcccctttttaccaagatattcacaaaagccagctgctaatcctccgccagctgaatcgcccataatagttactttactagcaggcataagggtataaattttactataaagactagcaatttcttgataggcggtacggaaagtagcatgcggaactaacgaataaatcgggacataaatcttcgcatccgtggcgattgccaaccgatttaaatattgccaatgagtcttatcgggacgctgaatataggctcccccggttagatacatgattactcgttgattatctccgtgatcatttaagacatatgttgttacttcctgttcttgacgctgaacatcaaccgtcatctcagcagcaggtaagtagtaatcagcttcattgtcaatccatgcattacccactaaggcattaaatttattattttctgcaagatcatttttaaacccgcttaattgaattcccatttcagtaaaggttgctttactagaacgatgagcaccacatcgccgtaactctcgcaaactattctcaagattattagccaaatgactagcaatttgagtattaaatttttttattttctccactgaaacgatcgctcctcatttaaaatcttactattatcctatcatgatttaagattttgtgtctttaagattacctaaagccattagctcgcgttgatgacaatggttttgccagcctaaaactacaactaaaattaaggcaataacgattaaaattactgccgcaatgataatgtcgcgatacccattataaagaatcatacgcagggttggtaaaagcttatctggaagactactagcagtttgggcatttgataatttatttagcattcttaaggtaattccgtggtgcgtttgaacaccctggaatagctcttggttaagaataactccatacaccgcggacataagggtctgactcaaaattcgcaataagtatcctagcgaagtagcaattggtacatcccgtaattcagcatctgtttgaacattaatctgtaaaatattaaagacaagaccaacaccgaatccttcaaaagcacccatgaataaaataagccagaatggtgttttttgccccccaatcattattcctaaataagcaataaaaattgaggctgccccacaggtaacaatccagtattttccccatcgctcctgcaataccggtactaattctgaaccaataaagttagtaaccgcacctggaatttgcgtcattccgccaagcagcgcacttaaacctaaaattccctgagcccacattggaatataagtgacaaatgcaataaatgaaccccagattataacgaataaagtaaaatcaattaccaattcgcgatttttaaacagacggctaggaacgattgggtcgaccgccttactgtcaacttttatcattccgccaagcaataagagaccaacaactaataaacagcccactactaagccagaagctgaaccaatcaattgaacagctactaaaattattactaaactgactaccagtaaagttgctccaagataatcaactggcttacctgcagcttgctttttcacattcttatagaacaagctaatgatcgtaatcgcaattaaggcaatcggtacattaacatagaaaacccagtgccaactcaacgcgtcaacaatccatccaccgagtagaggaccaataatcgaagcagttccaaaacaagcactggcaattcctaatacttgggctcgtttttttaggttgtcgtacaattcagcaaaaacgataaacgggattgtattcattccgccagcaccaattcccattacagttcgcgcaataataaaccataaaatattaggggctaatccttgaaagatggctccgactaaaaacatggaggtagcagtaatataggcttgcttatttcccttatgctcaccaaacttactccataatggggttgcaacagccattcccaaaagaaaagttgcgatgatccaccccatatattgcaacccatgaaggtcactggtaatagctggcaaggccgtatttacaatcgtaccatccatccccgccatgatgttagatagtaacaacgcaccagtaacaattgttcgtcgttgttgtaattccactttttcatctcccttaattctctacgtactaaagaggatggaacagagcatcaaagtgcgttgtcccatcctcttgaattacaaactgtttcccattatacgacctttgtcacaaaaagtataatggttattttttcattttcttaatgtcctgccctaactgttgccagtcagctttaatagtaggctccaatcggcgggcatagagtactgcggccggatgatacatcggcataatccaatgcttatcagtcgtcaactcataaccatcatgcgcatcattagtccgttgaatcttttcgtggagaagttgcccatgaagcttaccaatattggcctgactaccaagcagccgttgtaaagccgtattgccaagcgtaacaataattttcggcttaacttgagccagttcccaatcaaacaaaggagcaaatgctaagacttcttttttagttggcgtccggttaggccgtttttcaattacttcacctgtcttcttatcaattgccttcttaatactataaggccgttgacgaactacactagtaatataaacggttgaacgcgagtatccaattgattcaatcaatttcatcagttcctgaccggaagcaccagaaaaaggaatatttaccttttcttcgtaacgaccaggagcctctcctactaacatcaaatctggattaagcggtccttgacctggagtaaaacctgttaattgccgatccttcgtttttccttttacctctgccagtagcgttggcggatattctgcaatcatgttcgtaatctcctatccattatgtcgccacttagaatctgtaagaatacgagcagcgatcaatcccattggcaagaatacaacaatcataagcgccttggtcatccaaagcgttcctacactaatcgaagttaaaccgatattatacattgcccgatacatatagagtcccgggaccataataacaatcgacggaaccgtgattgaaatttgtggatattggattttacgtttaacaatcgatgccaataacccggcaactaacgcccctaaaaatgcggctgcccctgccggtattccggtcaagtccgttaattctaagcgtaaagtattagcaatcgccccaatacaaccggcaatagccgccattttaggcgtactgttaaacattattgagaagccaaacaccccacaaaagctggctggcaaccggagtaaaaagagcattaatgcagatagcggcaatgcttgaaaattctcaggacgcaggttaaccattaatgctacaatccacccgaccaaggtagcaactgtaataattgcgattgcataggtcatccgttcaagcccggaccgcatatcaagttttgaaatatcaaggccactagtaataaatggaaatcctggaataataaacagcattgcgccgatataccctgcttcatgacgcgaactcacattaaacgttaattgcatcaaacttaaagccaacaggtaagaaaggcacgcaactgcaaccgcaaccgctactcccgcaaataaggtaatgtgatggtcaatcatcttacgacggacatagtttccgaggccagccccgataaaactacaaaacatttcaactggtccaccaccgagtaaaaagacgaaggcgctacatgccagagcggctgctaatcctacttggtaaggagcgtaattcccttttgagtgggcaatttcctccaaacgggagtgaatttctccaattgtcatctcactcccatgctggtcaaattctttaataaatcgttccatctgcgaaagttttgtcgtatttacacttgtgcttggcaaagatattgcctgcgtatagctatgatgggcatccatacaggtatactcgagggaaactaacccaatatcgaccgaacaagtcatttttagcgtccgggcaactgtattcattgaatcacggactcgccatgcccctgttccataagaaagcatcattaatccaattcgcccgacaatcgctgctcgttctactaaattagcctcatacgcaggggtgaaattatcatttgtaaaaaagtcatgccatggaatcgccatatgatgcttatcagacaaatgttcagtcggctcaaaatcattcgctgagatctctttatccttactcaaaacccatcaagctcctcttatcaattctcttaactatttaattatacggcgactgtcaagcgacgggagtaatttcttttaatttagtgattagttgctgctcatcatcgcttaaaatgtaatcctcccgtgtagcaagcgaaataaaaaatttttccggaattgggtctttaatatcgagggcgacaattcctggttcatcctttaccgcatctttaaccatcaaactaattcccttattttgccgtaccaactctttaatccaggaaacatttggcaccttataaattgccgtttgtggattaatttgggcataggtagaataggtctgaaaggcagctttatgcacatattgttggtcataattaataaagatttcgttagttaagtcttgaaaactaaccgcctttttctttgcaagcggatgatcagcacttacgatgatactaaatggtcgcgtagttattaattccgcaaaaatacctgcttgatcaattggtgcaattgagcccaacattgcaatatcgatctttcccgcttgtaattcacttagcaattcatgagatcccacagaaacgatttttattcgttggagaagctgcttagaaagattgccaataatgtgtgaaatatacatttttccaatgattggcggaagaccgaattttatttggcgttgatcggaccgtgctatttcttgatgagcaatgtctatttttttgtttatcgccaacgctttttcatataataactgcccactgcgcgtaatcatttcatccctatgaacacgatctttgcgcactaattttgtgtcaaattcttgctcaaggcgacgaattgcctgggtaatactaggttgagaaacattaaaatactttgctacttgcgtataattttttaatttaactagcatggcaaagtattgtaaatcacgagtattcatcgtcttaaccctttctatgtcgaaataatatctttatcttacgtcaatttatacttgaatacaaaagaatgttcgcaaaagaaatcaatcttttcaacaagacggtcggctaaactatcttcatgttatcttgttatttaaaataataaggctgggggaatttttcatttctcccagcttccgcactaatcttaagctattcaagtaaatattaaattattgatgttcttttaagtaattgtccattattttattaaatttgtttgcctgttctgccattattacatgaccactttgatcaacagcttgatgcgagataaactgtggattagcttgtctcataacatccgcaaatttaccattaaaatatggactttgatttgcggtaactaataatgttggaatattaattttttcaagtgttaatcgccaatcccgtttagcgtgatcatagagtaagggaagattttcggccctaataaatggaaacatttctttttctggctctaattttgatattacttgagatggtaccccatttaatgtctctctaacattaccatgctctttcaattttaatttatacgatgcccttgtgatatccatatatccataaggccattgaaccgtattaaacatctttggagattgatcaattgctattacaccacttaacggaaaatcagtataatatgataaaaatccatatattacagatgctcccatagaatgccctattagaaaaggttttgttacattcaaatgatttaatagttcatacaaatcctttattaaaggctcaatagaatctaactgctcatctctagttgatgctccatgatttcgctgatcatacgtaattacttgataaccttgctgaattaagtttttaatttgtaaacaccatatttgttgatagccgccaaagccatgaattaaaacaactggtttcccagtaccataaacatagtaattaattcttatcccatcacttgttttgaagtccatcaggtaaaccttccttcactaaagctaaaaagatagtaactattaataaatcagcagtacctccaaggcttaaattttgctgagtaaatttttcttcaatttcagttaatttttgttgcccagctttagtccttattccaccaagatttaaacactctttaatttctttatttttccattcttgaatagccggatcccccgctcttttaattaaggtcgaatcttcaatatgtaaagctaattctaaaaaagttattaaaattcgactattccaatcatagtttgatgttaataaggtcggtaacccatacttaaaaaccgtcgggtatccagcgtgtgcttctcctcgaataccagaaaggccgtattttaaatattgtttctcacccgcagttagaatttttttcgatgaaagatgttttagatcatcattaatcaaattttttaacatctttttaatcacgtttttaatatcatttgcatcaaatcgttttagatgctgtaagctgtaggctgttgctgtaacaaatactcccaatgaaaaaactgctcctttatgagtattaacattatttgtagcaacaaacattgttttctcagcttttttaccatattcacgtaacttttcaaatatcaatgataaattagcagaacgactcattattcccagtaatgctgcttgatgaagatagttacgcaaactaatagaactattaataaacgtaaatatgtccatatctaagtgtgctccatgttcaactggatccactaatccgggcttaggccaagcagatacttcatataaaagagctcgctgtgcaagttgagttaaccaatttgcaatgttttctttttcttgatataccaattctacgcaaactagctgactaactttttcttgtaactcttcaaccgaatgtcgacgggagcgaccacattctttagctgggcgaccacaaattaaacactttctagcaggttgatttacatctgaccttgatagtgattttattgttccactatcattagccagcacatctaagtcaaataaacgataacttggcttcaattcttcaaaatgacttgtaatctcttttactaaaattgctcctgtatcaacaagatagaagcgttctggaccggttttcttatccagccactctttttttgaaataaaaacaattccagcatctaataacattttttcaaattcattgagaccagctataaaaaatgactctatctttttattattctttattggaccaggaatatttaatttagctgctacaacagtcattgatggattagttttcaataactggttttgtatttttacacgctcatccttattttttaaaacggcaagaatgtcttggtattcaccgtgatcaaaaatagtttgcatactaactcctcaaatcaaactttaacattaattatagcaataatgggtataaaaaacggtactagaaaattccagtaccgcaatttctattcgtaattagtccttaatttgtttaatttcatcaattaaagtaccatcacgatattcaacaagtgcaactgttcgatcagtatattcaatcttttctggcttaccaacaatcttttctgcacgttgttgtaattcttcaattgaaatcaatggaatacttggcacattcttgaatgcttcaattaaatctttacgtgcaggatttacagcaacccctacttcagtaacaacaacatcaattgatgaacctggggtagttactgaattaacagctggtacaattgttgcaatccgaccacgagttaatggtgcagaaataattgtcatctttgcagtaccagcatcttggtgtccaccaacagcaccacgaatttcaccattagatccagttaaaacattaacattgaaatcagtatcgatttccaaagcagaaagaattgcaatgtccagttgatcaaccattgctcccttgttatcaggatcagcataccatgatccgtcaatttcaatttgaccaggattactcttcatacttgaagcagcacccttgtcaaaatcttgaacatccataactttctttactaatccctcttctaaaagtttaacgattggcgaagtagttcccccacaagtaaaggaagcagtaatgttgttatcaatcattgcttgacgaaggaaacgggtaacagctaaagcagctccaccagtaccagtttggaatgagaaaccttctttaaagtatggagaatttacaattacatcattaaccatctttgcaatcttcaattctttaggatccttagtgaaacgtgttgcaccactaccaatacggtctggatccccaactttatcaacttttacaacgtaatctacttgtgtttgttggattgatgcaggcgtattaggataatcagcaattgtatctgttacaagaacaactttatctgcgtacttggcatcaactaatgcataacctaatgatcccaaagctgattcaccattcataccattagcatttcccattcgatctgagttaggaacaccaataaaggccacatcaattttaatgtttccattttcaattgaacgtgcacgattaccatgtgaacggaaaataaccggattctttaataaaccgtgagaaacggcttctccaagacttccacgcataccagaactagtaatgttagtaattgtaccagccttaatagcttcgattaccttatcattcattaccccagttaacgatgatggagccaaggttaagtctttgtaacccatcttgatgattttatccataaccatgttaaatacaaagtcaccattacggaagtggtggtggaacgaaattgtcatcccgtccttcaagttattcttgataacatcatctaatgaatctactaacttatcgtcacccttggtaacacgaacatcatgaccagtatagtgaacaattggatgaccaatttcagtagtttcaaatggcttgtagtttgttgaatctaaaattttatctgaaatttcgcgtccgactttatttttcaatgtattcgccctcctcattgatcaagttagaagcctttgctaaacgaattacccgttgtgcacgtaatacaactgggcggtcaaccatttgaccgttcattgagataacacctgaacccttttggtgtgcttcttcaattgcagcttcaacgtccaatgcattttcaatttctttcttggttggttcataaatcttatttacccaatcaatttgacgagggttaacaagagatttaccgtcaaatcctaattcgtgaatgtgttcagtctcacgtttaaagccttctacatcattcatattagtaaagacagtatcaaaggctgcaatgccagcggcacgtgctgcgtgaagaatcatgttacgagcaaattcgagttctgctccatctgggtaacgatgagtcttcatatcagtcgtatagtcttcagcagaaagtgccaaaccaatcatccggtcagtacttgcagcaatttctggtgcattaagtactcccttagcactttcaatagctgccataacatgcgttgttcctggcttaataccaaatttgttttcagcttcttctactacttttacaagatctagcatcatttgagctgattctacttttggcaaacgaacaacttgaataccagcttttaccattgcgaaaacatcattcttaaaaaatggtgtatcaattccattaacacgaacaactaattctgaatcaccataatcttgtgtttgaagagcttgataaactaacatccgggcagcatctttttctgccattgaaaccgaatcttccaagtcaaacataatggagtcggcaccataaataccagcatcctttaccattccggcattgttacctggaacaaacatcattgtccgacgtaaacgttcttccattattaaaatacctcccagtctggttgatctgctgtatcaagagcacgttgagcagcagccattgtccgtgctttaattacacaatctaaagctcctttatccacagctttaacattggcattatcaattccataagcagttaaagtatcagtaatcaccttacgaatttgattaccataaagttcttccacagaggaatctaagtcaatgttgataccattattaccttggctcaaagtaatttgaatatcggaagattccaaagttcctgctaatgcagtcttcttaatatccattatttaatacttccttcctttatccgagtttgaagctcagaccagttgtttttaataaattcgagcgttgtatctggaacatacttttttactaactcaatattatcattagcaattgctgctcgtaccttcgttgctgaaataatatcctgatccttgtttttctttcgatcaataatctttacttcaacatcaggtggtagaaccctatttaactcttcattatatatatttgttgttttggaatatggttcattcccaagatatcgagatgttatattaagtggttttgcaatttgttccttaaaaagggttgcatccaaggaagcttgaaatcttccaacattttgatcatcttttaaaaagtatgctggaaacgtagcataactaaccatgtattccttacctggtactactataacatttggtaaatcagccactccagctttaactaatttaaagcgttcagaaaatgaaaaaatagaaacatcttcactaacaacgaaaacatacacatgatcattttctttactagcagtttcaactaggtaacgatgtccgtttgtaaaaggattggcattcataactattcctgcaatcttactttccttttgatcattaaagttcggtaaagaagaaatatagtcatgaatatcaggagtaccactttctaatacagttccttgttttacttttgctaattcatgaaatccaacatactggaaactttgactatattgtggtttcgtaaaaacaaacaaatgaaagcgccccatcattgcagcttcgttttctaatttactaaccaaactgttaaatgtttcaccatgtccctgaacttttgaacaaattgcaatatacttcaatacattaccagcaattgatccagttgctaaaatctcaccattttcttcccatacaaaagtcttatcaatagaagatgtttctttttcagaaaaaacttcaattccattgaaccgcaagaacttttgccacttggtcaaattgcgttttaaatgaatgttaatttcacgaacttccattaatattctcctaatcgttattcttttgacttgcataatgttgaacagctttagctactgtatttactacaccatcatcaaatactccaggaacaattttttcagctgttggattagaaatcatatttgctaatgcagaagcaattgctttttcaaggccgaaatcgactttatttaaatcagctgataataatcctttatataacccgggaaataccaaaatattatttacttgatttgggtattgacttgagccagttgccattactgctgcatctgcatcttttgcaatttgaggatcaatctcaggctttggatttgcaagtgcaaaaataattggattcttagccattgtctttacttgttcacttgttaaaacatctgcatcagaaagaccgataaaaacatcccgatcctttaccgcttcacttaaattcttataaggagtttgatcagcactttgttttactaaatctgtttgataatgattataattttgactatcaacatgcactggtccatcaatatcaacaaatgtaatatttttaatacctgccgcaaaaagtaatcgagctgttgcaactcctgacgctccaactccattaattatgactttcaaatctttcagatttttctttactactctagcagcattaattaatccagccaaaacaacaattgctgttccttcttgatcatcatgataaactggaatattaactactttagacaatttctcttcgatttcaaaacaacgaggtgctttaatatcttctaaatgaaaacccgcaaaagattcctgcatattctttaatgttgctacaaattcattaacaggaacttgctcaacagttaaaggtagtgcattaacattagccaaatccttataaagtaatgctttcccctcaacaactggaagaccaccggctgggccaatgtttcctaatcccaaaacagcagagccatctgttactaatgctacaagttttccactaagagtatatttatcctttagttcgggataacgttctataagcttagagattatcgcaactcctggagtatacgcttcacctaattcttttcgatttttcacttcaaattgaggtgcaatattaagtactccttggttcttagcatgcattgagagtatttctttatcttccatttatcgaaagcctcctcatttcattattaatatcttaccacctttttaaaaaaattaaaataattactgtattttttaaatatttaaaaaataatgatatacttaaaacaacattgagcatgaaaggaataaaaataatgaactcacagcatcaacaattactcggtaaccttgcacaagattattaccttagcaaaatggcaattagtgatatttctaaaaaatataatcttagtcgctacctcattatgaaataccttgatgaagcattttcaagcgggattgttgatataagcattcatacagattatgaccgaaatgcccaactagaacgcgaattatcaaatagttttgatataaaaaatgtctatgttattaaagatccaagcaaccccttggaccgcgataaaatcattgctaactttgcagctaatcagatccaatctcttattaaagaatataaaataatcggattatcgtggggggaaacaatttatactattcttgatcatttcagcaaacactcttcccgcaatttagttttcacacaatttatgggtgaaaatatgaaatataaatcttctgccgcatcaatgcgaatggtacaaaaagctgcatccaaatatgattgtccttattacaccattcccggaccactttatattcttaatgacgaagcaagaaatgacctatattccgaaccggcttttacagaagcatttaaggttgccaataaaatggaaatgattgtttgtggattaggcactctccaatcaatagacagtatccctgcttggcatgattataaaaagaggttatttaaaggagttagtttaaaccaaattgctggaatggcatttggtcgtccatatgatattaacggtaactttctaattcatcccactaacgataaaactctctctatccctttaaataaaattcttaacgttcctatacgctttgctattgttcaacgcaaatcaaaatatcaagccgctttaggagcccttcgtggaggtttatttactgatatgatacttacagaatcaatcgctttacgaattattgaagagttaagataaaataaaaatccgaattcccgttacgagaattcggattttttatttacttcttctaccaaatgccaattaggcgcatccagaaggttccaataataccgtaaacaagtaagtagaagatacctaatataaagttcatcttccaccattcgctctgagtaacgtaaccagatgatgataaaatcgaagctggtccgttagcatagtgagtagtagaacccatgatagcagaagtgaaggcaaggagcattgcagttaacattgctggtgctccagcagcaatcgctacagaaacgaaagccgtgtacattgcagtaacgtgagcagtagcactggcaaagaaatagtgagcgtagaagtagacaactactaatacaactaatacccaaatccagctaactccgtgaagggcaccttcaatactgttagagaaccatttaatgaagcctaacttagtcaattcactagccatgaatactaagattgaaagccaaatcaatacattccaagcaccagattcgttcaagacgtccttagtttccaacacgccagtaataagcagaagagcaattgctaagaaagccacaaaagtcgcgttaatagcaggaataaaactagtcaacatccataaaacaagagtcaataagaaaataagccccatgagcttttcagaaagcttcatgctacccatcttttcaagttcgctattagcccaagtcttagcgtttggtgtttctttgatttctggtgggtacatcttgtagataatgtatggcacagcaattaaacaaagtacactaggaagaactccggctacaaaccatccaacccaagtaatattaatgtttaatgtcttagctaaggcaactacaaccaagtttggtgccatagccgtcatgaaggttgcggaagtaatcaaattactgtggaattcagtgaaaactaggaaagaacctatctttttccgagtacctttctttgggtcagacccataagtttcagctaaggacttaataattggataaactaccccaccagcccgggcagtattacttggaatggctggtgaagtaaccaaatcaattcccataatggagtatgctaaccccaaactatgttgcccaaaactacgaacaaagaccaaagcaattcgccgacctaatcccgttttaataaaaccacgggaaagtaggaaggccattgcaatcagccatgatgacgaattttcaaaggcctttaatgcctcttccatcggtacaatgccaaccaagaccataattgtgaacccaactaaagtcgttccggcaatcggtaacggctgggtgatacatcccacaatcgttgctacgaaaatagcaaacatatgccaagcagccatagaaacgccatcaggacggatcggaccgcagaaccataagattaagccaacagcaacgggccatgcccatgccttagctttaaatttagctaatcccattatattaaaccctctttcaattaattcttaataaccacaccatctaagacatctttcatcttagcagcagagtattttagtttttcgatttctgtatccgaaagtccgtaatcaacgactttttctattcctgttcgattaacaattgcaggtattccaagatacaaatcattaataccatattgtcccattaaaggggctgatattgggagcatgatattacgattttcaataatcgcttttacaatataagcaagatatttagctactccatagaaagtagctccttttccttcgataatcttaccaccacgttctttaactgctttttcaagttcgctatagtcctgagcagttaaatcagtaacttcttttaacggttttccattaatagtggcttcatcgaatgcaccaaacgatgtatctccatgttcccctaaaactaaagcatcaatttcatttactggaacatttaacttttcagataaaagtacattcaatcgagccgtgtctaatgaagtaccagttccgataacacgatgcttagggaatccagagagttgttgtgtcactgtagttaaaatatcaacaggattacttgatacaacaaaaataccgttgaatccactttcaacaattgggttaacaatagttgaaagaatctttgtgttccttgaaacaagatccaaacgagtctctcctggcttgcgtggaactccagcagtaataactacaacatcagcatcagcagcatcagaataatcccccgcatgaatgttgactggactagttagtggagtaatatcttgtaaatccaatgattctcctgttgccttctctttctttaggtcaacaataactaattcatcaatttcttgtgttgtttgaaggagtgagaatacgaatgatgatcctacagctccatcaccaacaagcacaactttatgatgatatcctaacataaaattttcctccaaataatatacaaataattgctctaggcagtttctcactgcccattatttttttactttaagccacgggcgtaaacagttacttgttgacctgcttgacgtccaaagacaattgtttctgcaattgagttaccaccaacacggttattaccatgtaaaccaccagcaacttcacctgcagcatataatcccttgattacatccccattaccatcaagcacttgagtctttgtattaatatgaataccacccatagtgtagtgaattgcaggtgcaatatggattgcaaagaatcctggcttagtaattccacgatccattcctgttgtccgatggaattctttatcgtcatgattttcaacagcttcattccatgttgcaactgtcttctttaagttctcagtatccatgttgaggttctttgcaagatcctcaatcgtatcgccatgaacaacaagaccaactttatcgtaaaattcaattgccttagcatggtcacgaataccttggtcaaaaattaagtaagcactgtgttctggaagggaagtaattgcattagaaacaatctttcgagtgtttaattcgttaacaaaccgattaccttcagcattaactaagattgcaccttcaccacggacagcctcaccaataaggtaaacatgaggattatcttgttgaacagttgggtgaacttgtacaagatccatttgcattaattcaccgccaacgccttcagcaagcttcaagccatcaccagttgctcctggttgattggtagtcttgtaatcagcaaggtcagggcggaaccgcttcatgtattccttagaagcaccaaatccaccagtagctaagataacagcctttgcgtggatggttttaattaggccatcagcattagcttcaacaccgattaccttaccctcatcatcttgtaagagcttgttaactttaaccttattaaatactggaatgttttccttttgaacaacttccaataaactttttactaagaaaccaccaattggcgccatacttgctggacggtgagtacgcttacaagacattccaccagtaattgtaatgtcatcaagcttaatcccatgatcagctaaccagtcgattgctggagctgtgtgatatacaaagtaacctagcatatccttgtcgtttagacgtccaccatcttggtatgtttcgtggtagaaatcggcaacgttatcaattactccatgttgtaattgcacattggtttcagcggcgttcattcctgaagaagcccggttagtatttccaccaagttcttcttccttttcaagaacgaccgtcttcattcccaattcgtttgcttgaattgctgcggaaagacctgttccaccagaaccaattacaataacatcgtaatcattatctaatttacttacagataatggttggaatttttcagccatgatattgctctccttttaattatatttaaatgtattaacagtcaaaaagagtggaacaagttctttttattgcttatttccactcttgccaaaattggcattacttttaactcaattcttatttatcacgatcaacgttggtcatcttaagcatgtccatccattcatcgtattgttcttccgtaagcttaccagacttcaaagcagcttcttttaatgtgctaccagctttatcagcagcttgagcaatcttagcactgtcatggtaaccaatgtgtggtgacaaagcagtaacagtcatcaatgaattatcaactaattcttccatccgcttttcattaactgtcattccgtggatcatcttgtcagcaaatccagtaattgttccagttaataagtcagctgattcgaggaatgcatcgattaatactggcttgtaaacattcatttcgaagttaccttgtgatgaagccattgttactacagtatcgttaccgaatacccgtaaagcagccattgttacagcttctgcttgagttgggttaaccttacctggcatgattgatgaacctggttcgttagctgggatatttaattcgccgtaaccagcacgcggaccagaagctaagaaacgaatatcttgagcaagcttgaacatgtcagctgctaatgtcttcaaagcaccgtgaacaacatctaaaccagagtggttagctaaaccgtagaacttgtttgaatcagcagtcaagtttaagccgtaaacttcgctaagcttttcagcaatcttttcaggcattccttctgcagcattcaaaccagtaccaacagcagtaccaccaattgccaattcatctaatgttgattccaaagtcttaatgtaatcaaggtcatgttctaaggaagcaatgtaaccagaaagttcttgaccaaatgtcaatggaacagcatcttgcaagtgagtacgtccaactttaacagtcttcatgtacttctcttccttaacctttaattcatcaattaaatgttgaacagctggcttcaacttatcaagcgcttctaaagcaactacattcatagcagttggaaatgtatcgtttgaactttgacccttgttaacatcatcatttggtaagatttcaatgtcagggttaatttcatgagccttgtgcgcaacaacttcattagtattcatgttggtttgggtaccagaaccagtttggtaaacctttaatgggaagtccttccgcaattcttcatcacttaatgcgagtaattcatcaatcgccttaacgattaaattacccttttcttcagagatagctttagtttccatattagcttgagccgctgcctttttaatgttcaataaagcacggataattgctaatggcatgtattgaccggttgggaagttattccgactccgttctgtttgtggtccccataatgcttcagcagggattttaacaggacctaacgtatcttcttcagtacggtattctgacatctcaaaaacctccaatatattaattgagcaattttgtcttgtgaaatgttacacatcatttacacgtatatcctaccttgtaagtaaagctatagtcaaatctttaattttcaataaatttcacttatagctattgccttgccaactgttataatagcttttttcaattacgtttgcaaaagtttcacaaacttcgatacaaaaaaacacctaagattttttaatttcttagatgcttttctatttttgtctaataatctggttttattattcacaaagatgaaagctgcttgattaatattgaggcttccaaattttttctgctactacgctcttcgcatcagtaattccgtcgccggctaggccttgatcgatagcagattcagctactcgttcagccactcgcttagaaaattctgttaacttagaaacaggaggtaatacagctgctcctggtttttctgggtcaactaagccacttaaagcatgagcagctgcagcaagcatattatcatttaacactttagcttcagcagccaaggcgccaaaaccaactccaggataaattaacgcattgttagcttgcccaatttgataaacggttccattatactcgatatctttaaccggaattcccgtcgcaattaatgcctttccatcagtccatttgagaaggtcggctgcttttgcctctgctaacttagttgggttagagagtgggaagataacaggccgtagagtatgggctgccatttcctttacaaccgcttcatcaaaacttcctggctgagtggacgtaccaatcattactgttggatgaacagccttaacaactgcaagtaaattagttaattcatcagcattagcaaattcgcttcgttgacgggtaaatggcttttgctttggtgttaagccgggcgtatcgtcaaacaataatccttgcttgtcaacaaggtagaagtgcttctttgcttcttcgggtgtcaggccttgacggatcaattcgtcataaagcatcttagcgattcccattccagcagtacccgcaccaaatgttaagaatgtttgatccgttaacttttcttttgagatattcatggctcctagcacaccagctaaggcaataattccggttccttgaatatcatcattaaaggtcaaaattttatcctggtacttatcaagaatccgtgcagccgttccccgaccaaaatcttcaaagtgtaataaactcttagggaacaatccttcaactgcatcaacaaacttatcgatgaagtcaaagtaaggttgtccttcaacccgcttcatccgattgccaagatagtgcggatccttaagtaatttttcattattcgtcccagcatcaatagaaaccgggagcacttgggatggatcaatcccagccgctgctgtgtaaaccattaatttcccaacagaaatgtcaaccccatttacaccccagtcaccaataccaaggattccttcagcatctgtaacaacgataaggcgaatatcacgaccatcagcggcatcagcaagttcctctttaattaagtcaggatgctcaatgctcaaatatgcagcatcttgcggcttaatgtaacgttcattatattgctcaatcgcctcagcaattacgggatcatacacaactggcataaattccgcaatatgtttttccattaagtagaagaaaagcgtacggttagtattgaatacttccatcaataggtgacgttgttcaatccgtgagttcttagattgatataaccggtagatttcgtctgcctgttcctcaatcgttcttacacaagatggtaacaagcctaataaaccatacttttttcgttcttcaattgtaaaagcagttcccttattcttaaagggatcatttaatatttgcattcctttacgcaacattatcgcctatcctttaccttttttctgtttcaacattcttagagtaattccagcgctagtttatagtcaaatatatgctatgatataaataaaattgataataccccttataatcactgatagagaggcatttactatgaaattaaacggcctaaaatattatcaagcactggtaaaatataaaaatttttcgcaagttgcagcaaaattcaatgtcagtcaacctactattacaatggctatccaacgactagaaaaagattttgggacgtcattttttgttcgtgaccatgtccataaacaattgcatatcacgccgactggtaagcaattcgccattcacgttgacgttattttaaacgaattaaagattgctcaccaagaaatcaatcaagctgaatcatccagtattcgctttgggctgccacctattatcggcaattactactttccgccattaaccccgctattaatgcgagaaggccttttaagccacttggaaacctctgagcatggttctaaggaaattctcaagatgcttaaacacggtcaccttgatttggcattgcttggatcgcttaaccccctaaaggaagtggggctaaaaactactgaactggctgagtatccctttaagattattgttagcaagcgtcatcccctcgctgctaaaaaggagattgattttgctacgcttaaaaatgaacgctttattgttcctgatactgaattctttcatgagcaagcttttaagcaaatttctcatttagctcattttcgtccccaagtcatctaccgaaccgctgacattcacgttatcaaaaccatggttgcagaaaatcttggaattgcttatttaacaagtttggcgattaccccagaagataatatccattccataaatgttactagcccgttaaaacaatcgttccgtctgtcagctgttactcgttcaactgaattattaacagctcccaagcaaaaactatgggatctcttaactacaaaaaaggaatgacaaataaccgtctaatacggtggctatttgtcattcctttttattatttctctttttcaatcttaattgtcttaataataacgtctttttcaggcttatccatcgcatctcgcttaactttgctgatcttttcgacaacatccattccggataatacttggccaaatacggtgtgatggaagtcaagccacggtgtaccaccatgtttttcgtaataatcaataatctcctgcgggtatccaacagccttcatttgatcaatcatattttctggaacatgttcattagtgacaataaagaattgactgccatttgtgttcggaccagcattagccattgacagagcaccagtgaagttaaataattcttcagaaaattcgtcttcaaatgggtgaccataaatactttcgccaccacgtccggttccagttgggtcaccaccttgaatcataaaatcaggaataacccggtgaaaaattacatcgtcataataatttttctctgctaatttaacaaagttttcaaccgttttaggtgcgtactttggaaaaagttgggccgtaattgttcccattgtagtttcaattactgcttttggtcctttaacctcatccaatgataattggggatatttcataaaaaagcctcctcttttctcttctaaacctctctaactatcttagcaggaatatgaaggaaaagacaattattagtcctcactaacacgtaatacacaagctcccttaatatcgccatgtttaacatagcgtaatgcttcatcagcctttgctagtggatattcgtgtacttcaggatggatattgagacggtcagctaatgttaagaattcttccccatcacgacgggtattgctctcaacactcgttaatgtcttttcgtggaatatttctttttggtaattcatcattggaatatcagtcatatgaatgccagctaaggccaaagtcccgcctggaactagactagctaaggccggtaataccatatcaccaactggcgcaaagatgattgacgaatccaaaggaaccggcgcagggtcataggatccttgaacagaagcacaacccaattccagggcgaatttctttgcatcctcaccacgcgtaaagacatgcacttcaattccctgtgcaagtgcaatctgggccgtaatgtgcgctgagccaccaaagccatatagccctaggcggccaccagcgggaacattggcacgttcaaaagcccgataaccaataatccctgcacataataatggagctgcctctagggaatcaaacttttccggaagccgatatgaaaatccttctggaaccgtgacatattctgcataaccaccatcatgatcccaaccggtataaagtgaatgaggacagagattctcatgacccgagcgacaaaacttgcataccccacaagcatgccggaaccatggaatcccaattcgctccccaagcttaaatcgttgtgtttctggtccaaaaccgacaactttaccaacaatctcatgaccaggagtaacgtgttcgtggtgaaccggcaaatctccttctgtcacatgcaagtctgtatgacataccccacacgttaataccttaacaaggacttctccccgtttaggagtcggcacgggcttttcggtaaattcaattggtgatttcttaccatcaatcggcccaggagttgtgactgcccaagccttcattgttttcggaatagcattttcgcgtttttccatccttaaagacctcgattaaatatatatttcattctttattgtagtgctttttattcataagagtgccgtattttttcaatttgacgagaccattgatccttaaattttggaatgtttaacggagcattgatagctggatcatcctttgctgcttgagttaacccttctactcctccgatatcatccaagattccatttccaaaaccactaacaatttggggactgatatgagccggcaatcgtttaggctttacctcctcaaatctaattttaaagttccacatatcgccaaagtcatatattaggtcatattcatggtcaagattacaatcgcctacccaactttgggtaatatcttttgattgaccaaagccactatcaagaatcggcaactgatagtgagtatttccttgatgcagttcaaataagtgatgcccgtccgcgttaaagactgctaagcttgcaaagcacaacatatccaggcgcatatcaccgctgacggtaaatcgccgccacattttaggatgataatcacttagctcaacataaatagtatattgtttattaacatattggattgcatgctcgcgttgatttcttacttgccgctgcatatcacgaattatacgttgtaggtggtacatccgctgtttagaaccaagatcttttagcctctgactaattgcttgaacaaacaaatcgtagtcctcactagagaaaagatcttctgcccgtaaaaactttccaaattcgcgaaaggcatcacttttagaatgaaagccggtatcagtcggacgatcattatgtagtttttcatagttaattaaatagtgatagaccaaggtaatatcgtcaagaacagattcaccgagtgcctcacagtagccgatataatctgcagcacaatctaaatcttgatcaacgatgctctcgctctttccacgactttctaaataatcttgataatcatctaaaatcttttctccgaccgccgttgcattcatgatatcgttaattgaaagtgagcggtaaagatagcgacggttatgttcattaagtttagggtgagtaggcaccttaaagtccgtaactgaatagtcttcaaaaatatccattacaacatattcttcatccgttgtcttattggtaatacgtgtctgttccgctaattgaagcgcaatttcagcattggtcgggtctttttcccaatcaataattgaattaggccccatcatgaggttctgatacatctgcaattgctgttgagttactggctgaatttggcgtgtaaatactactttgctaaattgggcgtcacgaatcatcctaatttttgcatgaggaattggcgaaacttctaataaacttaagaattcacgcttaaataccgcaataaaagatcgtgagtcattaaagcgttgaggatagcgtacaataattggcaacgacattaagttattcataataatcatgaattcaccagtaacacgaattgtccaaacatttgtctctaatagatcagatggtgcaatcacctgtgaattaatatgcaaatgttgggcaagtgaatttcccactgcaataatcaccctatcaactcctcctataatttcgattatattaattttattttgaaaagcattatttatcaacttaatcaaaccatatttactgaaaattataggcagaaagcctgtgactttagtcatgggatgaatgccttccaaagcagccatgagactgctttttcttactaaaaagtctataaaatctcgtttctgcccctgcaaatttagtaatattaaagtataaaggaggtgaaaacatgaccacagttttgaaagggatcaagcttcgcttgtatcccaacaagcaacaacaagctcaactatgtcaaatgtttggcaatgaccgctttgtttggaaccagatgcttgatatggcaaaacaacgttatcaaaacaatcctagtagccagtttgttgatcaatatggcatggatgtattgttgaaacctttgaagcaggaatatccatttctaaaacgtagtgattctaccagtctccaagttgttaatcataacttatatcaggcctttcaaagattatttaagcatctgggtggttacccacgctttaaatccagacggtctgctaagcagtcctatactggtaaaagcaaaattcaaatagtggcgaaccgctatttgagattacccaaaattggctatattaaaaccagcaaaactcgccagttaactcattgtaagatcaaacgctatacggttagttacgatccgtcaggtcgttattacctgtcactacaggttgaaaccacagtacagccactatcgaagactagtcaacaggtcggcattgacgttggcgtaactaatttagctattactagtgacggccataagtatgctaaatttgacgctgtctggttaactcaacaggcgcaacattggcagtctaagtatagtcgccgccgtcatcaagccacggtgagtgtccgtcaatggaaccataaccatcaggacgtcaaagaggaactgaatgactaccagaactggcaacgggcccgaattcagaaagctcgctatcaacgacgagtcgctgatcagcggcgtgattacctgcataagctgacgatggcattggttacgcaatacgatgtgattgtcattgaagatttgaaagtcaagaatctgcaaaagaatcatcatcttgccgcggccattgccaacgctagttggcatcaattccgtaccatgctgggatacaagtgtgactggtatggtaaacagctcattactgtcaagcccaactataccagtcaaatctgtagtcattgtgactaccatagtgggtccaaaccgctcgtaattcgtgaatggacgtgtccaaagtgtggggcccatcacgatcgggatattaatgcggcagttaatattctgcataaagggttaaaagccgttggctagggactagccgtggtaaaagaacgaaattctgtaagttaggtatttggaataccaatgtaacagcctaaatactacttcgcgttcccagaaaccgccgactttagtcggtgtgtagttcataaataaaatagaagatttaaaataagacataagtattgtctctgaaaggatgcgcaacttttgatcaatcaaaatctcgatatctttgacttacgaaaaattcaaatcaataaaactaaagctgaattggaaaataatggtaaacggcagcaaaaagaagtctctagtgacatgttaggaaccttcatgccagttgatcgcgaccccgtcaagataatccagatcactgaagctaacatgatccccgagttgcttccattgcgccaccaaagaatgcttgccagtcgcttttcatttttccgtggcaccgctgaattaatggaacatgaccttaaaagacaagcccaaagcaatcttcccataattatctgtggggatgctcatgtaaacaattttggcttttacgcctcccctgaacgcaagcttctctttggccttaatgactttgatgaagcccgaatcggaaattgggaaagtgatttaaaacggttattagttagtgctgaactagcgggcgaagagaacggttttgatcgcaatgacctttaccacctccttcaattaacgactaagacctaccgccatactatcaaaagcgctaataagatgagcctttcccaactgttttatttttcatttgcctatgaagacatggggaaagcgattgagtcttttggtgatatttcaacgcaaatgcaaacagtccttaataaggttcttaaaaagagtcagcgtagcaattcagaagaaataatccaaaaaatggcaactatcaatagtcaagggcaccttgtttttcgggataacccaccacgtgcacgccatcttagcgccgtgcgttatcaacagattgttaaaggatacaataaatattgcgaaaatgttcgtcaagatgttcgggttcttctcgcaaactttcacatttccgatattatccgctatagtgtcggggttggcagttttggaacacgatgttacttaatcatgcttactggcaatgataatagtcatattgttttacaagttaaagaagctatgccattgcgttataatttactttccctccccgtacaacaagtaattagaaatgggggaatcgctggtcaaagaattgtaacagcacaacgggttctccaatcctcatccgatcgttttttaggaagtacaacttttggtggccgtagttattacattcgacagttccgggatatgaaagaatcaattaatgttaataaacttgactttgaaagttttcaattctactgccagacgtgcgcttatttgctagcgatggctcattttcaaagccccaccgcaccaatgatccgtggttatttaaagcatcagaagatattagatactcttttaccaaattgggctttaaagtatgtcgatcaagtcacagcagactatggacaattcaaattggcaatcgctaaaggaaaattaataaattaattataattaaaaaggacttgcattcatcgttttgcaagtccttctttaatactatttttcagacttttttcgctgatcacttccataacggtcttgttccttgattacactacttttacggcgatgcttattaataaaatcttgctcagcagcgaaaatcattaaaaagtcaataaaatttttactaaaattctttttaaatttgtcccatctatttttgatcattttatatacctcataaatatcattcatctttacttttattcattctagcatatctatttttgtgcaaacgattgtgtaattttaaaataaaattgtggtaaaatagaatttgtaaaagcgcttacttcaaggaggaaatattttatggaaatatctaaagtaccatttggaacctacaaagacgatccagtaacaaaatacattttaacgaacgataatggtgttcaagtaggaattcttgattttgccggtttacttcaatcttttaaggttccaacaaaagatggtggtaaggccgatatgattttgacctctgaaaacctcgacgaatttactaataatggcttttgtactaaccgcttaatcggccgggttgctggacgaattgcagatggtaagttcagtattaacggtaaagattaccaaattgaacaaaatgaaggtaaaaatgctcttcatggtggaactaatggtttttatagtcacatttggcatgttgatagcacgaaagcaactgatgattctgtttccatcactcttagtttaaccttaagtcctgaagttgatacataccctggtaagatgcatgtcactgcaacctataccttaactaatgacgacttcctttcacttaagatgtcggctacttctgatgcagatacgttgttcaaccctaccaaccacacatactggaatatggcagcagcaaatgttccaacggtggatcaattaaagctttatgtcaactccgaaaatcacttagccgttgatgatggcaagattccaaccggtgaaaaaatcgctaacgaaggaacaccatttgactttagtaccccaactacaatgggcgatgcattagaaaaaatgagttcaactaaggaaaatggctttgatgatatttgggaagttactcctagtctcacaaaaccagttgccacacttgaagatccagaaagtggtcggaagatgagtctttactccgatcgtaacggattagttatgtatacgatgaactcagatgatgcagcggtttacaatcacggacaagttcatccccatcttggtttagcaatggaagcgcagaatctttcagatgcgcctcaccatccagaatttggtgatattactttacatccgggagaagaaaaaacatacaccattaaatggcacgttgaatactaattaattactacgcaaaatgcatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagtttcccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctgatacccatgccgggcgcacataaaaaagagatcgacaaattgtcgatctctttttgtgtgttaggaattataaattaatttttgtcatctaggttatacttcccagcattttgaagatttcctttgccttttcaaggtagtggtgttctgcacagaataccttgatcttgccaccttgatcatcggtaagagctgctagcttttcatcaagttccttaaattccttattaaggtccttaataacgccttcttcatcttccatgtaaacatagtgattttctgctggatctttacgaccttcactagcacgttcttcaagctttactgagtccttatctactttccaagcatgcttaaggattgacttaatatccttaattgtttcgtgttgagcagtacggtgcttctcattgtcaacactatcttcaatctttattaagtgtccttcagcatctgcaatcttctttgcaatacgatccaaagccttaagttgacgttttgcgtaatcagccataaataattacctcctaatataatagctataattcctaattcacttttattatatttttataatttaaattataaaaataacgcgtcttaaaattatagttaattttattatgaggtaatttcagcgcctaaataaatagatgattgatagaaattctcctattcaatcatctatttattaaaaaaacatcgactttttagcaacgctttggcttgtacttactggaatattaaaatcaggcagtcctggaatatgcaactcaattgagccaacttgttgattcttctttatcggtgcagttagttgtttttgatcatctccctgcactcgtaatgttggtttagttgcttgtaatttcatattctttggaagccaaacggtagtcttctttgttagcttaatattagccttattcttatttttatcattctttacttttacactagtaagcttggccgaaagatcacttacttttttgatttcaactggctggtactcatcgactaatttattataaaagtcttgttgcatcttcgactggtcattccattccccttttgtatgcaaggcaactaaaataatccggcgtcctgcaaaggttcctgttgacacaatacatttacccgcgcgatcagtatttccagtctttaagccgtcaatttccccatccttaggagcaaaaccgttttgtggcaaaagagcattcacatttgtcattaaatattgttgatctttagttacatcaaagttagcaaacttttgctttgtaatgtcgagagtttcaggataattttcaacaagatactttgagataagcgcaacatctttagcagataataagttctctgcgtctttatctacgcccttaagtttatgctttcctaagtccccgttaggcagcccgatcatattgtagatttttatatctgtaactcctgcctttttcgcaaatgccatcatctttttattaaaggctgctgtactgcccgcgtcagctaatgccaatgcttctgtacttccatcagcagatacgagcatcatcgaatcaactaactgacggactgtgtattcttccccattcattaatgggacatttgaaaagtgccaatcatccgccatcttggcaactgctggtgtaatcttaatcttttgatcccattttaaatgatggtttcgaatatcttgtaaaattactcctaaagttaagattttaattacagatgcaattggatagcgtttagttgcatttttttggtatagaacctggccactttctgcatcaatcgcataagctgctcgtgcatccatctgaaaagctgcagtatcagcatggactttttcgaacatccccaagccatttaaacagatactaattattgccgttattaataataatttggcaaaaaaagatttaacctttttcattataacaatttctctcctttacacatttaactatcatatcctattctgcctaaaaaaggtgtaacgatttggtaacaattcaaatgaaatccttatttttcattaaattaagaagatgcaccttttaacttctataaattatctgtattattaataagtatgctaattttaatcagaaagggtcggttaaaaaatgcaaagatcgcaacgtcatcgtcgtaaaccgcgcagacttatcttaattatcatcgctattctgctcattattatgggtgtccggcacttcagctcgacaagtgcccgcctaaaatccgcatggaataaaatcattttcacttccaataataatgttagtattgcggtatactcaccaaagacccaccaaatttatacttctagtaatgtaccccagcataagtttcgaactgctagtacagtaaaggttagtattctagcgggaattcttgctaagcaacaaagtcctcttacaagtcatcagaaatcgcttgctactaaaatgattgaacaaagtgacaatgattcaactagcgaattatttgaagattatcttggcggaaaaaacggtctccaacaaacttttgaaaaatttggcatgacccaatctcaggctaatagcagttgggggttaactgttactactccaaaagatcaagttaaactattaaataatattttctataagtctaaagttttatctgatgacgaaagaagtgaaattcgtgatttaatgggtaatgttgaaagtgatcaagcgtgggggatctcagcaagtagcgataattttgcattaaaaaatggttggctaaattacggtaaagatgaatggatcgtcaatagtattggctacgtaaaaaatagtaacggaacagactacacaattgcagtttatacggataaaaatcaatcaatggccgcgggacaacaagcaattgaacaacttgctcgtgtaacaaagccaatattagactaaattgaaatgataaacaaaataggggctggaagaaaacttcaaattttcttccagccccatttttataggtagtttattgagagagataaagcgttttggaaaggaatactacctattttattttgagagagattactaattaatttgatgtctatttttgttccatcactttttcaccattagctgtaatagtgaaagtcttgttagcagcatcagcatcaagaacagccacattcttgccatccttatctttccgcgtaaccttgatagttgtttcagttggtgtttccacttcaattgaaccatcaagatcaaaggctgcaaatttattccgccatgcaagtaagtctaagagattcttaactactggacgttgaacttcttgtgcaacttcttctttagtgtagtagtgacggttgatgttccgaccttccttagtcttttcaagtaattcaaggtcatttgaaccagcaagtaaaccaacatagtaaaccattggaataccaggtgcaaatacttggaatgcacgagaaagcaagtaagctttgtcatcgtcacctaatgcagagtagtaagtagagttaatttggtaaatatccaagttgttgtattcagcacttgagtatttccgcttaacgttagcaccaaccttgtataattcattggatgcatattcgatttcatcatcagttaagatatccttagcatcaacaaccccaataccatcatgagtatcaagagtagtaaattgcttcattggtgacatctttaaccacttagcaaggcggttagtcttaccagagtaaagggtataaagagtagtcattggtaaggtaaagtcatagatgaagaagtcatgttgtgaaatcttttgtggaatggtgtagtgttcgtgaatttcgggaaggatgatggccttgtaaggagccaaaatatcttgaacttcatttaagagatcccagatttcaggttcaacgaagaaatcattagtaccaaccttcttaatagcgtaagcaaaggcatcaagacgaatcatatctgcaccgtgcttaaccatgtcaattaatgtttccttgaagaattcgttagctaccttactcttaacattaatatcaatttgttcttcaccgaaagtgttccataagttttcagtagtaccatcatcaaaggtaatttcttgcttaggagccttatcctttcgcttgtaaattaaatcaacatcttcttgagttggacggttcttaccagctttttcccagaacttttcccaacgaataaagaagtcgttgtacttagaatcatcgtgcttcttcttgaagtcttggtacatttcagacttcttggaaatatggttaatcatgaagtcaaacattaagtagtagtcttcacctaatgcttcaacatcatcccagttaccaaaagcagaatcaacaacatcgtaacggtatggtgcaaaaccacggtcaccagttgatgggaagaatggaagtaagtgaacaccgccgattgcatcaccgatatagttctttaatacttcatgagtttctttaatatttttacccattgagtcagagtaagtaattaacattgcttcatttttgattggcataatgatatcctccaataattttaaatttagttagcttgtttagaatgacgagttgcaaagaaaataattaaggcaataactattagcattaccccgtagattgggaatggtgcggcaagatcaaggccactcattgggcgaccgactaatcgattcatccattcagcaattgttggtgagaagaaagctccaaagttaaaaccaatcagtaccattgaagttactaatggttgacgcttagcaggagctaaatccggtaacaagttaaaaatcaacggagaaactaattgtagtgggaagccgattaaaagcaaaccaattactaacattgcaaagttgccgtttgcgaaggcaaataagaagtttgaaatggccattaacccgagaccaaggtaaacagtgttaaaacctaacgctttattaattgatccgtagaataaaccaccaagcgttgccccaattaacattaaggaaagaaacattgatgaaccagtatagctacttcctttaattgcaacggttaagccagggaaacgattttccattccaacataatctacaaccaagaggaaggcaaagagaacaaggaggtaaactactggactaatctttttaattggttcttccacttcagttaattcttcagcaagatcgtcttctgcaacgttattatcttgtgctttgctatcgtcaggaacacgaactgcaaagaagaaaagaacaacgaaagcaagaagataaacggcaaatgatgcatgccaacctgcataactaagaattaatccggcaattgcaagggtacaagcttgaccgatttgttcagccgcagcacgccaaccaagcatttgagctcgggttgtaccttcataccaaactgaaatcatcgaaattgcttgagagttatataaaccaaatcctgctcctaaaactaaccgggaaatcaaaatcgcagtgtagtcattcgcaaatataggaacaattccggcaagaccaacaattgtaaccccggccataataatctttttatcagaaatattgaaccattgttgaagtaatggtgaaaggacaacaaaaatcattacagcaaatgatggagttgtaactaaatattctgactgtgtctgtgagattccgagtgccgcctttaattgcggtaaagaaccttgaatggcataagcactcgtaaccatgaacgaaactgacaggaatgccaatttggtaacaagagaatttttgttattcataattagtagatactctttctataggtatttgacaaacgtttatcatttctgtacatcaataatatacaatgaacttttcaaaatgtcaaacgtttaacaaagatttattacaaaaaattgtaatcaattacattgttattataacgcgctttaaatgaaaatagatgaaaacggatgagaacgctattttagctcttttttgaacaacttgtgaacaactatacattatatttttataatttttttattaaaaaagagtaaagcaatgactaattcatcgttttactcttttttacttaatccacacaaagcttcttgattgcctgcgcatagatttccatcgctttatacatgtctggcaatggccactgttcattagcttgatgcatataatcgggagttgttggtaacattccgccaaaggcaacacaattattcatggttcgagcaaatgttgccccaccagaaatttgtggttcagcatcaacatccccagtttgttctttataaactttcatcaaagtttgcactaatttactgtcttttggaacgtacagaggggctaaataatcaaaatgaacatacttcaaatcataagctgccacctgtttacttagttttgctagtaaattatcgcgatcgatcgttacgggaatccgtaaatcaatctgcattcttgtttcattttcattaatctcaagactagaaatattgaaagttaattgtccagactcatcgcgaacatcaccgagaacattgctccccgttgcatcttccttaaataatttgccaataaaatcaagtggcttaaaatcaaaaacatcatcaagcgcaatcactaaccgtaaaacagcattcgttccttccggtgccatcatcgcatgaacagacttgccaataacagtaattgaattaccgtcacttgtatattcaaagccatgcttatctaaagccgccttcacttcatcctgctttggaccatcgtacactgcactatcagggaccgcattaaacgcatttttcaagttaatctttagttgatctgttcctggaccaacgagataagattgttgcaaccccttttcagcataaattaatggaaattcagcatcaggagaaattccactatcaattggcgcttcctttttattatattcagcaattccacgccatagaatttcttcatcagttccataaataaaacgaattcgttgattgaagtgataaccttgatccatcaatgctttaacagcatataaagctgcaattcctggacctttatcatcttgtgaccctcgtccataaactgcatcattgattactgtgcctttaaatggatcatgtttccatttgcctaaatcgccggcaggaaccgtatcaagatgacaaattacaccaaaaattttgtccccactaccaacttctgcatagccatagtacccgtctggatcttcataggtcttaaaacctaattcatcacaaatcttcatcatttcatcgagggcgttacgaattcctttgccaaatggtgcgccttcttctgctggttgattatatgatggaacagaaattagtcgttctaaagttttaacagcagctttttgttcatcttctgtaataattttatccattcaaatcccctcctagagcaaggcagcaattcctaagaacaagcaagtagcaacaaagagataaatcattaatttcagcatccacttccaccaaatgccgacattaatatgcgcaattgctaatgctcccataacaactcccgaagttggggtaataaggttaacccaacctgaagctgcttgataagcagtaataacaaggctaccagaaacatgcgcaaaatgtcccattggtccgataattcccatcgttgccgcagctaacccagacgttgatggaattaagaatgacattgggatatagaaaatgtaagtcaaaataataaagatcgtttgtgataatccatgaaggcccaattctccccagtgaagaactgttccagtgatcatcccattattcattattacttgaattccccgtgcaactgccacaataattgcaacgcttaagaaatctcccattcctgacatgaaagcatcaataaattcactttccttcatatggtaaacagccataatcaagaccgacataaagaggaagagcatggtaatttcattgaagtaccatgttccaagaggtgccatatcatgccctaataaatcgcctaggaatggaatattaaccaaccactttgtaaatttatcaaaaaatgtccaatggctattaaggtttgaccatggaattagtcctagaatcatcacaacaaaagtaattccgaatagccaaataactgtcttttgacgaccggtcattttatggtcgtcattaggatcagccttgactaaaaagtgcttttcatcttctgctcgttgattgtaaactaatgatttagttggatctttttcaattaccgatgcatagtggtaaacataaataatactaatcgttatcgtaataattaaaaggattacccgggaaactaaaccatcaccaggagaaatatttaacgtttgagaagctactcctgtggcaaacgggttaacagttgatgctaaacaaccaacttgacttcccactaaagcaatcgcaaccgctacaattgaatcaaagccaacacccatcatcacggggatcaagagaggagaggatagaatgcaatcgtttcttcccccattccatatgttgatccaccaagagcaaacagaagcattaaaattggaatcaattgtttttctcgtcccttataccggcgaacgattgaaccgatcccttcgtttaatgcatttgtcttattaaccactcctaggaatccaccgataacaagaataaatagtgatactgagatagctccatctgtctttttatcaccgaccatcccgataacgggtgccataaagatatcccaaattccctggggtttatttgtcaccgccttatatgtgccagaaataatatttccagctttatccgtctcatatgtccctgctggtataatccacgttaaaattgcaattaaaataataattaaaaataaaattgtaaacgcagagggcatatgaaaatgatgttttttcttcgtttgtgtttcctgcacaataaccgcctcttttgtaaaattagtatcaattttattttaattcagtttgaaagcggcttcaacttaatctaagaattatccttaaagaatgctataattgccttgtagtaattttaaggaggatgaagctaatggtaatgaatcctaataaagcacaagacgtttggaaagacgccggtgaacatgtccaatttactgtattagaattaaaacgagaaaatcaagcaaaggaacaagaagcaattcaagaatttgttgaacggttccaagcaattactcgatcactgcgaattcgggataataagggtaatcttaaagtttctttaggctttagcaacgacgcatgggactatcttttcccaaatgcccctaaacccaaagaattagaaacttaccaaacattaaccgggccaaaatacaaaatgcctgccgcaaaaggagatattttcctccatattcgtgcaaacgatgaggctgcagtttacgaattcatggctcaagtaatgctctttattagagatattactaatgttgttgatgaaacaaagggctttcgctattttgaaggccgggccattattggctttattgatggaactgaaaatccggaacctcaggatgctgctgaatacgcaattattggtgatgaggatcctacgtttgaaaatggttcatatgcctttgcacaaaaatggcggcataacatggacatttggaataagctaactactgaaacgcaagaaaaagctgttggacgaaagaagttttctgacttagaattaagcgaaaaagagaagtttaagaatgctcataatgtcgcttcccaagcggaaattgatggtattgaacagaagattgtacgcatgaatgttccatattcagaccctgccgctgataatactggaactttctttattggttattcacggcattggactgtaactaagaagatgcttgaaaatatgcttgagcaaaacgattatctcctaactttctctgatattttaggtggtcaactcttctttattccttcgcgtccaatgttggatcaaattgctgaaggcgaattaaattagttgattgacaagttgaaggcaaattgctatattattagcagcaaattttaggagggatcatccattgaaattttaattctacacaatttaatgtatctggaactgtggattcacgcagaaaggtactacgggtagaattatttttcaatgattgatcaataaatgagaactaatgggccaataccattagtttaaaagtctacctgtagtggtgggctttttttcgttaccttttctgcgagtaacgaaagggtgattttttaatggaaccaatcacgataaataatttaacttttgcttatccgggacaagaaccgctttttaatcattgtgatcttaatattagcagcgattggaaacttggtcttcttggacgaaacggtcggggcaaaaccacactactcaaaatcttgcaaaagcaactttcctttcaaggaagtattcaaaccaatcttaagtttaactattatccattagtaattcgtgaaccgaatgattacacaatgaatgtccttatgagaagtggctatcaaggtgagcaatggcaaatcgaacgagaattaaatttgatggcaactcccacagaattactatggcaacctttcagtagtcttagtggtggcgaacaaacacatgtgatgctagcaaccctttttgcccaggatggatatttccccctgcttgacgaaccgactaatcaccttgatcaggatggtcgaaaacaaattgctcaatatctaaaagcgaaaaaaaacggcttcattatcactagccatgaccgagattttctcgataaagtcattgaccattcattagtgattgaacaacaccagcttgttttaacccgtggtaattacagtgattatttcgttcataaggagcaacgagattctacggccatcaagaaaaacgaaaatttattaaaagatattcatcatttaaagcaaacacgtcaggcaaaatctcaatgggctcaacaagcagaaaatgaaaagaagaataattctcatgcggataaaggctttattggtgccaaagctgcaaaaatgatgaaaaaagcaaccataatgaaaggacgcttagacaccgcaatcgaggaacgaaaaggacttttaaaagagattgaaaatgttgttccgctaacaattaatgtcctccccactaatcatcaactattgttaagcattaatgatctaacgttatcgtatccaactaaacaactctgttctaatatcactgcaaccattgaaaaaaatgagcaggtcctgctctgtgggaataatggtactggaaaatctagtattattaatgcaatcatcgggacattcagtggtaagcaaagcggagatatactttttagcagtgcccttaaaatcagcacagtacgtcaagattattctgataatcatggaagtttacgtagttttgcatcttcttctaaaattaactacgatcaatttcttaaccttcttcgtaaattagggatggaacgtgctacttttaatgttccgattgaagaaatgagtatgggacaacaaaagaaggttgaactagcacggtcattagctgagcccgctcacctttatttatgggatgagccgctaaattatcttgatacctataatcagcaacaactaattcagttaattcaagaaaagcgaccaccaatgctaattgttgaacatgatcaaaatttcattaagcaaactgccacaaagaaaattgaaatttaatatttcctgggaaataatcaaatttaccaacttaatgtaaaaaaggagctgtgacacaagttaggtcacttccacaaaatacgaacagcgcagtacaacaatggccttcatcgtccggcaaagtcgaacgttgaaggcctattgttgcttgcgggggctcgaaaacgaagtcacgagtgacttctgtctcgctcccataatttttagctaaattaaattcaattcagttaaccactcaagaaatagtgggaaccactttcccatatgattatctacccgatcattattgacaataccagtatattcgttagctaatgcgattccatgtcccccagtgccaaactcatgtaattcatatggaacatcatacttgattaacgcatctgcatatacttggaggtgatcaacaaagggagttaattcatcttttgccgatccccacataaaggttggtggtgtttgtggatttaccaattccgctacattttctgttgtaacccccatgcgttcatcaatcaagggttgaataacaggatatcctaatgcggcaaatttagcgtgtgttagtttttcgttactatatgcagcggcaatttggcctcctgcagaaaagccaataattcccagtcgatcaacgtcaacatctaattcatttgcatggttaacaatatattcaaatgcttggtgaactgctattttggcttcttcataatttttatgttcaactactggataccgcacaacaaatgtttgccatgcatgggttgcaaacgttaatgccacccgctcagaatctcgttccataatcttgttataactgcctcctggcaaaataacaaggccgggtaaagttttatcagtattactatgataaatatctagagacgaatatggttgatctaagttaacacttttaatttccattttctcacctcattttgattttgctaaatgttaaaattacaaataatagtataacctcaatatgcaataaacgatacaggtaaaaaattgttattaattcacaaatttccccttgtttatcatgatacatttgttaaagtgataaggtatcaattattatttgggggttagaaaatctaatgagtattatgaagactaagtcattctggattgctgctattatgaccttaatttgttctgttgctggggtgcttttagcaaaactaccttatgtcaacctgattggagcattggttattgctttattattaggtattgccatgcagttgactcctgctagcttgcggaatgaggctcaaggcggcatcggatttatttctaacaaatttttacggcttggtattattcttcttggtttccgcttaaacctagaaaaacttgctgccgctggggttaagactattttggttgcggctattggggttaccggaacgattgtcctcacttattggcttagtcgaaagtttggtgcagaagatgaattagctatcctttctgcttgtggctgtggtatttgtggagcggctgctgtaatgggggtttcaccacaaattgaaactgacaacgaggagcgcaaacgagaaaatgaagtattagctgttgccgttgtttgtgtaatggggacagtctttactttagttgaaattggaatcaaaccattactcggacttaccgatccacagtttggaattgtggctggtggttcattacatgaaattgctcatgccgttgcagccgggggagcttttggtgaagcaagtttagataacgcccttattatgaaactttcacgggttcttctcttagcgccagtcgctttaattgttggttactggtatcaacaccgccttatagttgaaagtgaagaagaacatactaaagaaccaaagaaattaccaattccttggttccttggtggttttattttaactagtgtgttaggaacctttcttccattctcaccagcctttcttgatgcacttgttcaagcagcctatatctttttaggaatggcaatggctgcattaggtgtttcagtaaactttaaggttatttttaaacgtggaggggccgtttttggcgcggctgtgattagctcaacctgtttattggtatttatgattattatgagtaaaatattcttctaagttattaaaagcgttaaattgaggatttattttagtggcatatagccattccgccaatttaacgctttttatttatattttttatttatattcttctatttaaccgtctttcccagctggtaagcttcttcaacatgtttagctagtttttgattattccaagaatcagctgcgagcacctctcctactttatcccaacgcatatattcaagcaattgcttaaaatataagttaagtgaagcaaaggcatctgcttgaccataaccacttactaaagtaatagctttctttccgccgtgaagttcatggttatagctgtagaaacgatcaatcactgcttttagcgctgcattgatcccgtaataatatagcgaactaaccaagactaccatatctgccgctaacagcttaggcattacttcattagtaataacatcattcggttcaatcgcaacttcttgtccgggatgattgtcctccaatttaatcatcgaaaattcatcggtccggcgtccagcatcaaagcgataaacttcatttcctgcttcagttgcgcccttaacaaaggcatctgctaattgctcagaagttcctggatgatggggacttcctgttaatacaataatcttcatcatgatcccgtcctttcttatttaattatagtgatagttcgactaaattagaaatagaaacattgaatattaatagataactaaaatgaattaacgaggccaactaaagattttcaaccaatttaacttagtacgctctcgtttttgttcttccttaatgtatgaacgatccgtaatgaaatgaaagatattcatgcctattcctcataaatatgttcactaaggtagcgctcgcttgaatcaggaaataccgtgactaaattagccccgtgtggcaattctttagcaacttctaaacttgccgcaagcgcagccccactagagctaccaataaagaggccgagatttttagcaacccagcgaacataatagaatgcatcctcatcactgattgtttttaccccggtataatctaagtccttgaaaaacggtggaataaactccactccaattccttctgtacggtgactatgggctggacccccatttaaaatcgatccggctggttcaacaatatagccttttaattctgggtaagcatcttggagcgccttttgaattcccgcaaaagtgccaccacttcctgcaccagctacaaaggccgccagcggtttattagcaagatcagctaaaatttccggtcccaaggtgcgttgataaacatcagcattcgctggattctggaattgtaaaggcacgtaagcatccccgatttcagcagctaattctttggcggccgcaattgctcctttgatcccttcttcactcggagtattaatcacttcggctcccaacgcacgcattaatgtttgcttttcaaaactaaacttttctggtaccactaatttaactggtaaatggtattttagtgctgctaaagcgactccaatccctgtatttccggcagttggctcgatgattgtcgttgtatcttttatttttccttcttccattcctcgctggattagcgccatccccaaacgatccttgatactgccacctgggttaaacatttcgagcttagcataaatattaacgtcattcggagtcttcatcggcaagtgcattaagggggtgtgaccaatcaaatcataagtattttcaactaacataatagttccttcttcctcagaaaagtaagtgggaattaacctcctcgacaaggcggtgggctaaggatagaacggtgattagcacggcacgggctgattatcgttcgaacttagcctcgagccttgtggttaatttccacgatatcgtaacaatatacctataaaaaacgaggctgttgaaaaaacaaaagttttttctcagcctcgccttatgtgttatcaacttgatagtaattcaattaaaaatgagtataccaaaaagtgagtcgcataagacgcgattcacaacaacaaatatttgcgttaacaaaataattgttttccattggtaatttcctcgtatttcaaattacagtaataataactagttaaaagtaagttgtcaagaaaatttacatagacaggtgtaaaataaaaaagaatcattttataaaacaggagcgctacacatgaaaaagaacggactattattagtcaatctcggttcacccgatacgccaacaactcccgacgttaagcgttatttgaaagaatttctcagcgatcggaatgttatcgaaatgccaccagcactatggcaaccactccttcgcggaattattcttccaactcggtcatggcgatcagcgactttttatcgtaattgttggacaaaagatgggtccccattgattgtctacacagaacggttggttgctaaggtccagaaattgatgccggagtggattgtcaaaatggcaatgacctatggcaagcctaaaattagtgacacaattgtcgaaatgaaaaaggaatgtcaaaatattacggttctccctctcttcccttttttcactaaaagcacaacccaaacgatcattgagaaggtaaaggatgctgatccagaagcgaaaataattgatcgtttctcggcagaagaagattatttagacttattggctaagcaaatccaaacggcatgggataaagggaaatatgacaaattactcatttcgtatcatggaattccgacagccatggttaatcatggtgatccttatcgtgatgaaacagaagcggccaccgcggaactgattaaacggctggacattcccgaaaagcaaattaagatggcttaccaatctaagtttggcccaatgccatggttaaaaccttacctccggaatacgctgcttaatgaggcacaactcggtcatcgtgatgtgttagtcgttgctccatcatttgtagcggactgtttagaaacattagaagaagatcaagtacaaaactatcaggtctttcgtgaaaacggcggaaataaccttgtaatggtgccttcgctcaatgactcaccagaatttgctcagtttattactgatcttgtgcaacgaaagggataaaaatggaacgaaaaagtttagacgaaatcaatgggagtgttgatgtaccaaatgtctatcaaagtgcattttggcagaaatttctcgcttatagtggtcccggtgctttagtcgccgttggttatatggatccaggtaattggttaacgtcgcttgccggtgggagccaatatcgctatcagctattagtggtcctttttactgccattttaatcgctatgtatatgcaatctttagcaatcaaactcggcgttaccacccgaaccgacctcgcccaagcaattgcgcggcgtttacctactcccctgcggattgccctgtggttatttaatgaaatagcgatgatggcaacggacttaaccggagtcgttggaactgctgtcgccttaaacatgttattcaagttgcccttacttatcggcgtcctgctaacaattgcggacgtgctagttgtcttatttttccttcattttgggatccgccgaattgaatttatcgttttaactgctattctggttgtcggcgccatctttgcgattgaagtctgtcgggcccaccctgaattttccgcgatcatggacggttttgttcctcgttccacaatttttactaatcacagtgagttgctaattagtttagggattgtcggcgccacgattatgccccataatatttatcttcattcctccctggcgcaaagtcgacgctacgatgaacatgatccagagcaagtcaaagaaacgctccgttttgctaattgggattcattaattcacctttttgcagccttcatcgtcaacgcccttctgcttgtactaggcggaaccctcttctttcatgcggcaagtctcggtagtcttgaggatgtctttttcgggctaaagaatccccatatcgttggtgctctagcaagcccattaatgagttggctctttgcctttgctcttttggtaactggtttaatctcctccatcactagtaccttggctggacaaattgtcatggaaggatttatcaatattcgcctcccactctggaaaaggcgtctccttactcgagccgtaacccttgtgccaatcctaattatcggcttcatgattaattttaacgaagagcaatttgagcaactcatcatttatgcgcaaatcgtcctcagtatcgccttgccatttacgctctatccccttgttgctttgacaggcaataagaaactgatgggaccacacgttaattcaccatggcaaaccgtccttggatatgttttggctagtttggttactgggttgaacttgttggtgttggtataatttttatttattataaatccaatagatagatacccttattttcaattatcagtgtttaaaaaactaatcaaatattgtaagataataataaattttgttgtaatttttgatgcaataaaagactggtcactatttacttttgggatagtaatttgatattaaaaatattttatctttggtgtgacgcttttatcaatctcattttacaactgaattaaagaagcagggctgaacgatatttatgttcaaaccctgcttctttattttagtttcgtcgtgcaatcatcacgcgctgtccacctatttgtttaactttaatgtctttaaaacgataatattccagtagttgacgatagcgttgtacagtagtagcagtaatcactatggttcccttaaaagcgaggacccttatcgcctcttgcaaaacacgtccttgcgtaattgccggttttacctgctgtaaattactaatcagaacatagtcaaactgatgatcagtgaaaggcaaattagtgttatcagtcaattctactttcgcgcgatcagctactgcctcttctttgatcagttctttcacttgctgtgcttgcttttcatttttaactattcccataattttgccgggagcagtcaattgcttggcaaggttagtaaacgtttttccattaccaatgctcatatcaaggatttgaacatccccgcgtatcgataaatcagcacttatctttttccagacctgttgcctttgccagatcaaccatccaataattccaacaactataacaattacgatcccaataacgactatcaattctcttcacccattattttaactaacaatatcgtttagcttccgaatatcctttaactgcccaacaactgtgattttatcgtgcggttgaataacatcattagcttgtggcatttgattaacttcatcatccttactaacaatgataatcacattgacattataacgattacgaaaattcagttcgtctaaggtcttattaaagaactttggattattaatatttacttctgccaaagttatttccttactcaaggtgacataatcaacgacgcttggatttagttgttgaaaaataagccgcttagctaaatcatgctctggacgaacaaccatatcagcgccaattcgttccaaaacgcgcgcatgattaacattttcagcccgacagattacatctggtgccccgagttctttagcaattagcgtggccatgatacttgcttcaacattttttccgattgaaatatacacatgatcaaaactaccgatatcaaggtcacacagagcatcctcatcttgcgcgtccgcaattaccgcccgcataactgaccccgcgaattcatttaccacttcttcactagaatcaatcgccaatacttcttgaccagcctgaactaaagcttcacatatcgaggccccaaattgcccaattccaataacagcataactttcttttttagccaattaacacactctcctctggataacgataattcttcgctgctgtacttgcatttaggattgagaacattacagtataaattcctacccggcccacaaacattaaaaacattataataaattgacctaataaattaaggtgggttgtaattcccaacgatattccagttgtcccaaaggctgccactgcctcaaaagtaacatacgccaacgaatcatgttttggcaaatcctgtgtttcaacaagcaacaaaattgatacaagcaaaataaataaagcaacaaatagtaatgtcaaagcacgataaatattttcttgggtaaaccggcgatgagcaaatgtcgtgtctcgctgcccacgcaaagttgcaaaactctgaatcgttaatagaccgattgttgtggttttaaccccaccagcagttgaccccggcgttcctccgataaacatcaaaataaccgtaaacgcgaggccggcagcacttaaatcagtataaggaaaagtaattaaaccggcagttcgtggcgtgattgccataaaaatagtattgagaatacggttggaaaaacttaacttatcacttaattgtgctaagtttttctcggtaataaagtaaacaaccacagaaacaacgaataaaactgctccagtacgtaacgctaactgagtatgcaaggatagccggtgatatttaggataattgagaatatctttccatactaaaaatcctaatgatccggcaacaatcaaaacagcaagcacacatagcatataagggtcattagcataatttgccatactattatcaaacaagtcaaagccggcattacaaaaggctgagattgaatgaaaaatactaaaccatattcccttaccgagtccgtaacacggataaaaatcaaaaaataaaaatattccacccgctaattggataagtaatgaaagccgaataataaggtaaaccacgttcaattgggataagtggtcaagattaagggcttcttgagttaataatcgtgttgacattcgcattcgttgccggatcagtaacgacatcatgactgcaaacgtcataaaacctaagcctcccacttccatcaagattgcaatcacaatctggccaaataatgtccagtgatgagctgtactaacaagagttaatccagttacgcaggttgcactcgttgaagtgaagaaagcagtcataaaatttgtcgtttctcctggtcgtgttgcaaacggcaaggagagtaaaattgttcccataaaaataacaattaagaacccaaatgtaagaattttgggaaatgtatatttatgtttatttatttcaatcacttttatccttcctcatatcaatattactcaactaattataagcgtttttgttaaattctaaaccattattttatttcccgggaaatcatctcgagaaagcgctacaatataactgtagattacccgattgcttttcctgaaaggagatccttttatgtactattcaaacggaaattatgaagcatttgctcgtccccgtaagccggcgggagtggataaaaaacatgcttacattgttggtgctggtttagcaggcctttctgcggctgtcttcttaattcgtgacgctcaaatgccaggcgaaagcatccatatttttgaagaattaccaatcgctggtggttcgctagatggtcaagatcgccctgatgttggatttgtcactcgtggcggacgagaaatggaaaaccactttgaatgtatgtgggatatgtatcgttcaattccatctctggaaatccctggtgcatcttatcttgatgaatattattggttagataaggatgatccaaatagttcaaattgtcgcttaacttataaacggggcaatgaggttcctactgacggcaagtatcttcttggaaagtcaactaaggaattaatgaaactaatccttacacctgaagaccagctcggcgatttaacgatcagtgattacttctctgaggactttttcaagagtaacttctggatttactggtcaaccatgtttgcttttgaaaagtggcattcgctagcagaaatgcggcgatacgcaatgcgatttatccaccacattgacggcttgcctgactttactgctcttaaatttaataagtacaaccagtatgaatcaatgactaaaccattgcttgcataccttaaagatcatggtgttaagtttgaatacgatacccaagtccaaaacgtcctggttgataccaagaatggtgaaaagcacgctaaaaagattattcttaagcaaggcggcgaagataaaaccatcaacttaactgacgatgatctggtatttgttactaatggttcaatcacggaaagttcaaattatgggagtcatcaccaggtagcacaaccaacccgagcccttggcggcagctggaaattatgggaaaaccttgctaaacaatcgccagcattcggtcacccggatgccttttgtaaaaacattcctaaccgcagttggttcatttctgcaactgctaccgttaagaatccacaaattgaaccatacattgaacgactaactaagcgtgaccttcatgatggaaaggtaaacactggtggaattatcaccgtcactgattctaattggatgatgagttggaccatccaccggcaacctcattttaagagtcaaaagccaaatgaaaccattgtgtggatttatggtctctattctgatacagaaggtaattacatcaagaaacgaattgttgattgtactggggaagaaattactaaagaatggctctaccatctcggtgttccagaagctttaattgacaatttagcaaaagaagagtcggttaataccgtccctgtttatatgccattcgttactagctactttatgccacgggtaaaaggcgatcgtcctgatgttattcctgaggggtccgctaacttagcctttattggtaactttgccgaatcgccaactcgggataccgtctttacaactgaatattcagtccggacggcaatggaagctgtttacagcctcctcaacgttgatcgcggggtaccagaagtctttaattcgatctatgatattcgcgaattaatgcgggcaatgtactatatgaacgataaaaagccgcttgaagaaatggacttgccaattccaaagattgttgagaaaccactgctcaagaaaatcaagaagaactggattggcgaattaatggaagaacaacatttactttaaaaaactaggggagtgaggcattaggtatctctacttttgtcccactcccttcaatttaatataaaggagtcttttttatgaccaatgaaacgattaagcaccaattaaaccatcgtacaattcgggcctttaagcccacaactctttcaacagaacaattgaatactctttactctgttgctagtcatacaccaaccagtatgtttatgtagcagatgtcaattatgcacattaccgatccagataaacgggccgtaatcagagaaattagtaagcaaccgtatgtcggcgcaaacggtgacctgttcattttgttagttgacctttatcgtaaccaacaaatacgacagcaaaagggcaaggatgatggccgtttacataccgctgatattttcttccaaggccttgatgatgcaatcatggctgcccaaaacatgattactgctgccgagagtatgggccttggcgttgttccccttggttcaatcaaaaatgatccgcaaaaaatcatcgaagtccttaacctccctaaaatgaccttcccagttttaggcttacaaatcggtatacctgaccaagaacctcaactaaagccccgcctgccattaaaatttatcgcatttgataatgactatccaaaagagatcaagctcagtgacttaagcgattatgatcaagaagttactacctactatgaccttcgtgatgccaaccgacgaattgattccttcaccaaccagattgcgggggctaaactcgatcgccactataccaagcgcgatgaaattatgaaggtgttacaccgacaaggtctttgcactgatgaaggaattgattagttcatcccctcaagagcagctaatgtcgttaaggtcgcatcataataatttttctctgttaagggtttactgaaaatgtgtttctggctagcaaacagattatcatacccttcattacgattgcagctaaccgcataaaaaatcggcgcactgaaactatttgattgatatttaaccaatcggtgaccgtttaatgaatagccagccgtaatataatactgttcactgaagaacctcatcattttatttaagactttctgagctcgtggatcattgctttttgccaacatcattggaacccgacaagcattcgcactatagtctccatcatattttccagcaaccgtattcggccccactggcttggtactccctggtcgagcccaggcaaagtcaggtactagtcctgttcggtgctgtttacttaatgcagtcagacggtcaagcatattatttttgatcatctgccaccttgaatcgtgagtacaatcgtataaatgatcaaaaactgtcggcattacatctgaagttcgcaataaataataaaacttagaatccttcgtaacccaatcacccactgttaacatgtgcgtggttgggttatattcatatttcataatatcagtggcaatctgttgctctagcttatgataataaggtgctttttgtggccaaacttttgcagcccggtgaagagccgcagcaatgtaaagatcaccatcagtcgcactattatgatcatcaacccattgaccttctttattataagactgacgccaggacattaagtaagttagctggtcatggtgttttccaacataatcgcgatgtgcaaggtaatagttaagtaacttatcaaagtcattttcacttgcccagcccttttcagcagcgcgagatactacttgcagcccgtagccttgtccttccgataatgcaacaggatgtttttggtcgttgctggtattaacatacgtttgcttattatttttgcggaccaaatatgtcccctgccaccgccgataagcttcgtattgaatatgttcaggattctttattcttacaaacgcgagcgttgcaatataaataactgcaacaacgagcgtaagaagccaaatatatactggacgtttcataactaatccccttattagtcagcaaaccgcttagtctttacccattttgtcccgtcacgccgtaatagtcgatcaagtgcaactgagattaccgcatgaatcgaaacaattataaataattgtgaataggtaaagtatgaagcaagcgctaaccagatttgcttattcgtcgcttgcccaaattgcgtagctgctgctgttgtaatttgtaaaatatacaagattatcattaataaccaattaaaaagcaaaagttgggcgattaggatgttactttccccgaatgtaaagggaatcattacctgtggattgaaaagatgaacaatccaaaaacctacgttcgctaaaaagattgcatcagaaagaacaattgccgcattaaaccagaaaaaagtacaggaataataaagagtttctaactttactcgccaattgctccggtcaaaaagatgcctaaaatttttcaagacaacctgataatttccttttgcccatcgtaaacgctggtagtaataatcatgcaggcgttttggctcctgttgaaaagcttccgaattataagctaacgcgattagttttccactttgcataatcttaaatgaaatatcagtatcttctgttaaggctccatttgcccagcctccgattgaacggacatatttactttgaatgataaagttagttcctgggatccggccaattttaaataaatgccaaattgcacagtgctggatccgttgggtaacaacaatttcttgattaatgcacttcgttaaaaagttttgctcggcattgcgtgtcttattccggccaaatgctgcaacgtaccgtgttggattttcgaggatttttcgtactaagaaatagagggcgtttttttccggcattgcatcggcatcgtaaacaccaatatattcaccatgagccattttaagggcatcgtttaagacaccggccttccctccgctaccatgacgttctatcacctttgcttttcttttctcatattttggaagctgtaacactgttcgggcccgttgagcagtttgatcattgcaattatccgcaaagattaataattcgaccttatctgctggatagtttaattcaaggattgcttgggtcgtctgcgcaataactactgcttcgttatgagcgggaacaacaatcgtaattaatggatatcgttttaatgggacaatatccacaatttttctactatgctcaagccaaaagtgaactgccccacctaatgtaatagatgacattaatagcgaactccaaattgagatcagggtcacaatcattacaaactcggtcattgctttttcctttccctttttacatttagtgttgtctgttcaacgcgaaaataaatcacccactgaagaaccgcaaatattaatgcctgaacaaaaaagatcatcgtaatcaccatcgccaaccaaaagaaaattcgtatcattatttctgaactcctcttagatactcaacgacaaggtctgtttccatatctcttttaatatgacgcattacactttccagattcttaaatgaagtcgcattaatatcatcaactttcaaatgtccccatttaaattgaggctttgaattattaatttgtaattcatcaagtcctgcacgtgtgctttggttctgataagcaaatgtaatatctggtaaatgatatgacaaaattaaaaaagtaccatcttctaaatagtacagggcttcagatggtaatcgtcgtcgttttaagactttcgcaatttgttgaagggcatagttataatcttgaggatgaaattgacgtatttgttgattatgaacccagtgaatcgctgtaacatcaatccataaatcagcaatctgttctttaataatgaattgaagttccttttcataaatcttattagcattataggccgtctgaagttttactatttgattatagtgggtcgcatagctttctatctccgcacgattgcggtcaagccagccccactcaccaataatgtaccgactgaaatacgccaaacttgcggtaattggaaaggcaaacagtaacattattttgattgaattatccattaccacataacctagcaataaaatggcactaccaatcgttgttaggccgattgcaagccaggttaaaataatatttggtactaagctccctaccattaagcccaaaatgatcataatcatcatggccgtcgtaataaaatgggcgtattgggatgcccaccacatcattaacacaattgcagtcaatattacacaaagcgcaataagccccgattctacaatatgtcgccgaatcataagaatgttctccctttcttcctataaattagcaactaatatcttagcacaccttttttagatttcactagtttaaaagcttggtaaataaggagttatgctttgtttgtaaaaataatttatcattttataacaagtaaattcccttgaaaaaattactcttttctatatttaaatttatagacattcatattagatatgttttatttttgtacgttgataagcaaaagcacaataattaaggtaaacaaaaaagcctgatttaactgtgcaggaaaaatcaggcttttaacttagtaaactcatcgatgaaacataacgttgctgatgttaattggataaagggatgcattgtttcaatgaagagtcttttatctaacttaaaaaacaagtggatttcttgtttgtaagtattatagcacacctattgtgaaaatgttaactaagatttaggatgattaaatatttttcgcaataatttcttatttatctactatttatcttattttccagcagtgattatcatcacaatatcacattatttctaattaaatttagaaataataaattaccttgtctgtctctgattaaaattctcctcggtattttatagataatatcattacttttatctaataattttcattatatctagttcattatattataatttagaaaaataaatatttttatgtgattggtgttaaaaaagctaagataagggtgataaataaattttgataaatttgtttaaaagaaatgaatttattattcctgatcacaccccatacggtcagcagcgatgattttatagctatttataaactactatttcattggattttatttatcaatttttatagaaaggagcagagttttttttactttgttagctaagtttaggggtatcatttgagttatttaatttactttatagctacttttcttcctttatcaaattgattaaattgcttggattcatatcactaatacttttaacctagtaattctcttttagcgtttctcattattcttagaagcttcttagaagcgctattgtttgatccaaaaatagaatattcattaatacgcaattacaaagcaatctctatatttaagctttctaatcaaaaagcaacctcagcgtcatcctttgacctcgagattgctttttatttgattactgatttccagttaatttccgacggactaacgttggatcagcctttcctggattcaattcgaccagtttccccgatccactgtaaataatccattctgctaagttaacaatatggtcgccagcgcgttctaaattccggataacggccaaatagctttcataggcttttacatcttcgccacctttaaccagtgctttcatgatttctttttgtaatttcacataaagtaaatcaactttcaagtcctcgttagcaacctcataggcaacctgctcatcagtatagacataagcatcaaggattcgttcaagcattttgcgaacaatcatcatcatctgttcaattggctgttcgatgtcttcatgatgttcaaatttacttaaggtaatcgcagcgcgggcaatatgggtcgaatagtctcctaatctttcgatatcagtactagcttttaagatactgataattttccgaaagtcggttgcaaccgggttttgtaatgccattagcttcaacgcctgtttttccaaatgaatttcttcatcgttaatctttgtatcagttgttaaaaccttatctgctaagtccgcatcatgatccgtaaatgcctttgttgcttgatagatctgctcactagcgtcaattcccatttccatgaagtggctccgcagccgttttaattcatcatcaaaaattgctcccatgttttcactcctaaccaaattttccgctaaggtaatccgccgtttgttgttgttgaggattcataaagatatctgtcgtctggttaaattcaattaattttccttggtgcataaaagctgtccagtctgctgaacgtgatgcttgctgcatattatgggtaaccataataatcgtaaatttctcttttaattgtactaaagtatcttcaatttgcgaagtcgaaactgggtcaagagcacttgttggttcatccatcaagataatttctggttgaactgccagcgtccgcgcgatacaaagtcgttgttgctgccctcctgataaggcgagcgcactttcttttaagtgatctttgacttcttcccacaaagcggcctgacgcaaactctcctctactcgttgatcaagaatttgccggtcctttactctggcaagccgtaatccataaataacattctcatagattgataaggggaacggtgttggttgctggaagaccatgccaatttgttgacgaatccggtaaacattaactttaggctggttaatattcaagtcatgaaaattaatttcacctttgaccgttgctaagtcatcgttcatccggttaagacttcgtaacaatgttgactttcctgaaccagaagccccaatcattgccgtaatcttattggccggaaatttcattgaaacatcatgaacaacgtgtttgtcaccatataatacttgtaaatttttcacttcaagagcaactgaattttccattcttttatcctcactttgcaagtcgttgcttaattaaataaccaatatatctagctaataggttaaagattaaaattgttagaatcaaaaccgctgctgaaccatttgaaacagcacgggcatctggaaccaatccctcactgttaactttccagatatggacagctaaagtttcggctggtcgtaatggatttaagaaactggtaggactaaatggattccaattggtatagctaattgccggtgaactctgcccggccgtgtagattaaggcagcagcttccccaaagatacggccagcacttaggatcgctccagtaataattcccggtaaagcagccggtaaaacaattttagttgttactcgccactttgacattcctaatcccaatccggcctgacgttgaagataaggaacttggcaaagggcgtcttcacatgcccgcgttaaaatcggcaagttcaaaattgttaatgctagtgcccccgcaagtaaggagaagtctaacccccattgcaaaacaaagactaagtaaccaaataatcccactactactgatggcaatgaactcaaaacttcaatcgccaagcgtaataagtttgtccaccgattatctggtgcatactcacttaagtaaatggcagcacacaatgctaaaggaatcgaaacgattaatgttaaaacaaccaggtaaagagaattaaataattgatcacgaattcccccaccacttctaaatgattcagcgcttgacgttaagaaatgccaagaaatatggggaattcctgatagtaataggtacgctaacaaggcaaataaaactaaccctactaaaccggttaaagttaaaataatcacggttgccaaccgatctactttttctggacgcattattttacccctttccggctaacgagccgcattaaaagattgaaggccaaggacattactaatagaattaaagctaaggaccagagtgcattgtttgagatcgtccccatgactgtgtttccaattccggtagtcaaaacactagtcaaggtggccgctgaatgcatcaatcccgttggcattaccgtcgtgtttccaattaccatttggactgctaaggcctcaccaaatgcccgggccatcccgaataccattgccgttaaaatcccgcttttagcactcggaataatcacccgcgaaatcgtctgccagcgagttgcccccagccctgcagacgcattgcgatattgtttaggaactgccctaaaactatcaattgtcatcgaggtcattgttggtaaaatcatcaaaaacaatacacaagtagcagcgagaatcccaaagccagtgccgccgaaaaagcgacgtaagaagggaacgattactgttaaaccgacatagccatatacgacggatggaattccgactaataattcaatggtcggttgaagaaacttatatgcggttgatggcaaaatctctgtgattgcaatagctactactaaggcaagcggcaaagcaattactcctgacaaaagagtaacgctaaaagaagtggcgatcatcggtaaggccccgaatacatgatcacttggccgccatttaattccacttagaaaatcccacaatgaatagtgattgccagtaaagagggcaattcctttccaagttaaaaagattaagatcgttgccactagtcccccaattaaagtaattgcaagataactaattactttccctgaggcttcctgcttactttcaaccgagggctgtgtcaaacgttgtcgtaagtcttccatcgtactatttcctttcagttactttcccagttggtgttttttcaactttcatatcatgaatgctaatatagtgagcttctgttacaagcgtcttttgaactttctcgctttgcatatacttaatgaaatttgcagttgattgggatggctgtttttgcgtatacatgtgctcatatgaccataatggccacttattagtcgtaatgttatcagcagttggtgctactccatcaaggttaactgactgaacttggtcattaagataagcaaatgcaatatagctgattgcccctggtgtatttctaataatttctttgactgtcccgtttgaatcttgttcttgagcatttactgcctgcatccccggtttcaataccgtctgttcaaacgcaacccgggttccactcccatgagcacgattaataactgtaattggcaaatcaggtccgccaacttcttgccaattcttaatttgaccagtaaaaatttgttgaagctgtttcattgttaaattcttaatgccaagttcttcattaacaattggtactattcccgaaacagcaacaatattatcatctaatttattggcattaattccatcttgctggtcagcaaagatatcagcagatccgatatttactgctcctgcttgtacctgactaaggccggttcctgaacccccaccctgtacaataatgctggtttggggatgcttagtccggtaatcatttgcaactgcttcagctaatggttgaagagctgttgagccgacaatggtaattttttcttgtgatggttgttgcttagcgagtacccatgacccacctaaccaacagactattgcgacgataacaaccccgataatcgtttttttcattactattcctacctgtttattagttgttttcatatatttcgtatggtacaaatagagaatagcaagtcgatgtaaatttttaatctttgtaatgtaaaggttatgtaaattttggagaaagtattatgaccaataaatttttgctaatgagccagcaagacgatctcgtccaccagttacaagctatttgtaaaaaagaacactggacctatgagctcgtgactactccgactgggttagtagtagccttagaaaaaaatcaaattagcggaatttggtgggatatgacggaagtaagcttagacaccacgattgctaccatgacccttattcggtcgcaagtccaaggaccgattaccgtttttactcctcgctttacggaacacattcaacgaaaattataccgggcacatgttgatgatgtaattgcattccctctcctccccagtattttccgctccttaattcagcagcgcttgtggacttaccactatccacagatgcattcattagctgatgataatacaaccaaaaatgacccagtaataactactggatcatgggaaattaatcaagaaacctatactgttactaaaaatgataaaacaattgctttaacacccaaggaatttcaattactttcttacttagttgatcataaaggacaggtattaaatcgggatcaactcgttaatggagtttggggatatgatattcttgatacttcacggatcgttgacattcatatcagtcacctccgcgataaacttgaagatgactcccaacaccctactcaccttctcacagtacggggatttggctataaatttgtttaaaatacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgataataaaaaatgagcgcggctggaaaaaaactcctagtccaaaataaaaaccggatgatgaattttttgaacaattcatcatccggtttttatgtacacaggaaatcgttcctgatatgatgtaattatccctaaaaacaaccaaagggagcgagttccatgtatccaaattataccatagggcaaaccgaattctcactaaactataactatgatttaccacaaaatcatgttgcacgattaattagtgattttgtcgactcgattccacaagatgtgctattagaagattcagtagcggctaccggccgccccttcatcgcatccagcaattatgcttaagattctcttgtttgcctacgcacgccaaacttattctggaagaaagattgaaatgatgttggatgagaacctaccaatgcgttggttagcttatgattatacttatagctaccataccatcaataactttcgccgcagtcagcacgccagtaagctaattaaacatgcctttgtctactttaccatggttttgaaagatcacagactaattcaaaacgatgcggtttttatcgatgggaccaaggtagaagccgatgccaataaatattcatttacttggcgacgggcagttgaaaagtatcacgctaagttaagagaaaagacaagtaagctttatgaggaactagtagaaaagcaagtggtgcaagaaatggcaccggagctggttacttccgccgaaggcatggacgtaatggaacaagaactggcggagaaaatcactaagctagatggagagattaagcaagaaccaaaaatcatcaaaggtggttcagtgagaaaacggcgccgtcgttttctaaaaaagcttcgtcaccaattaagcaacgacctaattccgcgtgccaaaaagtatgaacgtgccgaaaatatcttccaaggtcgtaatagctattccaaaactgaccacgatgcgaccttcatgtgtatgaaggaagatccaatgatgaatcgggagttgaagcccggctataacctgcaaatcgctacccataagcaatttgtccttgattacgggctgttttcaaatccaactgacaccaggaccttagtgccattccttacccagtttcatgctttagatttctttgaacatatcgtcgccgatgcaggctatggtagtgagtacaattacacaatgattcttgatcggtttgaaaagtagccggttatcccatacacaacctatcaaaaggaccagaaacgtaagtttaaaaatgatccaactaggtcacagaattgggaatataacgctaatgacgactactacattgatcatcaaggagttcgttttagtttttattgctacagtaaatccactgatgagtatggctttaagcgtgactttaaactgataaacatcaactatcagttaaattagatgagctagcgaagacaccaggtggtcggcaacgctatatgaaggttaacccaacctggaattattataaagctaaagttaaagataccctctcaagtgacgaaggaaaggcaatttatcgtcgacggatgtccgacgttgagccggtctttggtcacatgaagagggattttggcataccccgaactcatctcagtggacaacgggctgtggaaaatgatatcgggctagccctgatggcattaaatctaacgaaatttggccaatcaattagtcgattgaagactaatttcataactaatttaaaatccgaactacgatttttggatcgatcaaaaatcatagtccggattttattgttagagaaccaagaattaatagttaattcccagcctcgttttattagtgtaatcaatttaatttatctttcatccgtgtgaattttagtaaaactaaatatactgttcaaccatgtttcgatactttaatagttctttttgccccatggaagaatcgggggagaacgacttgaacgctattgttgccaccattttcatccatttgctgacgtccccatacccctaatgacataatgagacgggcaatttcttgaccacctgtcgtgagaacaaaacaaccagcttctttaatcggactgattaagtatttggtttgtaattcctcaattatggttatcgattgattatcagaaatattagtcaataattcgtgtaaatcatcaaagtccagcggttttattcctagccaaaaaagaactttagagtaatcagcattacgcaaaaagcttaaagaataagtaattccatgattagcttcttgattcatcattaacccactcccgcgtacaaaatattgtaatattcatcacaaattataacatgaggaaaaagcaatctcaaaataaccccctatttatttatcagattattaatcttaaagacacttttataaataaagtcaatttatacaatgaaatcgctatcaataacattatattgtatatttactttttagtaaaatttgtgcctcttttattccaaagaaatgtgatttaggactactcatcttatgagcgatcaatatttgttgcgcttgttcacactgtacttttgctaactcatttggctggaatatttgcagatagaatgataattgccgtaatttaatcgctaactggctccgcgccttcgtcaaagtcacatccttaaactgcttataatcatgaatcatgaaacgagttttccggcgctgtaaagcatagttaattgaattgctcttaatccggtgaagatcttgaactgtgaggccgtgttgacgaagaagataattaaacatcgtaatctgctggtcgacttgtcgccaatccgttgcaatatcatctcgtaattgtgtaatctcttctttggtaagacggtgggtaactccttgttttaattggtgatataaggtttgcagatcttgataatcgcgttggtggagtggaaggtcaacctgactaaataagttgcatcgctggtaaaggatcgtcccttcgtggttcttaaatccctgctgggcaacaacaaactggaatatcttttttggaaaacgccgaccagcttgataagccaacagaatactatccatatacaggttaatttcattaatgcctgcctggatctccctagcaactttgtggggaatgcttgcatgctgctggaagtgagagatgcctaaaaatagttgccgaccagttgtccgtgaacgtaagataaattgattctttaaacgccgaccacaatcacaatagaggttgtcgccaggatgatcatgttgtcgctgataccaaggatcaattaccattccctgaaactcccaatcagtctgtttaagatagtgatgagtatgaaaacgcgatagcatcgcataacgcgtaaattcactcaatgcctgaacctggtctggccttaactgttgtaaaatatcttctcgctgttgacgggtcaacgcaatgattttgtccatcctctcattcctcccattaaaaatactgtattactatatcagaacaaatgtttgatttcaaattgtctatttaatccctttctggtaaaacatttaattacaaggagtgatattatttggatttagacatacagcccgtgaggttgagtttaaaagaatataaacaagttaaacaattatatatgcgcgcatttccgaaatatgagcgagaaccgtggacgtggctgctcatcaagagtaagtatcaacgcgctgactttatggccttttatgaccaggaacagtttgttggatttgcttacgttattcacagtcacggtatgcattatattttgtatctcgcagttaatgatcaaatccgttctcaaggatacgggacacggattattaatgaacttcgtcgcctttaccctgaggattcgctggctctggacgttgagcagcctaatcctcaagcggcaaataaccaacagcggttacgacgacttaaattttatcggcgcaatggctttttcccaactccaaagcttttcaaagaggaaaaagtcacttttcaagttttagcaaccaataaaaaaatcaaccaacgaaagattgataaggcctttgagtggttctcatggccgcttggttggctgattcaataaagattttgattttactagtttgaggctgttgaaaaagcttttttgctttttcagcagccttttttactgtcaagaaaataaggtttacaaaagtgttacaatttatgtaagcggatacataaagaagtgataacattggtagaaccattatttttaaagccagtctttcatgagaaaatttggggtggtcgacaccttgcaactgatttcggttaccaaatccagcgggaacaattggggagtactgggcaatttctggccatcctcatgggccaaatatcatcaccaatagtcaatacaaaggccaactattgccaaaagtttatcagcaacatcctgagctgtttggtaatccacgctcttctgtttttccattattaacaaagattcttgatgctaatgctagtctatcaattcaagttcatcccgacgatgcttacgccgaagaacatgagcacgaactaggtaaaacagagtgttggtatgtcattcatgcagaacctggagcttatttaacatacggccataccgcaaaaacgcgcgatgagcttattaagatgatcgataatcaccaatggtcaaaactttttagtagaaagccagtaaaaacaggggactttgtctatgtgccaagcggaactatccatgccttaaataaaggaattatcgtcttagaaacccagcaaagttctgataccacttatcggatctatgactatgaccgtcgagataaaaaacaggtcagctacgccagcttcatttaaaacaagcaaaagacgtgacaacagtgccatttactgagccacaaattaacccccgcatcgtccataatgatagttcaataattactactttaatttctcaacctgactcaccattctttaccgtctacaagtgggagatcaatgattaaaccagcttgacctggtaaagaaattgggcgctactgaaacaattaataacacggctgaagatcccgtcaaagcaattaaggaaatcgttccgcgtggtgtaacttatgcaatcgatactaccggaaacaccggtgtaattaagtcagcaattgatagtcttgccaccgctggagaatgtgtcctcttaggagtttgcggcgatattaccttaaacttaatgaatgatatcttatcagaatctaagaaaatctctggggttgtcgaaggagatagcaatccccaagagtttattcctcaactagttaagtactacaagcaaggcaagttcccccttgataagcttgttaagtactacgattttgctgatattaaccaagttatcgctgactcaacaaacggaaaggttattaagccaatcatcaaaattgatcctgaattagctaaataattaggtgaagtgtttttatgaaagtaatttttgtttgccttggtaatatttgccgctcaccaatggcggaagcaatgttcaaaaaaatggttgcagaagctggccttgctgatcaaattactattggttcagccggaacaagtaacattgcagaaggttcacctgctgatagtcgaacaaaagccattctcgataaatatcacattaaagacgacggaatgattgcccgtcaattgcaggacagggattattatgatgccgattatattatcgcaatggatcagatgaatgtccgggacgcaaaagatatggcaccagctgggttagaaaataaggttcatggaatctttaaagctaccccaggaaaagaaaattgctatatcgttgacccctggatcactcaccgattccaagatacctatgatagcttaagtgaagctctccccaattggcttgctaagctaaagaaggaaattaaataactgtttatcaaaaaacacgcctgaaaatttcagccgtgttttttctttttattggtaattaagatcgtcaaacttcttatcagcgttttgttgtgccatatcctttgattggtagtaaacagcatctacccaatttccggcacccccggctgatacaagaactttaacctgctttccatcgattgtttcggtcttaacagtatatgatgaaccgtcaccggcattttgaacccaaccacggatatttaaccatcgtgatccatccatgttaaagaaactggctttcccccagttcttagtagcgttttggattccttcgttagtatagttatcctcgtcttcaccccactcagaatcctgtttaaagagttgagttgttgtactgctattctcaccactgtaggtaaaggtatgaggaccaaatgttattgttgaatcagcatcattatctgccgaataccatgttccctgcatttcacttggaacatcaatagtaccactgcggccatacttatgatcattgccagaattactggtgcttgctgaggaattgctatccccactgcgcttatcgactacctgtgccttagcagctaagtcattaacgagctttccctgaccttcttgattaacataattggccatttctgactttgagattgtggcgagtttagtactcttttgattttccttgacattttggtagatgtttacatcatcgttattaacagtgtaaaccaagccctgtgactttccaccagcagtcacatcgtaagctactccttgtcctccatcactcaattggtatttagaacttgggtaaagatttacctgcaatccctctttttgcgcttctttagccatggcagcccaattcccaccataacgaaggccacaatacgtactaatcaaactaacagcttcttgggggctcatgttatcactattaactttcacattacttttagccactaataaactactgcttgaggcagatgaagaattagccgctttattgttagcctgatttccacaaccagctaataataggcccatccccgtaaccattaaaaatcctatttttttattcatattaatatactcctataaaaaaatgaggctggagaaaatttttgttttctccagcctcaactgtttttatgaacaatagtaagataacatggaaaataaccacaaggctcaagtcttagtacggacgataatcgccgtcttagcttagtccaccgccttgtcgagggggttatttcccacttgcatatttaactaagcccgtgacttgtagctaccatcagtagtgttgatgattaacttgtcaccattcttgataaatgcaggaacgttaacaactaaaccagtttccatcgtagcaggcttaccaccaccatcgatagtagcacccttaatcattggttcagtttcagcaacagttaattcaacagtagttggtaattcaacaccaatgatgtcgccgttaacaaagtttaagataaccttcatgttttcaacaaggtagttcttgtcgtcaccaagcaagtcatggtttaaactgtattgttcgtagctttcaaggtccataaatacggctgagtcaccttcatcataaaggtattgagcagaacgcttgtcaacgttaacttgttcaaccttttcagatggacgcatagtagtatggacaattgaacctgaacggaggtcttggatgtccatttgcattaaagtgttacccttaccaggcttgtggtggttgatttgaagaacctttaataacttaccgtcacgttcaaaaaccataccttttttcaaatcaattgtttgaatcatagtataaaaactccttcatataaaactgaactcttttaccgattaatgggactttgctttaaagcaagccttaatctttggcttcgttccgtgccgttaatcatagatagttaccatctataatttacattcactgtctattgtatcacattccctaatcacaacaatagcagttgttaggatgttttatcaataaaaaactgtctgcctatttcataattttcaatagacaaacagcttttttctttgatcgatacttctaaaccagctcaagatgtaattgcttttcaccgatgaatccagcgcgcttaagaacaaggtaaagagcaattgaaagaacagcgggtgctaccacgccgaaaaccatgtatgtgctgaactgagcccagccgcgtgataagtaagcaattggtgcaatcaaggagtttagtcccaatcctcctaaggtcgatgttgaacggaaatcaaacagaactgttgcaattggtgcacaaacagctgctgaaacaaccgttggaactaaaagataaggattgatgaggagattgggaaattgaactttaggggtaacaagtccttgggcgatatttgcgccaaggttattttgccgaaatgacatcgcagtaaaaccaacaaattgagcagtagtaccgatcaaggcagccgccgaagagatcggatcaagcatcaacgcaacggccaaggctgcagaagaggcaggcgtcatcagaaatagggcccacacaacggaaattaccattgatcctaaaactggtgaaacttgcatcgaatgcgcaatgtaggcggacacagcaagaagcgccggcgtaacaactgccgcaacgactagaccaaaaccgatccccacggctaacgcaccaaatggaacaagaaccatatcaagtggcgtctttccagttaaatacttaccgacaagaacagcaacaagtgccgctagaacagcagaaacaggttggccagtagtaagaaccggtgctcccgctgccgccgcagttacttgccctgttgcagtcattcctttaaccgccgtatcagtaaaatgaacaccatttgatccaacggtagccgctaccattgatgcaaatgtaactaatgtatttgtgttcatctgtgaagcaaccgcaaccccaatagcaggcgctaataatgcttgagcctcaccaccaattagggtaaggacatggatacctgtcaagttaccaattgtttgagttaataatcctcctcctagaacgaccaaaatagcattagccaccgccgcaaaaattcgataggccacttccttgacctttgatgaattttgataagttgcattagctttagaattgctaactcgattttccatcattaacgcctccttataatttgtttttgtttaatgattgttgttagtttatcggagcgaaaattaaaagtcaattatatttctcatttatttttaatttaaatcaagaaattgtttttattaaattctttacgatcgtcacatttaaagtaagcgcttttgtaaatgaattcttaagaaatcataaccacccgtcaaacgggtggcttgcacataggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatgcttctttatcgtggattcattcaatccaactgtacttatatagtagcattcagcccaaaaatgtcggttcccatatttatattttaagtttgcatgtcgatcaaacatcattaatgcacttttctcttttaagtatcccataaactactagacacttagcttcggcggaatacttactaacaagtgcacatgatctggcatcatatgaccttcaattatttctactctcttatatttgcacaataaacgaatataatctcttaggtctcttcagtattgattgaagatcgctttacgtctatactttggtatgaatacgatgtgatacttacataaccacttcgtataggctaagctatttaatttattagccatatttatataacctcttttcccttattgactttggcttgaacacctacatcttaaggcaaaagaggccttttttatataatttttatctcccacccgcatagcaggtggttttttgtttcgtgcactcgctctgctcgcgcactcaactaggtctaaagacattaataatcatagccaccatttgtggtagtagtggctgttgttgcaacaatcttattttcttgaattgcttcattggcaggggtgtcagcagtatttacattgaaagtaagaaaagcatttttattttcttcttcactattagttttatttacagaagaagcggaacttgaattttcagtagcctgagcagttgtagtcttttgttcactggttctagaagtgtcagtagtattagctacaatatttatcttcgtttcagcagtatctagggcagtctcatcccctgaattttgcggttgcgccgattcagctacaataccacctgcttgcgttgttgctggggtagtcgtatctgcttggacactagcatttactaccccagttggcccaaaagccaacataaaagtagcacaggcagtaatccactgtttcttcgccttatatagtttctaattcttatttttgggagtcatactccgtaaaggattatttttacccataagatctcccccgtctcttaatcatttatccatctataattataatccaatacaagttcttttaaattaattttttatcatcctattaatttaaaggtcaacaaaatttatccttggcattgttaagagcaaaattaataaaaaaacgaatggtcgctttacgcttaatcccatccgctaccacaatacattagtcattgcttttcgttgtttctttcggttgcttctttgcaaataagtgatacacgagtcgggcaaccagtgcttgtaaaacaatcgttactacgctttgtgcaagttttcttacccatttcataattttagctcccttacttaaatcatgccttgtagttaaacctaatcttctattactttaattatactcgtttcttattaatttgtttaatagaagtctttatcttaagattagataaaattattaattttcataataatcttcaattcatcaatataaacgcacaaaaagccctttttattcgataattgagaataaaaagggcttaaaattaccacaatgttgtcttttggctaattataattttattattaattttctagataatttaatggcttatcaacattcacctttgttccttgatactttttagcaatccattgttgaatttgcttattatggtaaagcttgactaacttcttatattctttattatcacggttcttcttagcagttgctaaaacattaatgttatccttcgtgctttgatcaactttttcgtgataaatagaatctttcaacacatttaaatgaccagttaaagcaatcgtattaccgattaatactaaatcagttgactttaatactcgtggtccggtggtatcatcaatttctttaaattgaaggttctttggattagccgcaatctcattggttccacttgttgccccaaagcccggcttcaattttatcaagcctgcactttgtaagagcaagagaccacgcgccgtgtttgctgggttattagcgatcgcaactgtggcaccatctggaatgtctttaacactcttatacttatctgaatataagcccattggttctaaataggtagttccaatcgccgctaattgtgctttcttattttccttattataagcttgcagatatgaccatgattggaaagcatttacgtcaatttcaccactagcagtcgctcggtttaaagctacgggatcagtaaagctcttgaccttaatcttcaaaccttcacttttggcctgtttactatttgcaatgtgttgccaaacctggacatctgggccaatcgttccaacagtaatctcatcgttgcgggtaaacccaccattagcgcccacactaagtccagctgcaactaaaatcactactacaataccaacaatccaccagccggtacgctttttctttctcatcataactacccctttacttttgttttcgctattcgtcataactagtcgcaatagccaacgggatccgacatgtcgttattctcgagaaatccttagtcagcgtttaccaaaattattattagtcaaccacgtggcgttcaaatggcttatctgaaatcccttcatcaagaatcttctttgaccattccttagcagagaataatgaatgatcacggtagttaccgcaagattcaatcgttgttccctgaacatcttcccacttagtcttgtaggcaatttcttcaagtgaggacttcaaggccttggcaacttcagtagttgagtgttcaccccacgtaattaagtggaaaccagtccggcagccaaatggggaacaatcaatcacgccatccaaacggtcgcgaagcaaaccagcaagtaagtgttcaatcgtatgtaaaccagcagttggaattgcattttcatttggttggactaaccgtaaatcatagttgctaatcttatctccctttaccccttcttcaacggtaattaaacgaacgtaaggtgccttaacctttgtgtgatctaatgtaaaactttcaactttagccataataaatctctccttttctgcctgatgagaatgaatcttggaactaaaaaatccctaggaacggcaatccaaccaattcctagggacgtttaatattcattaacgtgataccaccctaatttagccttatctcacaataagacccgcaagaagtacataaaaatactccagcacggtaacgggtgctaatcgcttgctgctaacacgtatgctcacagcatcagtctgctccaagaccatcttcattattcgttaccatactggttctcatctttcctagctctctgtaatggcattaaataattactcatcttttctaagcaatttctaatttaattgtaattataatatccttatccttactaattgtcaacacctatttcaaaattattcatgatataacgttcttaacgttttagcatcatttttagttattccgtttttgatgtttcgtgggatcatcacactatgctcatattctggagcgtgagccaatccaagggcatgtcccagttcatgttgggcaacctcacttcgaaattctttattagtataatctaactgattagggtccaaagttaaagttgccttatgcaaggtattcgtagtcggatcatattccgtccgggttgagccgagttcagatgttgtatagccaacaccattgtttcccgtattatttcgtgctagatcaccatcagccgcaataatattggccttatcttcgttcttagtccagcggatatgaactgctttcgtcttattccattttttgaccgcatcacgaaaagcccactttaattttggatcagcagtttccatgtaaatagtaatattctttttcttccacctaaatccttcaagcggtgtcggtgtattttctgggattcttagccgttctgcatttggtcgttggccgccattagaaaactgaaaatcattactatcagaagaatcctgactaaaaaatgatgattggaaaggttgggaaggcgcatctacatcagcatagacatgataatcgctaattccaaccgtccccacgactaagagtgctactaaaaatcgacgcatttaatcatccccattccataaagttagaaatgacaacacggttcgaggcgttcttgccagaaactaacaatccagttctgggagaaaaagccgatcaccgttccaatattaaaagcaaagattgcatgatttttaagagaacataacaagataatgataatgggcaaaataatattaaattacttcgtgaatttaagactggcgcggcgctttaaatagactgtcaacttatcatgcggttgaaaacaacaattacactgttgataaagggcatacccggcaaaggcaatcactaagccaagcaggttaaaaccaaagcgcagaaaaatgttcatcgtatcaattccccaaaatcgccataagttcgcaaatagttgcatgaaaatactgtacggaactaaaaatgttaactcccagccaaattctttaggagcaaattcgccaaccaaaagaatatgtagtcatcgctaaatatcccagcgtccaattatgttcttcttctaactctacaatcgcttcaagtaactctgcttgctcattataatatcgacttggctttcgattgagccatttgtaataaccatctcgcgaagaatcagctattttacacaactggctaattgaccatccattttcctgatttagttctttgatcgcttggtaccggagtcctttttcacctcccgattgcgtatttttgttaatttttttgcgaacgcaatctctatcttttgcttttctagctgagcccttaataagcgattttctgccttgagtcggtcaacttccgtccacttctcttctggcttagctttgcctcggcgatcacgaagtgattctgggtcattaccgcttttgcgatacttttgataccagccataaatctaatgcctcatctgtttgttgatattgttcaaccaatgagtttttaaattctttagagtagctttgattatgatgacttgcttgaagtcctggcattccctgatacttgtatagaagactccaccgcctgatagttttttggctaatcttgtatttaattattaccttatggattccatttcgtaaaacttcattgaggattaaaaatttttcctctgccgagtatttagattttcttcccatagaaaaagccctccataactacctcggttgtcttagaaaggatatattcctcatgactaatgatatcaacttttggaccggaatcaaggacccttacttaatcacctacactgttattctcggcgtaacttccaatatcactggttatccaatcaagaagtcgtcgaacggctacccgatttctctccagatctaagggttactatcaagacttaatagccacgattagtaaccgcagtcaggccttgttagatcagttaatcaagcggaataatttaccaagtgcgatgcgacgagttaagcgaacccttgccaagcaccgccaggagatcattgccagcttttacatccgactaaccaacgggcctatcgaaggcactaataataaaatcaagataatcaaacgaaccgcatatggctatcgtaacttcttccattttcggattaggattcttatttcgttgaagacttctaatctcatgattcgtgaattatcaaaaaagagaactagaccaaaagccaaagtagcttagtctagttctccaaattctcttcatccttaccgattgacaaagagccagggttcatggtatggtttaattatcaaaattaaaggaggtcatcatgatggctgataaggtaatgacgagggatgaactagcaaagtacaatggccaagctggtcaaccggcctacgtagcagttgaaggtgtaatctatgacgtctctgctaacccggcctggcagggtggccgccaccatggaaacttggccggtcaggacttgaccgacgttttgcttgaaaagtcaccccatggtaaacgggtattaaaggatctgccagtcgtcggtagacttgctgaatagaacaccaaaacagctgcggagggaaaatccacagctgttttttatataacaccgtttgtaaaattaagttagaaaaatagaaaggccatttgtggtagacttttgaatacccctaaacaaaagaaaggaaaccacaaacgagctgacaatcatcgcccattctttcgtgcaaaagcttaaagcgtaccgagtggcccaaatgatcaaccgttgtgccgaaaccgtttatcgcgtttatcgttacctggaaaccggtgcctcaattgctgattatcaagatcactatatgcgcaataagcaacgttgtggccgaaaacgtactcagttgtcactggctgaactcacttatatcaacgacaaaattgcccaggggtggacgcctgataccattattgggcgcgctgagcgcccaattagttgtaacctgcgaactctttaccggatgtttgaacgtggccagttcggcttcgatgtccgttccttgccgatgcgaggtaagcggcacccgaatggctatgtcgagcgcagcgggaaggctggccaattggggcaaagtattcacgagcgtgccaaggactttccgcactatgccactgaatttgggccccttgaagctgataccgtccaaggtaaaaagcaccaaggggcggtaataaccctgaccaaacgccaatcgaaggtcgaaattgtactcaatgtgcacgaaaagacggctgatgcgattaaccaacacttaagtcagtggcttcggaaattcccgcggcacttcttcaaatcgattacctttgacaacggaaaagaattcgccggctggcgcgagattgccaatcaatttgaccttcacacttactttgccgaggttggtgctcctaatcaacgagggctgaacgaaaacaacaacggtcttttacgccgggatggcttaacgaaacagctagatttccgcaatcttcctgatgaattggtaacccaactgatgagtaagcgaaataacctgccccgtaaatcactaggctatcgaactccatatgaagtattcatgtcttacgtcactgatgagcaactattttctttctaacttaaattgacatttcgggattttatcctccccaaacgtaattgaactactcccacttagctaaacctacggtttaattgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccactcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgagcctttaagaaccgacgactacgcaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaattttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatactaaatatatcatagaacaaaagaaaaagcactaacgcgctttaagagagcgattcatcccctacttatagaagtaggggtattctcgcaaatttatggataaagaccagaaagaatgcttccctcttctttccagtctacctattaatcttcaacttttttagcgtcgttcattgccttcatgatagaaggattctttgaatgacaatccttgatcatttggatatcttcttcacttaattcaacagtgtatttagccatgatcttccctcactttacttaaaaaattacacccttactatatcacatcacaggagcagtgtctggcttaatcagtaaattaagatcattaattgacattcaactgagatttgctaagattaacattgaattgcataaacggggagcttgcagacaggctgagaggggactatgcgtctcgacccaatgaacctgatttggataatgccaacgtaggaaggattaataaaggacgaccaggatcaaagtgattactggtcgctttttactttgcactatcttaatcaaatcaaacttaaggatggtggaattatgcaacgacagacaacaattatcgaaaacagcatgatttggtgtggcgccgggatttcaattgctgaaatcctaactggaacttacttagctccccttggttttacaaaagggatcgccgtaattatccttggccacattatcggctgttttctgctctttttagctggaattattggcggtcagcaacgtcttagttcaatgaacgccgcaaaaattagttttggccaaaatggcagtaagttttttgccctattgaatgttctccaattgatcggttggaccggcatcatgatttatgatggtgcattagcagccaatgggggctggcaccttaatcaggcattatgggtcattttaatcggcgccctgattattggctggctgctcgtcggggttcggcacctttattaccttaaccttgcgaccatctcaacattattaattctaagcggtctcctatgcgccgccatttttacccaccattctaccagttcaccaactggtacattgtcatgggctcaggggatggagctagttatcgccatgccattatcgtggttgccacttattagtgattacaccagtgttgctcaacgacccgtgccaactagcgggattagtgcagttgtctatggcctgactagttgttggatggccttcatcggtttaggagctgctatccttactcatgacattaacatcgccacgattattttacgggccggcttgggaattgccggtttatttatcattattttttccacaatcacaacgacatttatggacgcttattctgctggtgtttcttcaaaaacgattttcagtaaatggtcaggaacaatggccgcaattggtgcaacaattctaggaacaattagtgcgttgattttccccatggacaacttcagtaattttctttaccttattggttctgtctttgccccaatgattgcaattcaaattacagattacttcatcttgaaagtagattatcgtaaacaaaattgtcaatggactaacctaattctctggttgattgggtttatcatctatcgaattctgctaaattattcatttccactcggcagtaccgttaccacaatcattatcatcatcgcaataacctggggtacacagcaagttcgcaatttggtcaaagtgaaataattatagttttcctactaagtaatagtattattaatgcaattacaaggaaggaattacttttatgaaaaaaatagttgctaaacaagtatcaatacttgaactcttctatgatttaatttttgtttatgcgatctctcgaataacaatgatgattcatcatccaatcgatggtagcttgccgccaagaatatatattgaatttatcattgtcgttatcttcgttttacaaatttagctttatcagacagtctatattaatcgctttggaacaagtcgggccgtcgatacggttggcttattgattagtatgtttgccgccatctatttagctaataatattaatactgaatggcggttaacatttcatgcgttcaatctttcggcagcactaacaactattaacttaatctttcaatatttatttggctctagcactcattttaaacgagatcatgatctccaaggatttattattgcgcttggcttagaatttattcttcttgtaaccgggctgattattggttatcagtatggtgtctatctctgcgttgccggtggtttaatcggctttttaatgcccttagtgatgtaccgcatgtttaggccggaacaagtcaactttccccacctcgtagaacgcctaagtttaataattatcattacgttcggagaaacacttgttaacattacccattactttaagggcgctatctattcaccattagcaatcgcaatctttctaggagtagctgccctattcggcgtctatacattgctagtagaacgcttcttaaatcatcatcagcatactcgcggctttattgcgatgtacactcatgtagtaatgattatcagcctactctcgattacgactaggattatctatatggctgatgaagaagtatcacgtttgtttcttagttgctttgtcgcatctaacctcatcgtcttctacctttgtctctggctttatagtttttataatcgccgccatttacgcgttaatggtcgagatcttagggcaatggcgatcgtccttttactaggatcacttggcattattttatgtcgcgaaaataacctaagtttgatgagcgcatttgcgttaaccaacgtggtcgaattcggcttgttggaatggaagctgcaaagaaaaaaagccctctaaggagcctcacaacaactattcatcacataattagttttcatccgcatttatattccatttatcctaataaccatttagggcagatggaatttttattcccgaaatgtcaatttaagttagaaaaaaagtagttgctcatcagtgacatacttcatgaatacctcgtaaggtgtttgatagcccaatgacttgcgaggaatgttgttccggtaactcattatttgagcaacttcttcatcagctaggtggcggagatcgcgacctttgtggagcccatcgcgccgcagaaggccgttgttgttctcgtttaacccccgttggttaggtgcccccacctcggcaaagtaggtctggaggtcaaattggttggcaattgctcgccagtcagcgaactccttcccattgtcgaaggtaatcgacttgaagaagtggggtggaaactttgccaaccattcctgtaagtgctggatcacactggtggccgttttactatggacgttaagaatcacttcgactttggaagtccgttctaccaaagtcataacggcgccctgatgtcctttgccctggacggtgtcggcttcaaggtggccgaattcacggttaaagttgggaaagtcgatagcccgttggtgaatgctttggccaagttgaccggccttcccccgccgttctacgtaaccattggggcgacgcttgcctttcatcggcaaggtccgcacatcaaaattgccccgctcgaaaaggcggtaaagcgtccgcatactacagctgagtggctgttcagcgcgtcccataattgtgtctggcgtccagccttgagccactttggctttgatataagttacctcatcagtgggcaattgaatagccttccgaccgcaatgagccttgttttcacgatagtgttggtaatattcttggagcgtgtggccggcggccagaaagcgataaactcggtagacggtttctaagctccggtgcaaaagtttggcagcccggtaggcttttactccttggtcacgaaaattagcgatcatcgttagttcgtctatggtaagatgatggtaggtcatttgtggtgtcctttcttttgatgtatgggtattcaaaagtctaccacaaatggctttttatttttctaacttaattttacaaaccgcgattttaaattcagttcaaatcccatatgtttattgtcaattttgtcatcaatataaatcgtaccgcgttttataaaaccaatatcttggcctattttttgaacaggaatatttttgtaatgagtatcataacggaaattccttactccttgcaaatacccaaccgtaagtagattggagaagatatatttcccaaaaccttgaccattgtgggaaggaagggctgctaatcgatgaatgattgcatatggctcattttattttaaccacgatccatctttaatctcttcatacgtttgttccggggttagttgtaaggtagccgtcccaacaattttttgattatcaattagcacccagttatagccagctttaatatcattttccatcgttttctggaaaggatgaccatcttgccattgtggattacccttttcttttaattgtgctcgtgcctgttcaataattgtcatcacactttgaagatcatccaaagttgctcgtcgtaagtaaattgccattatcttttctccttaatcatctctcactcctaacaacaaaattctaatatattaatgtatggtcattttatcacgattaattattaaactgatggggctttagctaagtttaagtgttttgtcacagcgttttcattttaaggagggaatctcatatttatccatattgaactactcccacttagctaaacctacgatttaatgcttgaagtgggagattctggaaacatcgcatacttaccctaccgattctgaacgaaccttcaagcagaggttacgactattagccaaggctcgtcccgagcctaactttatctatcgatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacgggttgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcgtctaattgccgtggaactaacactttattatgatgatcccaggcgatttcctgctgggcctttaagaaccgacgactacgcaatttctcccaacgatacaactttttacggtatttgtcttcaaaatgattgatcggctccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgattcccaaagatattgcttgatttctggaaattgttttttgaccattctggagctagacgatttgtaagcatttaaaaatttagccatttccgtatgaggcgttgctctaaacaaaacatgtacgtggtcctgatcatgattccattcttgcaaattaatgccgtatgcttgtttcacaactacaaaacgatgtttaagatattcagatatttcatcgttaattacttttcgacgatacttaatcaccattaccaaatggtaattaagtaagtatactgaatgctgatttttatctaattctattgttatcaccacattttatagatatatactaaatatatcatagaacaaaagaaaaagcactaacgtgctttaagagagcgattcatcccctacttatagaagtgggggtattctcgcaaatttatggataaaattaaagaacaaacagcaacaggtttaaccgaattattggatcaagctcagttagaaaaagatgacctcgtagtgttatgtctttcaactagtgaagtccatggcggaataatcggaaaggactctaacattgagattgcctgggcgattgtttcgacagttgttaatatcttacgaaaacaccaactccatttagcagtccaaagttgcgagtaccttaatcgggcacttgttgtcgaacgaaatgtagctaaggagcgcggctttgagcaagttactgtcttcccttcgctccatgcaggtggtgcaggacaaattgctgcttttgaaaactttaacgattcgattgaagttgaacacattactgctgaagccgacatggacatcggtgatacctcggttggcatgcatgttaagtttgtccaagttccagttcgcacttcgataaaacaaatcggactggctcatacgacttatctccgcaaccgaccaaaattgattggtggtgcgcgcgcaaaatacgaatgggatccgtttgacaataaataattttaattatgaggctgcgagaaaactttttcaacagcctctttttttatacgaatcttgttacgatatcgtggaaatccttgtagactagctttgcattgtagccatccttgcgggagtgggactaaaaactcgcaagcaagtttaattctattccctttttcgttcaattatttaactttccgattacccaattcccaaaaagcgagggccgaggcagccgccacatttaaggaatcaacgcctgtagccatcgggatcttaattgtaaaatcactctgcgtaattgtattttctcttaatcccggcccctctgaaccaaggataatggctaatctatccaccttagctaactgaggatcatcaatatcaaccgtgttatgacggagcgccatcgcggctgttttgtagccagctcgatgaagaagatcaactccttctgactgccaaactttagcatcaacataggtccacggtacttgaaaaaccgttcccatagctacccgtgaggcccggcgataaaggggatcagctgagttgctcgttacaattaccccatcaattccgagagctgcggctgagcgaaaaatcgccccaatgttggtgggattaacaacactttccaggattgcgatacgcggatggtcactgggcatagtagccaaaaaattatttagacttggccgttcgacgcggtacatagctgctaatgctcctcgtaaaagattataaccaccaccagccaactgccgaagtaatttactattaactacataaattggcgtttgttctaatcccctagtttggttaattgccatctcatgatccaaatcagccaagtcacgctctagttccttttcttctattaaaagagatgctggccgataacctgctcgtaaagctcgttcaatcactttgggactttccgcaataaataaacccggattaggttcaagagcatgaaaaagttgtgcttcattaagtcgcatataaggatctaaatctgatcctgtaagatctgtaagaaaaattaaattatgcatattaaatttaccttatcttaaaaactgaattagtttagtatactcttattttcgacctttttcatgacggttattttataacgagtttcgtttgccgatcgggtaataaaatcacgttgaatcaaaagagaaacaatcattgctaaagcatcaataattatgaaaacaattaaggtgacatagtaattgtggagaacttggtgtgtgtaagaaagaagaaggggtcccaccatcccagcaattgcccaggcagttaagatatagccatgaatagctccaagttcttttgtcccaaaaacgtcaccgagatatgccggaatcacagagaatcccgccccataacaagacattaataagcacaacgctaatgcaaagataaatggcgccttaaataaaagaagaacaaagagcatcacaatatcaagaacaaaaatcaaactataggtaagtggccggccaataaaatctgataaagttgcccaagctagacgaccaaaaccattaaatagaccaatgataccaaccattacggcagccgcactcgctgtcattgtcgtcatgtcctgggccattggtgaagcagctgaaactagcccaattccggtagtgatattaataaaaaacataaaccataggaaggcaaatgtccgtgtccgcaaagcctgattagcagttaattcgcgaccagtcaaacttatccgttcagcattcttagcaatcgctggagggagttcatgtgatcgtggcttcttgataaattgggcagcaaccagcattacaacaaaataaaagcctccgagaatgtagaaggtatttacaacgccaacgttcgccattaaactttgcgcaattggccccgtaagcatcgctgcaaaaccaaagcccataattgctaaaccagtagctagtccccgcttatcgggaaaccaacgcacgatagtagaaaccggggttacatatcctgaccctaatcctaagccacctattactccatatgcgacatataataaccataattgatgagactgaatcgctaatcccgttaaggcaatcccactcccatagcaaatacttgaaatagttccagtaactgttggcccaaatttttctactaaacgccccataaaggcagctgacatccccaaacaaaagatagctaagctaaatgcaaacgatactgaagtttccttccagcctgtatatccagagattggtttggtaaacacactccatgcatagacactaccaatcatcaaatgcaaaattactcctgcaatagctactccataacgatttcttgttttcggcatcttcactactccttctctacataatttacgaactttatcataaattaagctctataagttcgtctatttaaaaatatcatagagcaactaacttatcaataagaaaaaaacgaacaatctaatttagcgatagcatttattactgcttgaaacttacctttaatagcaaaaaacacccagcttttacactggatgtttctcattggcaaatatgttgtttttaattgagttgacttagttttaaaactaccaaagtaccatcatatcgcagttccaactctaagttacattatataattctattcgtactcttttgtagagggccttgatatatcagtacttcaaccgtgatttagcttatacggtagaaaaccggtagacaactcgtattacaatgccacaaattgattaccattgaaatcaactaaagagtgattaggatattcaattttccctattgctccattcagctggtcagcaacagttcgattacgaccacgccataactgtgaataatacttaagtgttgtggtcggcttagcatgccctaaccgttgagatacagctaaaatatcaacattgtatttattaattaacaaacaagcatgtgacgtccgtaattctttagcctgaatacggtgaactcctgctaaatcagcatatcgattaacaatattattaacggttgaacgatgtaatggttcatcagtggcactcagtacataatgatcatcaccctgttgcggtaaattatcatactgtaactttttccaccactttaaaagatccacaaggtcagttggaatatcaatggtccgcatccccgcagtagtcttagtataattcttgcgttttttatctgggtctttagtattcgtcaaagtatgactaaccttaatatacccatcagctaaattaatatctgaccaccacaatgcaagtgcctcggaaacacgcattcctgtgaaatagtaaagattgagcatcacgtaagctaaggcaccttcaatatcaccaatataacactttgagataactttcttgaattcttcaagcgtctaatagtgaataatgtggtggcctttggaaatcgctcccgttgccttcttaatcctagaaggattttgagttaagtaatcaagctcaactgcactatctagcacttccctaaacaggccatataccaacgaggcatacgattgcgaatagcccttctcatctgagagtaaccaatttctaaactgtaaacaatccactggctggatttgcttcagtttcttgttaccaaaccactttaaaatcatctcaagaactggttcacgagacaaccaagtgctttcttcaacatttccacgataagttggcttaaacactttattgtagaaatctaataacttaacgttaccggactgcgttggaaaaccatttttactgtactcatcgcggatacgctcagcttctaaatgagcatcacgcaaggttttaaaacgattaccatttttatcccgacgtgccttcttgattatcttttttccagttaaaggatctaagcctagataaacgctaatataaatatatccttgttcgccatttcgaggaggctgccgatacactgattaatatttagtctttgccatcagcgtcatcctcctcaagaggaactcccaaaacgacttcttctatgatagcacgaggtgcaacttgcaagcgaggattaccccaaaaagtttttccccgtttaaccatgacctgacgagtatcatgaagaatcgtttttgcttgattaggcttaaagcccatagctatcaactcattctttgaaaccgttgctttcattgattaccaccaactttctgagatggtgtataatatgggcgacaatgatttggtagaattattgtggatggctttgcaatgctttggtcggctgcaaagtcttttttattctgtaaataggctaaaattagcgattgcctcataggacttcgtaactcaaacaagtgaacgtactgatgattacttacgttatgttgtttcttataatgttcaagaagcagaataggtaagtacttactaggatttccattccagatcatacaatatcgaatcgctcgataataaagatgaggatacatgcttcgccaagtaacacctattagctcatgaatcgaaacatcgttgcaattttgttcgcaatattgatcaatcaacgtatcaatacattgaaaatagaattcaaaaacattcaattaagctcacttcttttaataaaataagcttgattcaaagagtaagtagcgctctccataatctagaatataaaagcgcttaaactcttctttagtaacgcccagttcttcacgctcctgatcaatctctttttgacttagataattattcggttgtccgttaaattttaagccagctggtcccaatttctgatagaaattcaattgagtatcactaccaaccagcttcagcatctggtcgccagcgtagttcatgaacatgtcatcagcataaatgcgtgatagtcgacgcaatagcaataaccgttcaccagctggcttatttttgaaataatttacatgattattctgattcttcattaagtcattccaaaacttatcgctagaccgtgtttctttaatagcagtgaatagccaacgtcgctcagataaggtcatgttaaagaaagtctggtaatttttattttaagaattgattgtattttttcataaaaaaataccccctacattttcgtaggaagtatttttagtcaaccataccagttgacagatatccaaattaatgctttgcaaagaagtcgcggtagacgtccgggaccacccggtcggccgcttgccattgggcctggagccggttttccagttggtcgcccggggcaaagaccgcctgcaagtccgccaccatttggtcgacttgtgctggttggtaacggttgaccggggccacgtagcgcggcgcgtgcagcgtttcttcaaagcccatgatcaacatgttgttttcaaaggcgccccgcacggcatcgaggatttcgttgccacggttgatgtctaaatagacgtcggcgtgggccaccagtttccgcaccgtcttagttgcgacagttggatagaggtcaacgttagcgtagtggtccaaactcatcagcttgctggacatttccgtcaccgccgctatcgcgaagtggaagtccggcaagcccttgatcagactttcaatttccaccaactgatcagaattagtcaggatcaagatttccttgcgttccttgttgagtcgttggaacggataagcgtaaccaaggtagctcagctggacttgctgctgcggctggtcggctaccaaacggcgcaagttgtcgtaagcggccttggtctggacaacaatttcggcgttaggcccgaggttgccgtttaaaataaaatgcatgttgcccggaatcgcatcttggagcggttcttgccagaagagacgcgggtgcttaacggctgccccgagcttctggacgacaaacagcggcgtggacagggagttaaagttaatttggcgaatatccaggtccgcttgctgcaggtagtaagcaatgatctcagtctgattgttgaagaatcgtggctggccgttaggttggtagtagaccagttggccggtcaggtggttagagacgacaatttcttgaccggcccgggtcaggtaggtggtcagcgtcgggtgaccggcttcatcgtagtcggtcacggcgtgcttgaagccccattgattgtagtgatcaaccacccggactcggccgttgcggtcaaaccattccaccgtcttgaccggtcgggagttatcggtcgtggcaaaggtaatccgcccccgttggatccccatgtccattagcttgccaccgctgctgttagcttcaatcgcccagtagcgcggcaaatcaatctggttaaagtagcgcggtttgccgactaattcttccccggccagctgtaggtagtacttcagcggggaagtcacgtcgtcaggcaagaaaccatcatcgtgcaagacgaccgtcgggtacttttggccagccaccaactgggaaaattgcaggtctttgctttcgactgtgtagaaatcaaataaattaatcatccgcttgcacctctttcaacaattgggcccacttggcctcaatttctggttccaagtagtccgccgccaggtcataggacacttgttccgcccgttctaagtctaatttagcaaacagggctgctaacgtcgtcgtcaaagcgtggatcgcttgctcgcccgtttcgccgatttcgtacggaatcaaataaccattttcgtcgttgcgaataaaggtctgatttccatagcggacgtcaaagccaatcatcgccagtccggaacccacagcttcaagcaaggtcagcccaaagccctcactggtggaagccgaaatgtaggcttggtagccttgataaacatccgttaagttctggtgtccctttaagtggatgtaatcttccgcttgcccgtccttaatcagctgttgcaacttggcccgttcgcccccttccccataaatatcaagggtcaattgcgggaattgggccttggcggccatcacggcttggactacccaatcgaggtgcttttcccctgccaaccgcgaagccgtgatcagactaaacggccgccgcggcgtggttgggtgctttaattccagcaaactgccgaccggaatcgtaaagatttgcgggtgggcctggttgtacttagcaaattgggccgccaacagctcggtctggacctgggtggacgtgacgtagaaatcaatgtcgcggtggtgctggaagacatactcgtagtagttgttccacaagatatgatcatcattggtgttattgacgctaaagtgctcagcgtgcacgacgctgccgaccttggctggccccttgtgggctaagatttgttgagccatcccggtcccccggtcgacgataatcacgtcccccttctgcaaggccaaccgttccaaaaaggcggtgatcaattcttccttggacaataacagttgacccggcaggcggaaagtcgcgttatcaccggtcggtaattcttccatcgccacggagccgtcctcattaaagaagcgccgcaccatcagcttggccttaccatcgatcggggcgtaatattcgctcatgtagcggccgtagctaaagaaatcgcggtgaaagaggttgccgctgcgcacgtattcggcccgcaggacttgctcactgccagcgcaccgtaaaatggcccgcacgtagtattgatcattaaagatgtacgtcaccatgttgccttggcgttccactttcgttggttgctcggcaaaggtcgcggttaaatcggccaaagtgtaggtcgtcggcgcaattttaaagtcactaaaggcttggtagagccagatgacttcttcatctttaaagcccaggttggcggtatagtgctcaatattttgggccgaaataaaatcagtaaagataaattttgcatccacccctaagtgatggaagacttgggcccggtaagcctgggcgtattcgaccccgctgctggcccagccgattccttggttaaaattataaacagtcatcataactcctcatttcactacttgatccatcacaactggcgcttggcgcaaaggttcaacgtcaaacccctagttgctgagttggccctaacgcaagacgctcatcaacgaaataatgacccccataatgacggagagggcaatcaaaaacatcaatttttgttggaggttaaaagctttttcttttttctgcttcgtgggcttgaattgctccttggctaaccggttggcgatgtcgctggtcaacgggtcgtcatgcttttcgtgctcatgcattggtttttccctcgcttcctagacaaagtaaatctgcttttcaccctttttgttgacgtcgatcgtactcatcaacaagtggcgggtaatccggtgatacaagtcgtggcgcatggcgttatatgaacgcagggcttccttgtgatattcatacaagggattccgctgggccgtcgaccggctggtcacaatcgtttgcaattgggacagcccatcgatttcttccacccagcactcatcaattgcttttagcaccacaatccggtaaaaatcattttcttccttggtgtccgcaaaagtggcctgcttgcggcctaactccgcgcgggcaatgttcatcaggtagtcgacgaccgtggtttgatcagttaggtctaacgtggtcggccgtgcaaagtactgataagtcacgttatctaaaatatagcgtaccagttgatcgaccgttaaagccgggtgggtggtaaagaagcgggtaaactcagcttgcaaaatcgcggctaaatccaaatcgacttgctgatgatacaagagccggttgcgctcgccaatgatcaactgccgctgaatctgagcgctttcgtccatttccaaggacttgcgccgctgctggcggtcggcactatcactggcttcttgggcctgggcaattgcgcggcggaacttccgggtagtaatctcctcggggtgggccggatcagtttgccgtcggcgcttcttatagtacttctgcaaccagcgggccccgtgcttgattacgacttggtcttccaaggaaacgtaaaattggctggtgcccggatccccctgccggcccgcccggccctggagctgctggtcaatccgcttgctggccattttttcggtcccaatcacggctaaaccacccaactccttaacgccgggccccagcttaatgtccgtcccccggccggccatggtggttgcgaccgtcactgcccctttttggccggcttcagcaatgatcgccgcttctttggcggcatttttagcattcaagacactgtgggggattttttgttgcaagagcaattccgaataaatttccgaaacttccacgttggccgtcaccaagagaatcggccggccactttcgtgcagccgcagaacttcttggagggaagccattaacttttccggcagggtggtatagaccttgtcgggcaaatcaacccgcgccaccgggcggttagtcggaatttgaatgacccgatcgtaataggtctccagaaattccttttcggccactttccccgtcccggtcatccccgccagcttcttaaacttacggaaaagattttggtaagtaatcgaagccagggtccgggtatcgggcgaaattttaacctgttccttcatctcgattgcttggtgttgtcctgcttgcagtttcattccttccatcacccgaccgttggcccgatccaaaaggtctacttcgccatcttgactgacaatataatctttatctttttcaaagagccggtgagcctttaaagctaagtttgttgctcgtaataattcagtgtgatgaccattgaataaattcttaaccgcaaagtagcggctcatttttttataacctaggtcagtaaaccaaactgcattttcctccttatcatatttgtactcttccccttccttaagggtgtagatgaattcatctgctactcccaaccaagttgattgtacccgcggtgaacctgaaatcaccaacggcatcaccgcgctgtccaacaaaacagcatctgcttcatcgacaatcgcataattaaaatcacgcataaatttattttccacactagttgctaaattatcaaatagataatcaaaacctagtgttgcattagtagtataagtaatatctgccgcataggcactccgcttatcttcgttggtaaactctttcgatcccggcgcagcaaaaccaactttacaattcaaccctagccattcataaactttccccatttcagtgccatcccggtaagccaggtattcattcggagtcaccagcatcgcccctttgccgcttaagccgtttaaatacaagggcatcgtcgccgttaaggtcttgccttcgcccgttttcatttccacgatattaccctggtgcagggcaatgccacccatcacctgcacatcgtacgggtacatccccagcacccgccgatcagcttcgcgcactaccgcaaaggcttccactaacaagctatctagggagtgtccgtcttttaactgctgcttaaatttccgcgtataatccttcagttgaccatcactcaaggccgccatctgcggtgccaactgattaatttgtttggtaatccggcgcagcttttttaatcggacccggtttaataatggcttcttcattactctttatcttccttttttattaatttctgcctactaatccagatattgattcaccacattaatacgacgttcttgttgaatggcattgtaaattaattgctgttcataattgacgatagcgctcaaactctcgtcaacgattgcatcttccacgtcttcgtcatcatcttctgctttagctatttttacctgttcagctacctggtcagtcacatcagttaaatctagtcggtggaaaattatctctgtgcagccagcgctaaccagctcaacagcataaaagtaagcggtcggttcaaaagtaaagatcccactatcttgacgtatgattgccatcttcaccagcttgccttcataattaaacatcaagactcgcaagtataatccctgctcgtaattgctttcggctactaagtggagctggtattgatgattgtgttctaaaagtggcaactggggtaccgcatgggcagttgcaaagttaaatagttcatcccagtggtaaatagttgagccagtcggtaaaaagggattccgtaactgaacatggtcctgggccaaaaatttaatgcgcgttccatgtaggtaagcatgagtcgccgattgaacagcactaccataatacttgtcggactgataaatctctccccgcgcagcgcctaaaccaacgtaaaacagatctgctggtgacttaatgtagatactttgcatcattgcttcctccggtcaaaatcccgttccatcattgtccagtattgcttttttaaccaggctgccgtttcatacccagcatcattatggtgtccatctagcccccgaccaataacataaggatgtttgccagtttgggctaagtgaactaacaaatcatgatacgccttattatcgtagtcatcttggcgcatataagttaacatcaattgggtttggttgagatcggtctggtcaaatttagaccagaaacgttcgttcatcgtcttaaccatctgtttgcggccagccaactgtgctttccgcgtagtatatttattaattatatctaaagaagttgcaaagccaccataacgaacagattgctcacactgagcaacgtttccaagatttaccaatggtttcccaacaatgatactatgcgcccccagctgactaccataatatagagcaccaaaggttccagctgataagccggaagtattaagctgatgatgatcaaatcctaaccaagccagggttttcaagatccgctctttaatctgagtttcaaactctggactccccaaataaaaggctgtcccttcgatccgtgggtcagcaaatagtaaaaatggtgccccgaatgaacgcatcatataaaaggcttcaaatccctcggccgtccggtacccagaaaagtaaacatttaacggcggtttaaggtcaccagggttaaagtagtaattaacttccgtccgatcgtgatcgataagtcgtcccccacccggcaagaattcccccatttcatagcgtgaccaacggaggtgaacattacctaaagatagccatccttgtcctttagcctcaaaggtaatacaaagacttcctcccggaatcgtatcataaactggcacttgctccgtcatatctttttcagtaaaaactaagcgtttagaaaaagtatacggatttcccggtggtgcttcataaactaccattcgtagcttaacttcctcactatgagaatactcactccaaagcttaagtaatcttcctcgatcaatataaccaccaaaacgataagttcctactggttgatagtcagtgccaaagtcgccagtcaattcgaccgccagaaagccattaaactctaagctaccacgataatttggtgccggttcaaacattgaaggatcaagttttgcccccccttgcccctcaaacagacgagtttgcaaccatttcacaatttgatcccactcagttagtggtaaaggccgaaccactttcgccttaaaatagtcggtttgtaatggcgtttttagttcttttaggaccgcaggggcgcaagtaacacgataactgtcaacatacttgaacagagcttgtaaatctacatctgtcgggcaagctgcaaagtaagcccccacgaaattttgaacccgtggcttttcgacttcgacaactggcttttttttctttaactggttagtcgcctctttcgtcactggcttttttgaagataattttggcttaggatttaaatcagctaacaaggatgacactgcccctggtgcggcataatgccactgatgatctttgtcggcaggtaactgtgctgttaaatcatttggcccaattaataagtaatgttccactttactcctccgcctttttcaatgcaacttgaaaccgcttgacaatccgaccactagtatagtccgcaattttattggctgcatggaccagcgccacgttccaatttttcaagccatctaaataaaagtgtaaggatggcccaagctcattttcaacatcatcaatgcggcgcccattcttcccttcctccacataaagcgattcagcccttaaaatttcagggatcccggcactaatcccggcaatctgtaaaaatacatctggttgagcagctaaatcaattatgatacgagtagtatgaatggcttgaattaaatctggttcagaatttacaacgaccaaatgaatatcacgcttacgttcattattacgtgcagcatcaaggtcatcagcaagttggttttcggccttagaagcttgtacttggttaaaagtatattcatcttcaagatccaagtttttgtctaattccgctactaaacccgcgatttcatcctgacgttgaaaatcctggaaagtaaggagcgttaaatcaatcaattcattttcattcatcatagtcatgataatccgtaaacttttacgtaggagaattggatctactccgtcaatagcgaacataattttcaaaagccgctcctggttgctgatgccaagacttaatcttgtatccaaaggtggcagttgtaacacctgagcaccaaccttcgtcagctgctctcgattataattagaatcagcgatcgttaagactgcacgctgtgccatctcagcttcaatctgttcttctaaattagcccgattaccaaagtaagacaacactacttgatcattgggaagcacatccattagcatttgatcatgaaatggatcggcagcagcgattatgacatctttagaatgaatttgttgctgactaaatagagtgaactgctcgataattaaactcctcaggttcggatagaccccctgatgctgagcaaggtgagtgcctccaacaatatgaactttcccgtcagatgccacgtagaattgttcattaccgttactatccaagtaagcctggcgttggcactgttgctgatcatcatattcgctgactcgcgaaacaaagccgcgatcgtcaaagtccagcttccgataaaggcggtcatctttaaaaagatccatcatgattagattgccttccggtcccattgaaagctgagcataacgttgggcatggctaaagacagtcacggtaaaggggttgtagacgtaattggcgtcagcaggccaggtaaagtcgtggtaatcaaggttgaccaccgataaatcggccggaatcccctgtaagtagtcaaagaccgccaagcgcggcacttcgtaaatcccctgctggtaggcaaagtgacggagattaggaaagtacaccggaaccagtaaggcggccgtttgctcgcttcgagtaaacatccgaacctggttgatcgtatcgtcaaagccgtgctggttctggcggaaccaaatttgttcgcgactgtcccaggattgatcgccccggtaccaagcgggtaaaaagtaatacatcccttctacacctcctttgcgtggtcaaatagcggccgatactgcttgcgaatcgataagatattgatctgatcgatcatccccatcgaaaaaccaacgatcatcaagacgtagcccggcaacatatagatccccaattgtccggggtggctgacaatcatcaacattggcatcccagcaaagataacattgtaaacaccgcccacgaccccaaataagagggtaatcaggttgatccgccgctcagtcgccttacccggccgtacgcccagcaggtagtcgccggagcgctgaaaggccttggcctgctgttcggcattaacgttaaccagcgcaaaggccaaggacaggataaacagcagactgatgtagaggatgattcccggcaacttggtaaagccaaaactggtcgccccccaagccaaccagtaattttggggataaaaggtcaataagaataaacaaaagtaagtgggcagtgtaatcatcgacatggcaaacatgatcggcatcccgccggcgggggttaatttaattggcaaatacgaacgcgaagcataattgttatcaatcataagacgcaccaagggcaaacggtattccccccggtcagccataacattgaggtaagcaaaaaggaccatgatgatgaccagggcggcgaccaccaccattagacgggtcgtggaatgatcggctaacatcaaaatccccgctaatcccgttttcatcgcactctgcaaaatattggccagtaccaagagggtcagcccaccaatccctaacagggcgttcatatttgacagccacatgataaacatcgtcccggtcgtcatggtcagcaggaccgcccctttcgccgcccagcccgtctgggtcaattgcatggaactgaccaggacaaagccttgaattaccgttagtagtaaggtaatctctttgcttatccaatccttgcgccgctcagataagcgatccatgccaaaccctcgtccctgagtcaataaattggcgatgatcatcgccgacatccacggtgaaagccccaaactaaagagcgaaagctgggttaggtcccccccagtcgccaggctggccacgtgcaaactggcattttttaccaccaacgatttggcatcagtatatggaagaggaatcgacttccctaaaatgaagataaagacaaacaataccgaccagcaagccttatgaaagaccgggtgattgaatttccatttttgccaagtgtgcaccgcacttccccccatttcatcgaacaatgtttgccactcagattctagctgttttataatacaatttcaataatgcaataatcaaaatagcgatcatatttatatgtttgctaaaaaaacagcatcgataagggcgcgcttggtaaagaatccatctcgaatcatatttcctatgcgattagcatttctcgataatgtggcatactgttcatcactaatttctttcactttttccgctgcttcctctaaattagcaacacagtaaccaatgtgatgctcatcaatgaattcactttgcgccaaattatttttaacaacgactggtattccggacgctaagtacgtactcaattttgatggagcatccattgtcatatattgctctgtataaggatcatctgtccaaactaagccaaacccaccgtttcgttgcaaactttccagaagtaaaggatcaattttataccctatagcttcaacgttttgattatctatttttgcgtcagtataaacttttaatttcacttttaatttcacatcgtaattccaacttttaataaaggtaaacttatcaggatttccggcaaaactaattgtatgagaatttttgggagagataaatggggatatcatacctgggtggtcccaaaattgctgataaatcactggaatatcttcttttaagccatcttgccttaaacgttcaatcaatttaacagacggagcaatcagtacatctgctttattgaaatattgaatgtacttaggcatcaaatacaggttcgcttcaaacattaagggaagaacgtcttctataaaaatgacttttttcaccccgttatacagtgagaccctatcaactaatccgatatcccaatcaatcgaattccaacttggcgcctgaaagattacagtatcgttatttgctaatccggctaacatcccatcaaaccgtccgtttcttacttcgattggttcatcaggccaatcataaaaatacattggaatctctttaaagtgtaaatcatgacacgcgatctctgctaccgtattttgagcttgttgtgctgtatttacgtagttaaggccatggatgtttgtaataaagactgtcattttaacctcacttaatactgtatagcttcacctttatctccattcaagattactaatcatttcaaaagctgccctcttaattggaaagttttgcctaatcaaattaccaatctggtgagttctctcgagcatttgatcatactgttcttttgttattgacctcatagctacctctagctttgataaatcacctaatgccaaaccaatcccatgctctttaacaaattccgctaatgctgattgcttagcaactattattggttcgtcagcagccaaatacatagctgctttgtaaggagaattatacttttcatactccccgctccatcctgttatttgaggataactggtagaggcccaacatagtccaaagctcccagatagaatgctaggaattgcttcatgatcataatttcctcgataattaatgttagggtagctattcgtcgttaaatcatgcaagacattgtcggtctccacttcccgtccaaaaacgttaactgcaatggatgatggaatccccagtaaaaatcctgctttagtcaggttacctgcgaaatcgatttctaatttcaaagggcgtttccaatccattgaattcttttttgctgaatatccaaatacatccagatagacaaaactattactgtactctagtccggcaaaatcaaaatccccctgcaaacgttccgccatttgatgattatgaacgattaacccatccatttttgataaaaagtaatgttcaacaaacgaattactatgatgatctgtcaacatttcccgtgcttctttaactgatttttttccttgccatgaagtaatatcatgaataatcgctacacatttggcaccaatttgattatgaaggtaatctatcaaatagccagtgtatgcgtttgaattgtgcaccggaaattgaaggaaaacaatatcatctttctttatccccgccagttgaccatcaagccttgtttgtagtgaactggcaggttcctcatcccaaaaataaatgtaatagtctaaagtacgtgcattcaacgcttgtactaaactctctgttacttcatattgcggccgaccaaaagccgtattatcccaatatgggacaccattttcgcggctaccattactgctcataacccaataattcataatttgcacatctccatatatagataataatgatcttttagtagaaactcaaattgtagagtgttttacctctagtgatgcctaaacaagatatcaactaaattgatacgttagttatattttttcaaaaactatgactctatttgatcccaatagattggcatgacagccgttgtactactaaaaacgtacatataaaggtcacgcacagctgcaatcaaccgatcactggttgcatctaactggttaaatagttgatctacgctctcgtaaagaatcgtgtcgttatccaaatacaacacatgctcatagtcagctaacaccactggcaaaaaaattcgttgtaagtacaaaagattaacgtgatcttttacttgcgctactaattctgatggtagttccaccaaggcatgcggtttgacgtggacgtgcggttcaccaactaccgtgggtaattttgctaggaccttcaaatcttctgtaaccacctgttcgttgaaaatgtaaatgtctaaatcctcaattgacagatagtttttttatcaatgatatcaaggaaacgcttaattacttagtgtaatttcctgagaccacgtaacaaaccgcatttttagattccatataataaagttcccccaatcttcgtgttattagataaccccagttaaggtaccatccccatcactgctttttactcgctgccttttccaaaatccgcaaacgttgcatcacgttcttatactttaccagattggtgctcccactctttagcagttcatcacggtgcactcccaaccgccaacggtaagccttcaattcttccgttatatccatccccagcaaagccatcattgtaacccgctgttcaattgcttctagtgggtagacgttggcttgactcgtttcccgggtcacactattggtccgctttcggtgcatgtttaggggcttattcataaaggccagccggtccgccaataaataaacttgccaggtggtcaaatcatcttccacggcccggtcggtcgggtaggcgatctggtcaaacaattcccgcttgtaaagcttacctcacggcaccgtaaaacactagctcaggttaaaatgcatattatactcttcggcaaaccactccgccggggtatagaccttttcatagtgatcttcctcgcgcacccgaaaatagaatgtttgcttgtcttcaacaaattcataaaaattaccgattgcaacatcggcgtgatgacgttgcattaaatcaaccaattcggctaaattggtcggttccatccggtcgtcattatcaacaaaggctagtaactcgccggttgccatcgctaatcccgcgttccgactgtcgccaacgcccccgttgggcttatgtaagacccggacccgggaatcttgggcgcggagttgctcacaaagcgccgcactgcggtccgttgaaccgtcgttgaccaaaatcacttccaggttttggtaagtctgatttaagaccgagttcacgcaatccactaaatatttttcgtcattgtagaccgggataatcaccgaaaccatttgcgctatttttccatctccacttttattaattacaatgttaacaaaaattccttattttataccattagctgtaatccatatcaaaaccatttaagttatcacctaattccagcaaaagttgtcgtgaaaaaaggtttccccctaatcgacgaaaagaatcgtaatagcggataaacaacataaaatttaagggcatcaatatcccagcaatttttggagaaggataaataaatttgccgtccttaagagctacaaaatttgtaaacaaaacatcattatttcctttttgacgagtattcattaacttagtaaccgtatccggcgcagctaaaaagtcctctgcctcaataaaaaggatatagtcgccgatagcttgcgcaagcccaacagtttttaaattctcccactttttactactattttgcaatcggtcattggtaacttcgtagcaatttctggatcgttagaagctacaatcacttctaaatctgggtaatcttgttctaaacaggtttcagcacatcttttcagtccgttctccgtcccgttagttaaaattattaatgatactcgcaccacgttagtcctccctcgtaatatttacccgctgcttaccctcctacatttcttttatcagcttccgcacataacctgctaaatcctctggggtaggaaaaaacatggcttgattattttgataatcctctcgttgtaacgccaaaatcggtttaccagtcgcaaaaaaacgttcttgcacactttcatcacgttggatcagtgttaaatccaacattgctacactggtatcaattaattgcgttaatgctgctggcaagatcgtctgatgcaaattaacattcggataagctactaaacgctttaactcaaaactcataaaaacaggagaagcaatctcaaaatcaacctccggcaaaagcctaatcagctcctccaattgatttaattccgcccaagctgtatacaacaatagtttgggtcttactgatttgcttattacgcttaagtgattaccaatcatttgccattctaggttgtgatactcccaccattgcatacgtccgcgcacagttgacaaaaaattccacggtttgtcactacctgtatagtgatcaattaccgcatcattcactactaactgatcgtacgggggccaaccaaactgttcgccaacccgttccaggccaagctgattgttgaaacgagccggtaattcagtaatcgcaccttcacaaacgcgattaagaactgtttgatcaccattatcaatctcattttcatggctagagaaaaaatcgatgcaacgacgagttaaatctgctgtctgccatcgttcataatcaatagcactcctgtgttatacggtgcacaattgatttcatgagccatacccaccggttgcccttgtaaatcgaattttaataatggccacagactatgccgaacaatcacatcactatcgagatagagaattctctttgcttcaatcaattgcggcaggtagattcggacgtaactgtatccattaatgtgttgccacgaaactttgccaatcgccatttggttaagatcaatttttaagtcatggagctggctccctactggcgacaacttttgattaatattccgaaaccattctggtggaatatccatatttgctaagtaaacatggacattaggagtatgataaaaaattgattttaacgtcgtttccaaggccgttacatagccatagtccgcagccaaagctactacataatcgtgcattctttccctccaaattcacttactacttaactaataatttttctaccacttccaccaacatccgcttaaacatatagccattgcgcaacaaatagccatagtccttagcattttgggccatgcgctgatagtcttcggccgtgcaattttggaccagctggtcagcttccgctaaactttcggctaacaaccccaaatggcggtccttaatcaattcggccgcggcaatgtcagcattggccactacgggtagccccgctgccaagtaggtactgagcttataggacgcattgaggtgggaatattgccgttctggctgttccggggtatcgatgctccagcacaggccaaagccgccgtccaacattggtaacagggcgctttcgggatggaacccgacgtagtcaatgttttggtcgggatcggcctgggcatcagccgcaaataaccgcaagcgggtctgataagaccattcccgggtaaagggaaagcggctttgactgcctaaaaaggtcagttcccgccgaaacgccgccatttccggttggtaagtggtggggtgatcccacaggtgttggtaaacgatattatcaaccgtgagtccctcggcccttaagcgcgcagccatattttcacttggcaaaatcaacaggtcggcttcattgaaaaattccacgtacggccgcatccagtcagcataattttggctaaacatcagcggcgggacgtcttgaatgaagaaaacaatccgcgtttggtaaaggcgcagctggttgaggtactgccgctcgaattccagcccgttccacgtcgggagctgaaagatcacaatatcacccatctgcaaagaggcattgatgccgtcgatgcgcacccggagttgttctggcgaatcactggcgacattatagcgatagatggctaattcattagccccctgatccttggccagctgagccgttacattttgtgccgcttgggcggtactggtattcgccatgccgtagaggttggtaatattaatcttcatttggttccattccttcctgactaagatcggcgacaatctgggcggcatatgctggcgccgcgggcaaagtaatgtcttcagcaaagttatgttccatcgtgtgcttatggctgagctttaccttgctggtcgcccccatctgaaaccactcgtattcggaatcaatgtagccaatatccactaattgcatccccgttaccgccaattcgccaaccaaggctttagcagttgggccaagcatcaataagaccagcttgccgggcccatatttttttaatcgcggccttgagcacattgtactgagcaaaggcattatgcgcggggccaagaatccgctgcaccgacttggcattggcaaataaatcattcctcacccccgaccgggacagctgcccttcgacaatcaagatgtcgcggtcgtcccatagttgccgcagcttcgcaaaatagccctgggccaagcgcttgtcttgccaattcatgtagggacgggaaataaaggtgttgccgtaccagtcgacattggctcccatcaactgataaattgcggcgttggccggccgattctgagcccaaaaggcctgcgctgccggggtgtagcgttctaagtggctaaagacgtccgacatgcacaccaccagctccgggtggctcggcgtatacaacagccgtttcaaacgttctactagcgctgggtcgtaaacctggtaaggaatatcgcgtcccgcaatcaggtcaatctcgccatcaccaaagcgagcgactgatgaatgatgcgccaaaatataatctaaggtttgatcaatatccttgaccgtgaccccgtaaagcggctctgttgccatcactatcctccgatcgattaattgattagttactatgataagtagtcgatcagcgaaagtcaatcggctttcgccaaccaatgacaattcctctaaattgtctcacaatttagctaacgctttcattcaaattttacacccttttttccgttgttacagcaaatcccccccatcgcgcttatcccaaagaaaaagcctgaaccctaaatggattcaggctttttgactggcaaacacgcttatttatcgttatgatcccggcgtttcttgcggccgagcaagccggctagcaagatgcccaggccacccagcaggccagtagccggggcagattcattcccggtttgcggcagcttttcaacggccttgccggtcttcgttgcgctcgggtcaactggacgtgctaagttgacgtagttatccgtgttcgtcgtcacatgcgatcccagttggctgattgattcagaatcgtacttcgccaaaccgtcatcagaaagactggtcgtctgtgaagttgatactgattgggagtcaaccttgtgactgtctgacccactgtgacttacagactcacttgcgcttgttgatgcggattcgctggcactagtagaagcggattcacttgcacttgtagatgcggattcacttgcgctcgttgatgccgattcgctagcactagtagaagcagattcacttgcgcttgttgatgctgattcacttgcgcttgttgatgcactttcactcgcactcgttgaggctgattcactcgcgcttgttgatgcggactcgctggcactcattgatgcactttcacttgcacttgtggatgcggattcgctggcactcgttgatgcactttcacttgcgctcgttgatgccgattcactggcactcgttgatgcactttcgctagcactagtagaagctgactcacttgcacttgtcgatgccgattcgcttgcacttgtcgatgctgattcgcttgcgctcgttgaggctgattcgctagcactagtagaagctgattcactggcactcgttgaggcactttcacttgcgcttgttgaagccgactcacttgcgctcgttgatgcactttcgctggcacttgtcgatgccgattcacttacgctcgttgaggccgattcgctgacactcgttgatgcactttcacttacgctcgttgaggccgattcgctgacactcgttgatgcactttcacttacgctcgttgaggccgattcgctgacactcgttgatgcactttcgctggcacttgtcgaggcactttcacttacgctcgttgaggccgattcacttacgctcgttgaggccgattcacttgcgcttgtggatgcggactcacttgcactcgttgaggcactttcacttgcacttgtcgatgcagattcgctggcactcgttgatgcactttcacttgcactcgttgatgcactttcacttgcacttgtcgatgcggattcacttgcacttgttgaagcggattcgctagcacttgtcgatgcggattcacttgcgcttgttgaagcggattcgctggcgcttgttgaagccgactcacttgcactcgttgaggctgattcacttgcactcgttgaggcactttcgctggcgctcgttgatgcagattcgctggcactcgttgaggccgattcgctggcgcttgttgaggccgattcgcttgcacttgtcgatgctgattcacttgcactggttgaagcagattcgctggcactcgttgaggcactttcgctggcactcgttgaggccgattcacttgcgcttgttgaagctgattcacttgcacttgtcgatgctgattcacttgcgctagtagatgccgattcgctggcactcgttgaagcagattcacttgcgcttgttgaagccgattcacttgcgcttgttgaagccgactcacttgcactcgttgaggcactttcgctggcgctcgttgaagcagattcgctggcactcgttgaagcagattcgctggcgcttgttgaggccgattcgcttgcacttgtcgatgctgattcacttgcactggttgaagcagattcgctggcactcgttgaggcactttcgctggcactcgttgaggccgattcacttgcgcttgttgaagctgattcacttgcacttgtcgatgctgattcacttgcgctagtagatgccgattcgctggcactagtagaagcagattcacttgcgcttgttgaagccgattcacttgcgcttgttgaagccgactcacttgcactcgttgatgccgattcacttgcacttgtggatgcggactcacttgcactcgttgatgcactttcacttgcacttgtggatgcggattcgctggcactcgttgatgcactttcacttgcgctcgttgatgccgattcactggcactcgttgatgcactttcgctagcactagtagaagctgactcacttgcacttgtcgatgccgattcgcttgcacttgtcgatgctgattcgcttgcgctcgttgaggctgattcgctagcactagtagaagctgattcactggcactcgttgaggcactttcacttgcgcttgttgaagccgactcacttgcgctcgttgatgccgattcactggcactcgttgaggcactttcacttgcgcttgttgaagccgactcacttgcgctcgttgatgcactttcgctggcacttgtcgatgccgattcacttgcgcttgtggatgcggactcacttgcactcgttgaagccgattggcttgcactagtagaagctgattcactggcgctcgttgaggctgattcgctggcgctcgttgaggctgattcactggcactcgttgaggccgattcgctggcgctcgttgatgcagattcgctggcactagtagaagctgattcactggcgctcgttgatgccgattcacttgcacttgtcgatgcggactcacttgcactcgttgatgcactttcgcttgcacttgtggatgcggattcgctggcactcgttgatgcactttcgctagcacttgtcgatgccgattcacttgcactcgttgatgcactttcgctagcactcgttgatgcactttcacttgcacttgtggatgcggattcgctggcacttgttgatgcggactcacttgcacttgttgaagccgattcactggcgctcgttgatgccgattcacttgcacttgtcgatgccgattcactggcgcttgttgatgcggactcacttgcactcgttgatgcactttcacttgcacttgtggatgcggattcgctggcactagtagaagctgactcacttgcacttgtcgatgccgattcactggcactcgttgaagcactttcacttgcgcttgttgatgcggactcacttgcactcgttgaagccgattcgctagcacttgtcgaagctgattcactggcgctcgttgatgctgattcactggcgcttgttgaagccgactcacttgcgctcgttgatgcactttcacttgcgctcgttgatgccgattcactagcactagtagaagctgattcactggcgcttgttgatgcagattcgctggcacttgtcgatgccgattcgctagcactagtagaagctgattcactggcgcttgttgatgcagattcgctggcacttgtcgatgccgattcgctagcactagtagaagctgattcacttgcacttgtcgatgccgattcactggcgctcgttgatgccgattcgctggcactagtagaagctgactcacttgcacttgtcgatgccgattcactggcactcgttgatgcactttcgctagcacttgtagatgcggattcacttgcactcgttgatgcactttcactggcactcgttgatgcactttcgctagcactcgttgaagcactttcacttgcgcttgttgatgcggattcgctggcactcgttgatgcactttcacttgcgctcgttgatgccgattcacttgcgcttgtggatgcggactcacttgcactcgttgatgcactttcgcttgcacttgtggatgcggattcgctggcactagtagaagcagattcacttgcgctcgttgatgccgattcacttgcgcttgtggatgcggactcacttgcactcgttgatgcactttcacttgcacttgtggatgcggattcgctggcactagtagaagctgactcacttgcactcgttgaagcactttcacttgcgcttgtggatgcggactcacttgcacttgtcgatgctgattcgctagcactagtagaagctgattcacttgcactcgttgatgcactttcacttgcgcttgttgaagccgactcacttgcgctcgttgatgccgattcacttgcactcgttgaggcactttcacttgcgcttgttgaagccgactcacttgcgctcgttgatgcactttcgctggcacttgtcgatgccgattcgctggcactagtagatgcggactcacttgcgctcgttgaagccgattggcttgcactagtagaagctgattcactggcgctcgttgaggctgattcactggtactcgttgatgcactttcgctagcactcgttgaagcactttcacttgcgcttgtggatgcggactcacttgcactagtagaagcagattcacttgcgctcgttgatgccgattcacttgcacttgtcgatgccgattcacttgcgcttgtggatgcggactcacttgcactcgttgatgcactttcgcttgcacttgtggatgcggattcgctggcactagtagaagcagattcactggcgctcgttgatgccgattcacttgcacttgtcgatgccgattcacttgcactcgttgatgcactttcactggcactcgttgatgcactttcgctagcactcgttgaagcactttcacttgcgcttgttgatgcggactcacttgcacttgttgaagccgattcactggcgctcgttgatgcactttcacttgtgcttgttgaagccgactcacttgcgctcgttgatgcactttcacttgcgctcgttgatgccgattcactagcactagtagaagctgattcactggcgcttgttgatgccgattcgctggcacttgtcgatgccgattcgctagcactagtagaagctgattcactggcacttgtcgatgccgattcactggcgctcgttgatgccgattcgctggcactagtagaagctgactcacttgcacttgtcgatgccgattcactggcactcgttgatgcactttcgctagcactcgttgatgcactttcgctagcactcgttgatgcactttcacttgcgctcgttgatgcagattcgctagcactagtagaagctgactcacttgcacttgtcgatgccgattcactggcactcgttgatgcactttcgctagcactcgttgatgcactttcacttgcgcttgttgaagccgactcacttgcgctcgttgatgcagattcgctagcactagtagaagcagattcacttgcgctcgttgatgccgattcacttgcgcttgtggatgcggactcacttgcactcgttgatgcactttcacttgcacttgtggatgcggattcgctggcactagtagaagctgactcacttgcactcgttgaagcactttcacttgcgcttgtggatgcggactcacttgcacttgtcgatgctgattcgctagcactagtagaagctgattcacttgcactcgttgatgcactttcacttgcgcttgttgaagccgactcacttgcgctcgttgatgccgattcacttgcactcgttgaggcactttcacttgcgcttgttgaagccgactcacttgcgctcgttgatgcactttcgctggcacttgtcgatgccgattcgctggcactagtagatgcggactcacttgcgctcgttgaagccgattggcttgcactagtagaagctgattcactggcgctcgttgaggctgattcactggtactcgttgatgcactttcgctagcactcgttgaagcactttcacttgcgcttgtggatgcggactcacttgcactagtagaagcagattcacttgcgctcgttgatgccgattcacttgcacttgtcgatgccgattcacttgcgcttgtggatgcggactcacttgcactcgttgatgcactttcgcttgcacttgtggatgcggattcgctggcactagtagaagcagattcacttgcgctcgttgatgccgattcacttgcacttgtcgatgccgattcacttgcacttgttgaagcagattcacttgcgctcgttgaggccgattcgctggcactcgttgatgccgattcgctagcactagtagaagctgattcacttgcgctcgttgatgccgattcacttgcacttgtcgatgccgattcactggcgcttgtggatgcggactcacttgcactcgttgatgcactttcacttgcacttgtggatgcggattcgctggcacttgtcgatgccgattcactggcgcttgttgatgcggactcacttgcactcgttgatgcactttcacttgcacttgtggatgcggattcgctggcactagtagaagctgactcacttgcacttgttgaagccgattcactggcgctcgttgatgcactttcacttgtgcttgttgaagccgactcacttgcgctcgttgatgcactttcacttgcgctcgttgatgccgattcactagcactagtagaagctgattcactggcgcttgttgatgcagattcgctggcacttgtcgatgccgattcgctagcactagtagaagctgattcacttgcgctcgttgatgccgattcgctagcacttgtcgaagctgattcactggcactcgttgatgcactttcacttgcactcgttgatgccgattcgctagcacttgtcgaagctgattcacttgcgctcgttgatgctgattcactggcgcttgttgaagccgactcacttgcgctcgttgatgcactttcacttgcgctcgttgatgccgattcactagcactagtagaagctgattcactggcgcttgtcgatgccgattcgctagcacttgtcgaagctgattcacttgcactcgttgatgctgattcacttgcacttgtcgatgctgattcacttgcgctcgttgatgctgattcgctggcacttgtcgatgccgattcacttgcgcttgttgaagctgattcacttgcgcttgttgatgcggattcgcttgcactcgttgatgcactttcacttgcgctcgttgatgccgattcgctggcgctcgttgatgcactttcacttacgctcgttgatgcactttcacttacgctcgttgatgcactttcacttacgctcgttgatgcactttcacttacgctcgttgatgcactttcacttacgctttttgatgccgattcgctggcactcctcgttgaagcggattcgctggcactcctcgttgaagcggattcacttacgctcgttgatgcgctagtcgaagtactcgtcgaggtggattcctgttcactcttactcgtcaattgacttggaatcgtcgaatcaactgaatgagtatcctgatcgtagttgtagacttcttgaccaaccaattgaccttgcaagtttttccaagtatcttgccaagagttaataattgcataaccaccagaaaatgccccattataatttcctgctgcaagattagcttggtcagcattactatgttgagtcgtaaaggtaactgtaaaagaagcattcatggtgttgttattatctccccaagattggaaatacatagccgtcccaattgtgtccttattgaaaccagtggtaaatggtgctgtgtttaccacaatatctttggtattttgtttgtctcgtactgttgcttcatcaaattcattattataagcaaaagaataaccaattttatcatctttatagcttcccttgcccgaaaagaccgagttatcaaagtcgctatttgacatatgccaaatatctgcataccgaccatattgatagaaatcattcttgacgtcactaattactccatttgtcttattaacgttctctggcttaaatgtgatatcattttctggattgacatcccctgaattgagatcacttggcgattttcgtaccttcagaccacttgttagtccattattacccaaatggctgtaagtcgttcctggttgtaagctaatatggacattcacatcgctaatgattttgtaatccttagttaggtaaaaacccatttggccatttctcaaaccataattaagaggattgtaaccttcataccatatcccttttttaggatagaaggtaactgtccactcggtttttccattacctaggtcttttgtctgtatattaacgttgttcttagcataatcagtagtttgaccagtatcccgagtagtataagcattgatatcccaccataatcggttgtttttatctccggcaatccacttgtatttatcgttgccattacttccccaataagcaggcgtatcccccggtttcgtattggtatcgggcgtccccaaccccgagctggctgggatatttgccaacaccattgtgcccaattggttgggctcgaacaccgtcatcaacgattgcaattcactcaaaccatggctggcatcactttcactgacttggttcttggccaagacgtcttggtagtgcgcaatggccgcttggtaggcttgctgatagtcgctggccgcatttttgtaactgtccgtggccataaaggtattcgcctgagctaccagttgctttaatcggtcaacattcgacgtggtcggcgctgtcgtatccaccaggctgttcgcattaatcgtttgactggttgcactcgtggccgtccccgacatcgtttggctggtggtactcgtcgtgctggccgattccttgaccgaagtcgaattgctggttaaggacgtactggtactcgtggcggacgtcgacgtgctggtttcactagtggatagtgagcccgaagtactggtcacttggctcgtagtgccttgattgttggaggaagtcaaactaacttgatcggtatttgccaaggcactgttcgcggcattattcgtggccgtcgtttggacccccgtggtcgtggccgccaacgctccggttgaagcaaccgtgccgcccccaatcattgccccggcggctaagacccctttcagcaaggtcgccgactttgaatccaagttcgcttctgattcatccaattgcaccttgtgtggtgccgaatgcgttgcgatctttagtaaacccacccgggttaacaaacattgcacccattgcttccctgacttgtacaattttacccgagtagtccgggagctttcggtgatcgtttccttttttgtccgtttcaagatcccacgtcctttcatttctttatgtacgcttctagtcagttgccttgcgctcaatatttatcaattgattaacccgtcctgcgacgctcgtcccaatttcaaacatttccgctaatcaggttaatcgcgagataaccatttctattatcactataagcactttattcattcgctttcatcagcttttcattgatcatatttaaaatgcttaataggtgttaaatagatagtaatctttttcaacatatttatcaacgggatattaaaaaaacttacaatttatttaaatattaatacctactgagtgatcaatatttataacttgaatcataattttgagtgctttttctcccgccacagccccgagtcttagggggccattgcgtcaatttatcaatggtctaggtggtgttttcaccactcattagcttcatcatcttgttatgtaggaatggtctattttagcttatgataatttataatttttcgccgggggccggccgaccattaattttgcccttggtaccaacaaccgaatgtattgatcgggttacattttgctcccctggttccgactaaagataattaacccatccccggagtcaaacttgctttggcgcgggtcaaccatcccgtcgacatattttctcatcgaattctcatttaagtcttttcaatcccagcgaaacctgctatgctaaccccactagctgcaaagcatgctcaaacaactggattggaggagatcatatgcgcaaaattactgtgaattcggactttaccttgccagtccgcagtgaaaaacaaatcgccagcaacgttttgaaaggctcgctggggaacctgatcgaatggttcgattggtacgtctacgcttcctttgctatctacttttcgggcgcattctttcccgctcacaaccccacggcccaactcctagctgccgcgggggtctttgcgatcggctttttcatgcggccgcttggttcgttaataatggggcgcctggctgatcgccatggccgccgtacggccctaactatttcagttgtaatcatggcaacgggctccttgatcattgcgttcgtcccgacctatgctaccattggcatctggtcgcccctgattttgattgccacccgcttattgcagggcctgtcgctcgggggcgaatacggaacctcagcgacctacctgtcggaaatggccagtccgcaccaccgcggcttttacgcttcctttcaatatgtcaccctgattgcagggcaactgttcgccttgctggtgcaaattgtcctgcaaagtttctacaccaatgcccaactgaccgcctttggcattagggccatcggggccttggtcattgtgtcggggtacacctcagcttttaagagtttcgttttccttttttagctctttaagcttagactgatttgcttgataatttgcttctaatttttcaatttcatcattcaacttagcaagagtattaggagtaagtaccattcctgcaagcatcttaccttgctgaagagtaattgtttttttggctttgtcgttcacagataataaatattcataattatctaaaaattgacttaatgaaaccatataggtttcatgtaaatgttttcttagcatttaacttgccttcgctttctaaaaatttgttaaggctatttgccttaacaaacttattctaattggcagattgcaagaaataacttgaacgaatttagtgacgtaggttaagcaagaagatctcgattggtgtgcgccagttaagacatttaagtggccaggaattcagataccaactgatttgaaccagctggcgatcgctcagctcttcaatagcttgtcccttgggaataaatcgtcgcaaaattcggttacggttctcattactaccgcgttcgtgcggtgaataggcatgggcaaagtaaacctgagtacccgttagctgttcaattgcctgataattagcgaactctttaccatgatctacggtcagcgtcttgagcttgtcttgaagttgactagctagttcaagtacggcttgagtcatgaactgactgtcgcggccatggagccgtttaacaattgtcaggcgactcttacgctccacaaaagtagccacagcttgacctttacgtttgccagaaagtacggtatcagcttcaaagtggccgaactcctggcgagtttcgactttatgaggacgctcctcaatggagcggccgtgactgaacgtaccccgcttttctttagcacgatgacgacgaattccatgatcaggcaaatcgggtagctgtacatcaagccagccttgatcaatccagttatagaccgtcttgtaggcaatccccaccacatgggtaacttgttcaggggaccacttctggacttgaatcttttcctcaatcaagtgcttaaggcttttagtgagcgaagacttccacccccgttgactaaccttgcgttcaaagtcagtttgcgctagctcagcccggtactcactatttagccggtgaagttcgttaaagatggtggtcttactaaagcctaagtagttagcgatgtatcgcaaggaacgtccttcactaagcgtttcaatgacaacacggttctggaatgataaaatagcggtgctcatcaaggtccttctttctaatggattgtgtggtaacaccattaaagaccttgatggttttttctgtccacttaaatgttcaacttaaattttacaatctgccataaagaaaaatcctcctgtactgaatggtatattttcagtataggaggattggtcgaccgcgcctagacgtgtcgttattgactgcttaccgtttgttggctactaaaaagggcccgaccctaaccgtaattggttagggccgggccctttcttatgcgttgcgcggtggtaaattaattaccttagtcttcgcgcttcttcttcagaccgagcaagccgaggaaggctacgcccagcccactcaacattgcccacgtagctggttggtccccagtctgtggcaagtgttgttgtgcttgttgcttagttgcggtttggttcgttgacgttgcgcccttcgtttggccaccattggtcccaacacctggctttatcgccgagccagtagtcgcttcagtcacgtgcttgtgcaggtttgcctgcagcgtggtcgtgctaccgtccgcaaaggtaacttgtacgttcccggcggtatcaaccgtgatcgtcgcaattggggccgttgggttggtcgtctgaattgcttccttgacttggtcttgttcggcttgcgtcaagtggttcggatcaaccacgttgaccgcttgcccagggttcagtgggtatttatccgcatccgtcttgcccgttaccaagtcgtgacctgaaatcgtattcgtggagccatccgggtacgtgatggtcgtcgtcccatcgtcaccgaccgtgaccttcgtcccatccggcaggttcgagttcgcttcgtcaaccttgtccttaacggcgttcttttcattatccgttaacttggttgggtcatcaaccttcaccttgtcaccgcctggtacgtttggcgtgttcttatcagcgtcactcttgccttcaatgacctggtcacctgggatcgtgtccttcgagccatctgggtaggtgatcgttacgtcaccgttgtcactgaccgtgaccttgctaccttctggcagcgtcgacttgccattctcatccttgttggcgtctttaatggcttgttcaacatcggacttttcatcttccattaacttgttcgggtcatcgaccttcaccttgtcgcccggtaccttcggttcgttcttgtcggcatcagtttggccttccgtacccttaccttcaacgaccttgtcccctgggatcgtgtccttggagccatctgggtaggtaactgttacgtcgtcgttgtcgccgaccgtaaccttgctaccttctggcagcgtcgacttgccattctcatccttgttggcgtctttaatggcttgttcaacatcggacttttcatcttccgttaacttggttgggtcatcgaccttcaccttgtcgcccggtaccttcggttcgttcttgtcggcatcagtttggccttccgtacccctaccttcaacgaccttgtcccctgggatcgtgtccttggagccatctgggtaggtaactgttacgtcgccgttgtcgccgaccgtaaccttgctgccttctggcaacgttgacttgccattctcatccttgttggcgtcttcgacggctttaactacttccgacttttcgtcttccgttaacttgttcgggtcatcgaccttcaccttgtcgcccggtaccttcggttcgttcttgtcggcatcagtttggccttccgtacccttaccttcaacgaccttgtcccctgggatcgtgtccttggagccatctgggtaggtaactgttacgtcgccgttgtcgccgaccgtaaccttgctgccttctggcaacgttgacttgccattctcatccttgttggcgtcttcgacggctttaactacttccgacttttcgtcttccgttaacttgttcgggtcatcgaccttcaccttgtcgcccggtaccttcggttcgttcttgtcggcatcagtttggccttccgtacccttaccttcaacgaccttgtcccctgggatcgtgtccttggagccatctgggtaggtaactgttacgtcgccgttgtcgccgaccgtaaccttgctgccttctggcaacgttgacttgccattctcatccttgttggcgtcttcgacggctttaactacttccgacttttcgtcttccgttaacttgttcgggtcatcgaccttcaccttgtcgcccggcacctttggttcattcttggcggcatcgctcttgccttccaccactttgtcccctgggatcgtgtcgactgaattgtctgggtaggtaatagtggtatctccattgtcacccacagcaatcttggttccttctggtaagccggtgttgtgatcacgaatgttgtcttcgacttctttcttttcgtcattagtcagcttcgttggatcatcaaccttggtcttggctggaaccgttggatccagcttttcagcactagtcttttcttcaaccagctgattaccttcgatagtgtcgactgacttgtctgggtaggtaatagtggtatctccattgtcacccacagcaatcttggttccttctggtaagccagtgttgtgatcacgaatgttgtcttcgacttctttcttttcgtcattagtcagcttcgttggatcatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagctctgctgaagtctttttgactacatacacatattcatcgtgatgatcaatagtatatgttccatttacagtatttgcttgattggtcgccaaattatagtccgttggtaaattgacatcataattataattttctcccaatttaccactaatcttatctgttgctacttcttccccatctcccggcacaaaaatagaatttttactcccagttacatcgatataatgaactctaacttcagacttatcttcactaccatcctttgcataatagtaaacaataccatcattagttgatgtaatctgatttatatatgtgtaccattttccatgcgaaataaacgacatgcgatcgttaacatttaacttgttccccaagtaacgtgtcgtattattaagcacttcaccatcataatacgcagtaactcgaaccaacccttgagcgtcaattactgtttgctttataactacatgtttatcaagtctaaaatcatacgattcacccactttatatggggagatatatcctgtggtctctggcgattttttcaatgtatatccatcaatagttggtgcctctccggtaattgtgtatttctgataagcaacaccttcaaaagattttggcactgcaatttcgtctcccgttgcttgatcaatataatgaatcgtagttgtcattttcgttggtattggagtcatcacaaagccatttcccattgaagctgggtctcccttaattccggtattgtgaccatatgcaaaaccaaccaccatgccatatatattatcgcctttttcgatcccatcaagatcaattgaagcactagtcccatcataattagtaaaaattggagtatgagtagttccactatactcaaccttctttgattcaccaggtgctaccactgcttcttgtatatttttacccaatccagtatgcaaaattgttacatataaactattatcattcaaattatttgagcgggccaacaaatagatagcatggtaatgttcattatagttagcaacaccggcaaagtagtatctcccgctctcatcgttggcagtgtggttttgtaagatttcctttattttttctgttgaagtgtcctgataccacttcaggttattgtatacccagttatccgtgggcttattaattatctccgttaacatgggctgggaatccagcttaatgtcttggtttgaaatcggtaagctagcagtacctgccaccttcattactggtcgtgcagccagtactttaaacttggcggctgtaaacttggcggttgtaaacttggcggttgtaaacttggcggttatcttttgtgtagttggtgttgttgcgtcgttagccggcgttacttcagtatcttttttgtcgacattggtagtattttgcgtagtatcttggccttgcggagtatcttggtgatttgttgcctcttcagtatcggttgtaggtacttgctgatttacattttggccatttgcttgtttatctgtactatctccactagtctgcggcgtagatgttgtaccttctgttgtaccttcagtaaccttgtccttattgcccccttgagtcgtggtacttcgtgttacatcatcactaggactagtaacagtatctgctaataccgcatggttgccatatagcataaaagttgtccccaacaatactgatgctactcctacagataacttccgtattccccaacgttgcttcctttcggcatgcttttgttggtagaattgatgattgtttttcgaaaccatatccgttcctcctaagctcataaaatatatatacttatcacactcttagtgtatcatatacttcgtataaatctatcaaaaaaacgattcctaaatttcaagaataagttagccactggactcaaataaataatactgatcaattgattattggtcgatggagctgtgatatctcttggtagaaggccttacgatagatatccattgacgaatgtccattaaacatagctcgtggatagtgattcatccaatcattagtcgctatgatctgagcactactatagttatttataacttcacctttggtaatctccttgcggagaaaccggttattgatctcattggatccgcgttcccaaggagaatatgggtcagtgtaaaaaacatggtcatgaactcgcgttaactcactaaattcagaaccattatcagaagtaattgttttaaaaatgcgatagtaagcattcttgccaagcttctgacgcaactcaacaaaaaaatgattcactgcatatgcagttttactggtaatttttctcgtaatattaacccgtgaaaaacgatcagtcattactagaacaacgctatccttgccatctttatgaccttgaatagtgtctagttcccaatgaccaatttcggaccgttggtccgcaacctgtggacgttgagcaatgttaggtcctaagcactttttggcttgtgaatgagattgatggtgtttacgtttagttttctcaaaaaggtccaagttagacgtacggaatacaccatcattaatccactgatacaaagtcacaacagacttagggatcagtgaatcatcactcatcaaatcacgtgccttataaatagccgcttgaggagagtaacgatgctcatcaaattcaccaagcattaattggtcggccaattgtaaaaaacgctttgagcggtaatataaacgaggacgaccggaccgttggtggcatttaagataaatattctgaccagcttcataactgtagatgtgataagggtaatcgtaagtcttaccattgaatttttgacgacgaatttggcgaactgtaccacgtttaagctcattattaatggtttggtggttcactcctaattgacgaccgattgcgcgattggaaagtccttgcgactttaaagtcgcaatcatcactctctcttctttagtaaggtgtgcatatttgcgataagtggccaaaaggttagtgagcatggtatcatttaagtgcgtcatttgacggacatcctttcatatagttttgattcacttaatatgatacctgatgtcacgccgaatggcgtttttgcatttaccaccaattaggtggctaacttcattctataatccaccgttttaatatctttttgaaagcgtcttccaatcgctaaccaactaatagttaattttcttaagtcagtagggaaaatgggcccaccatgcggcccgaagccacaaaaaaagccccccgccagcagcaatcaggccgcaagcggggggcttttcggtgggggccgaggcctcaaccaatcccttataagttgctaaaatcagttttatctaaatctgtatccgggttaacttttggccaactgtcaaagtgccgcaaccaccatttgtaattatcgtcggcgacttggtagaacaagcccgtggacgagatccggtacttggtaaagccgttgccgacttgatccatcgtgccaatgattggcaccccatagaagtactggtggtccatgtcaataatcgtggtaaagtgcccactcttggcctctttgtcggtaaagaagccttcaaagtacttaatcccttccatcaggactaagcgtgattccatatcggccaagtactccggcgttaaatgttgcgaaattaccggtggattcccggacggataagtgttttcgttgtaccccgccgtcatggtatgcggcgccaacaacacggcaatcgatcccaagtgggagtaaccggcaaattgcggcatcagcccagcttggtattccgctaacgcatgcacggccaacattgccttgcgcttatcattgaggggcgctaattccaaggggtgttcaccgatggcaaagcgcatcaagttgacggtctttaacatccgctgactgtaagcatccgccaaattgaggagcggctttaacgcggccacatcggcatccgttggcaccgtccgaatcgccttggtgacatccccattgatcgcatcctggccaccacggccggcttccagttccacttgcaattgtccctttaagcggtccaccgtggccaccagctgatcataagcaggggtccccacttgcaagtaatctccaaccgttcggtattgcagatattccggatccagcggggccccttcataaacgctcccttggtatggcaaggtcgcattgactaattcggcccgttccacaactttcttcagtgtggtcgtgagtttgtagtgttcgtcagcatattggacataggtactggttcccggcacctgctcggccattagttgctccaaagcttcttgccgccgcacattattgtccgcgatcaatttatccgcggccgcttgggcggcttccgcactggtcaagacctcctgtaatgtggccgcttgactttcatactgataggcctggtcgggatcggccagcatcgcttgcgcgcccttgatgaagtcattgacccggttgatttcattgtataaggtcaaccgcgtcgcaactaagttttgcaaggcgatcacggcggcttccaaatcgcgccgcccctgcatttgttgggccgaactttggatatataaatccatccatcgtttcagtgacgcctgattatcctgaatcccttgcgtggtataagtctttagatttggtaagacattgatcccgtatgcttgcaagatgccttctgcggcctggcggtattcaggactgacatactgcaaggccgtttgatagtaggcgaccgtagctttaaattcattgatcgcatccactttggcctgctcggcgggactcaaaatcgcgccgtctaatttggcctgggtggcctcaacttgcgccacggcggcatccagcatcgcctgcgtcaccgctggcgtggtcatcagtttttgtaaggccgccacggcttcgtcatacggggcttgagccgtcgtcgtggcattgtgataccgcggatcttgttcccgttggtcataccgcttcagcaaaaccgtcgccacgttaaagtccgtagcctgaccatccaacgcagcttgagccgcatcgatttgcgcgatggcggcctgcatttgctccgccgtaacttgcggatcgtattgcaactggctcgcggctgctaaagcggtccggtaagctaattgcttggcagcatccgcattgtaatacgcggccgttgtcatcacgctttgacccgttaacaaccgccgttgtaacggttggagatcaattttcggttgagggcgaggggttggtttcacctcgtcgatcgactggggttgctcgtcgctggccccagaaccagacgttgggttgtcaccactcgtggctggtgtgtctgtcccagacgttggcgttttgctggctgtgctactgtccgacgtggctggtgcttccccacctggcgttgcactggtcgttggattgtcaccgctcgtggccggcgtgtccgtcccggacgttggcgtttcacccgctgtgccactatccgacgtggctggtgtgtctgtcccagacgttggcgttttgctggctgtactactgtccgacgtggctggtgcttccccacctggcgttgcactggtcgttggattgttaccgctcgtggccggcgtgtccgtcccggacgttggcgtttcacccgctgtgccactatccgacgtggctggtgcttccccacctggcgtcgcgctggtcgttggattgtcaccgctcgtggccggcgtgtccgtcccggagcttggcgtttcgcccgctgaggcactagctgacgtggctggtgcttccccacctggcgttgcactggtcgttgggttgtcaccactcgtggccggcgtttctgtcccggacgttggtgtttcacccactgaaccactatccgacgtggctggtacttccccgcctggcgttgcactggtcattggattgtcgccgctcgtggccggtgtgtccgtcccggacgttggcgtttcgctcgctgaagtactgccggacgttgccggtgcttccccacctggcgttacactggtcgttgggttgtcgccgctcgtggccggcgtgtccgtcccagagcttggcgcttcacccgctgaaccactgtccgacgtggctggtgcttccccacctggcgttgcactggtcgttgggttatcaccactcgtggctggtgtgtctgtcccagacgttggcgttttgctggctgtgctactgtccgacgtggctggtgcttccccacctggcgttgcactggtcgttggattgtcaccgctcgtggccggcgtgtccgtcccggacgttggcgtttcacccgctgtgccactatccgacgtggctggtgcttccccacctggcgttgcactggtcgttgggttgtcaccactcgtggccggcgtttctgtcccggacgttggtgtttcacccactgaaccactatccgacgttgctggtacttccccgcctggcgttgcactggtcgttggattgtcgccgctcgtggccggtgtgtccgtcccggatgttggtgtttcacccgctgaggcactgctggacgtcgccggtgtttccccgcctggcgtcgcgctggtcgttgggtgctcgccgctcgttaccggcgtgtccgtcccggacgttggcgtttcacccgctgaaccactgtccgacgtggctggtgcttccccacctggcgttgcactggtcgttgggttatcaccactcgtggctggtgtgtctgtcccagacgttggcgttttgctggctgtgctactgtccgacgtggctggtgcttccccacctggcgttgcactggtcgttggattgtcaccgctcgtggccggcgtttctgtcccggacgttggtgtttcacccactgaaccactatccgacgttgctggtacttccccgcctggcattgcactggtcgttggattgtcgtcgctcgtggccggtgtgtccgtcccggacgttggtgtttcacccgctacgccactgtccgacgttgctggtgcttccccgcctagtgttgcactggtcgttggattgtcgccgctcgtggccggtgtgtccgtctcggatgttggcgtttcgctggctgtgctactgtccgacgttgccggtgcttccccgcctggcgttgcacttgacgttgggttgtcgccgctcgttaccggtgtgtccgtcccggatgttggcgtttcgctcgctgagccactagctgacgttgcgggtacttccccacctggcgtcacactgaccgttggcttgtcacccttcgtggttggctgactcccttgatcaagcggggtggccgccattcccaggccaccaaaagtcccgatcggctcactgctccggcctgaactgacttgcggccacaggatcgcattggtcgttccgattggggtccgccagacttgcggtggcaagtttcgatcaatcagtttccgaccatccggcgtagtcatcgtcacgtggttgccgcgaatctttacgaccgttcccaccgggatgtggtactgatctccttcgtgcaaaccattccactccatcaaagtatggtaatcaatccccaaaacttgcgccaaggcccacaaagtgtcacccgcccggaaagtataggtttgatccgttggcgcaatgcggggcgcaatctccgccggcgtcgtcgctcgccacggtaacaagctcgccgcatcaatcgtggttaggcctaagcctaaggtaaacgcggttaagtcaatcgcaatccaatggtttcctttcttaactaacttgacccggtacaaccggtcagcaatcatttgatatttatgttccatttttctcccccttattttaaggataatttaaccaatggccactctgcttcaagttaattctaacttaatttcttgcttttttcacttattacgcgaaaaaagaggctgatcagcgatcaagcccctttcctcattggctaaattattcttttcgtttccgcttgctcaggcccaacaaccctagaacgccgagcaacgtcaagcccagcacacttgtttcagacgtttggttccccgtctgtggcagttcttgccttgccgttggggttccttggcccgaaggggtcgacgttgattgactcggtgccgttggttgagcaggctgcgatggtcctaccggttggactggttgaactgacggcgtaatctcaccaccgttggtcgtcttcaagtagtagaagatgacctcggtcaagcgaccatcggcccctttgatttcccgacgttcaaattggtgaccagtaatcactttgtggtattcatcaaaattcgtggccccgttcccctcaacgatgatcgaatccgcaattgaatgcccattttcatcataaatgttaaaaatataaatttatccccataatttgctattaaacccatttaccaatagctagataaataaatcatctttgttataacttatttcctgatcgagtaactaacttttcgctcttaatctttccaaagcttattcaaaaacccatcaaaaaaaaacgccaaacccccttgaatgggtttggcgttttagtcaactaaatttcgtttagccttcatcttttggcgtttgccgcttcttcttccgacccagcaatccggccaacagcaagcccaaaccacccagcagcccaccttggttggtagtggctccagtttggggcagcttgcccttgctcttgtcacgctgcgcggcggcttggtccgttgccgtttgatcccgcaagctgactggagcgctttgcccatgcttagttgccgacgtggacgatgtgagcgacgtggacgtgaagtcaatttcttcagaagcgtaatcatgcagtcccttcaatgagtcactttgtgaagtggacatgctcatcgattagatgcccgattgggaatcaaccttctgactttcgctggccgaaagactgtccgaagctaacgaagcacttgtcgaagctgacgttgaggcactcgtcgaagcactcgtggatgcgcttgttgacgcactcgtcgaagctgacgtcgaggcactcgttgacgcactagtagatgcactcgtcgaagcactcgttgacgcactcgtcgaagcgctggttgaggctgacgtcgatgcgctcgttgacgcactcgttgatgcactcgtcgaagcactagtagatgcgctagtcgaagcactcgtcgaggcactcgtggatgcgcttgttgacgcactcgtcgaagctgacgtcgaggcactcgttgacatgctttgactttgtaccgtgctcaatgacgcactttcactttgtgctgcacttaacgattcacttgtactaatagattccgactcttgccttttgcttgtactagtagattccgatttcttcagggaatgactagtgctagcactctccagttgacttggaatcgtcgaatcaatcgtcttattgtccttatttaaattataaacttcctgtcctactaactcaccttgtaaattcttccacccatcttggtaggagttagcaatcgcatagacccccgagaaagatcctttattagcccctgccgctaatttggcctgatcagcattactatgtttcgtcgtaaaagtaatcgtgtaagaagcgttttgtcccccggtcgtattcccccacgattggagatacatagccgtcccaatcgtactcttatcaaaggaagtcgtaaatggcgcggttccatttactaaatcaaatgatggcggattccctccaacatttgcgttatccatttcgttactataagcaaaagcatcaccatttttatcgcttccccggcccgaaaagaccgagttatcaaagtcgctacttgacatatgccaaatatcggcataccgcccgaagtgatagtacagattcgtggtgttaccgattaccccgtttgttggattaacgtccctgggcttaaatgagatgtctgattttggattgacgttccctgagtcgggatcatccgctgaatcccgcaccttcacaccgcccccggtcccttccagttggtaggtcgttcccgggatcatgctggtgtggatattcacatcaccaatgatttggtagtccttggttaggtaaaagcccatttgaccttgttgtagtgggtatttagaagccgctccccagcccttgtaccagaccccctggccgggataaaaggtaatcttccattttgtatacccgtcccccaagtcgcttttttcgactttaatattttccggtgcattatatagttgtttatcattgtcattaccaatagaattattacgcgcggtataggcatttaagttcgtccacagtcgatccgaccctacgatccacttataattaccgttccacaaagccgctgtatcaccagttgctgtattatcatctggcgttaaaaagttgtcactccctgtggctgaattagcatcaaaaagggccatttgagtggccaattgttcaggcgtgatcccagcatcgatcaccgtcatcaacgattgcaattcacttaaaccgtagctggcatcactttcagtgacttgattcttggccaagacggcttggtattgggcaatcgccgcttggtaggcttgctgatagacactggccgcgttcttgtaactgtccgtggccataaaggtgttggcttgggccaccagttgctttaattggtcgacctgcgatgtggtcgtcgtcgccgtggttgccatcaggctatcggtgctcatcgtctgactggtcgtactcgtggtcgtttggctgttggtactcgtcgtgctggccgattccttggccgaagtcgaattgctggttaaggacgcactggtactcgtggcggacgtcgacgtgctagtttcactagtggatagtgagcccgaagtactggtcacttgattgttggcggaagtcaaactaactcgatcagtattcgctaaggcactggccgcggcattattcgtggccgtcgtttggacccccgtggtcgtggccgccaacgctccggttgaagcaaccgtgccgccccccaatcattgccccggcggctaagacccctttcagcaaggtcgccgactttgaatccaagttcgcttctgattcatccaattgcaccttgtgtggtgccgaatgcgttgcgatctttagtaaacccacccgggttaacaaacattgcacccattgcttccctgacttgtacaattttacccgagtagtccgggagctttcggtgatcgtttccttttttgtccgtttcaagatcccacgtcctttcatttctttatgtacgcttctagtcagttgccttgcgctcaatatttatcaattgattaacccgtcctgcgacgctcgtcccaatttcaaacattcttgtcagagatattccacgattacgtttagttaataatttcagcgctttctttactcgttgttgcgactgtttagctggacgggcgtaggccccattgtggtctacacccaacgaaaagccaagaaacttcaaccgtagagggctaccgactttggttttatctgggttcactttaactttcaagcgcttttctagaaactgggtaatgcttcgcattactcgttctccggctcgttgacttttaacatagatattacaatcatccgcatagcgcacaaagtgatgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttggagatacttaatcattaagtcatgattaacgttatcaaaataggcttttaggtctaagtcgacaactcttcgatagccttgattataaagatctactacttttgcaatagcgtcatgggccccacggtggggacggaagccaaaactattatcagagaaaacacgctcaaagataggcgtaagaatttgggctacaacttgttgaaccattcggtccaccacagttggtattccaagtcttcttactccaccattaggcttcggaatttctacccgtttgactggtgctggtttatacttgccctcacgcaaactagcgatcagttccatcttattttctctgagatatggcagaaggtcattgactgtcatatcgtcaatgcctgctgctcctttatttctcttaactcgcaaataagcctgattaaggttattgcgatccaagactaagtcttggatagtgacactcatacctttaccttcaccataaccggtactacgcgcccttgtgtactttcggttttccaaacctatcctcgacaagcggtcagcttgttgttctgttttctgcgatcgtcgcacctgattacacctccgatataagttacaagttattgtcgttcagtccttaatctgattactcaaactactatgacctcggctgactcctgacttactcaacgctacaccactgtaccgcttgcttctgtggaaatttatcttattcctcttgtcggaagcttgtaagtcaggcctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagctcatggttccgactactacggcccatagcggactttcaccacctagctaatacccatgccgggcgcactacaaaaaaagcacccagctttcacactgggtgctttcgtcatatggcaaacattttggcaaacaaacatgttatttttaatgagttggtcaagttttagcactgccaaaatgccgatatatcgcgcttccaactctaagttacattacaattctattcgtattcgatcgtcgaaggtggcttactcgtaacatcataaagaatgcggttaacgtggtcgacttcatttacgattcggactgagatcttttgaagaatatcccatggaatcttagcgaaatcggctgtcatcccatcaattgaggtaacggcccggatagcaactgcatagtcatatgtccggccatcgcccatgacaccaactgaacgaatacctggtaagacagtaaagtattgccaaatttcttcatcaagacctgcttttttgatttcttcacgaaggattgcatcactttcacgaacaatttcaagcttttcaggagtaatttcaccaataacacgaattccaagacctggacctgggaatggttgacgccataccaattcatgtggaattccaagtttttcaccgagttcacgggtttcatccttaaagagcttgcgtaatggttcaattaacttgaaaccgagcttctttggcaaaccaccaacattatggtgagacttaattgtctgggcggtgtctgttccagattcaattacgtccgtataaagcgtaccttgagctaagaaatcagcatctttaatcttcttggcctcttcgttaaagacttcgataaattccttaccgataatcttccgcttttgttctggatcggtaataccttcaagcttacctaagaagcgatctgctgcgtcaaccttaataatgttaacaccaaggtcgcgactcaacgcatccatcacttggtcagcttcgttcttccgtaacaatccgtggtcaacaaagatacaagtaagttgatcgccaattgccttatgaatcaaaacggcggtaacactggaatcgaccccaccagaaagacctaagataaccctcttatcaccgacttctttgcggatttcatcaatctgcatgtcgatgaagtcatccatcgtccagtttgctttagcgccacaaacatcaaaagcaaagcggcgtaaaatgtctaatccgtattcggaattacgaacttcagtgtggaattgaacaccatagaatttacggtcattatcagcaatcgatgcgattggacagttcttactagtagcagtaacttcaaatccagctggggcttgagttactaaatcaccatgactcatccatacatattgcttctttggcaaacctttgaataatacagcctcgtcatcaagtacttcaatatctgctcgtccatattcggagttatcagctttttcaacctttccgccaaggtcgtatgacattaattgcattccataacaaatacctagaatcgggataccaagcttaaagatttctggatcgaccttgaatgcgtttggatcataaacactattagggccaccagagaagatgatccctttaggattaatctctttgatctcgtctgcggttaacttgtgagaaagcagttcggaataaataccgaaatcacgaagccgacgagtaatcaattgattgtattggctaccaaaatccaagacaatgatcttatcaaacgcatctaaattgatgtttgccacaatgacacttcctttgttcaaatttttattcttaaaggctagtttacaggctgaacatggcatggtcaatgattatttaatattccataacaaaaagacgggagctaaattttctcacgcctttttcgttagatggaattttattgaggatatttaattagtgttctaaatcaatatttaatagacgtaattcttcatcaactgcttgtgcctcaagtgttttagtatctttatcagtttttatcatttcgacagcctcctcatctcatttaatctgtatccttcttaagtggtctgtgagtaattgtcaataaaaatgagtcataaatatcacgtgcaaccgtttcgaacattgatacattaggattaaaaagatttattttttacttttactagatgttttaactagattttctaatgcagaatttgtaatccattccaaattcggttgatttgaatgcgctttctgcatttgataaaatttagttagttattttttacttgaggtgcaatatgtttattcggacaaaatatcttaaccaactaataaacagcatgaaccagtcaacaattaaggttcttgttggcgttcggcggtgtggtaaaacgactattcttgaccagtttcgggcaactctccggcgtcaagaaatttcctcaagtcaaattcaagtgatcaactttgaatatctcctagaaaatgaattatgcaatccagaatatctcttacaatttattcttgatcgacttagtaaacaccagatgaattatatcttccttgatgaagtcgaagtggttccccagtttgcccgcgttgtaaatgccctaaattcactctctaatactgatatctatattacaagttccaacaaaaccattttggagaaagaaaatcttcaacaaatgatttcttatactatcatccccgttttcccttgcagcttccgtgaatacataaaaaggaaccaacaagaagctgattcccaatcgttatatcaatatttaaatgagggcgggttcccctatactcacgaaatccacggtccaatcaacctccgcaattacgtgaatgggatcatcaacacaattattattaccgatttcacccagcaggcgaccctttgcaatccaggcctgactaagcaacttgcccatcacttagctcatcatgctggaaccacacaaaatatctcccaaattgtcgatagtcttaaacgtcaccacatcactacttccaataagacggtcgatttttatttacagttcttacagaggtcctttatcttttacccatgcaaagaatatgatttttcccgtcgccacgtcaaaagtaccaatattcgttattatccggtagatcctagtattcggcaagctctcacactgaaaaagaatgtcctttctcaacgaatccttgaaaatattgtctttattgacttattgagccaaggctatcaagtatatagcggccgcatcaaagataatgagattacctttgtcgcaattaaaaatgatatctttacctgtatccaaatcgcttattcgcttgctgatgatggtgcctatcgccgggcgatcagcggattacggcaactttcctcaaaatataaaaagcttttaattacagtaaaaccagcgctcaattacgctggtttagatcctgatattgaaattattgacttgtatagttggctaaccaattaacctcgtcgcagataaagcttatccacgacatgtcccgttgtcttatgtaaaattacgtcagcacgacttttggttggaaggataaactctcgtaaattaggaaggtcgacgcgttgccaaacatcctttgccattttaaatgcttcctgacggtcacccttcgaataaggatagtaatagtttgatgggtcagtaaaggctgtctctagcaacatcccaaaccgttgaagataccaatgttcaatcaggtccggatctgcgtcaacatacaatgaccagtcaaagtaatcactgacatatagttgctggttacttggcaattgcaacgtgttaatcccttctacaatcaatatgtctgggcgatcaattaccaagggcttatccagctgaacatcataaacttgatgggagtatgtaggcgccttgacaactggttcccctgccttaacatcattaagaaactggaggagcctttccatgtcatatgattcgggaaagcctttccgatccatgatcccccgccgttttaattctgcattaggatataagaacccatccgttgtcattaattctacccgcttatcaggcagcatcttatttagtaagatactaatcaaccgagcgatggtgctcttcccaactgcaaccgaacctgcaataccaataatatatggaatgcgcatcgtggaacgctgtaaaaagtttgccttttgcatctgccattccaaaaagttctggtagcgcagttgaattaattttattagcggcaaatatacatcttgcacatcctcaattgaaattcgatcattcaacgatttaatttcatccaagttcccctgggttaaccgtactgaatcagttgggaaaaagccgtgccatgtttgccgatcaaattgttcgtagttcatccattcatccattatgcaaaatcctttatttcacccgtcaatgaaaacggttactcaagtttaatagtaacatattataaacataattaaagctcaatctagcttgtgaacacctaaacattttaccagataattagcgcagcgcaactgtttgaaataaaaatggagactagtactattactggcctccattttcatttgattatggtttagggaagtttaatttcggataattctttaactctggtgcatcggttgtgtaatcatcgaaagtactctggttattattttccgactttaaacttgtcttctgtttcttttgctgcttctgtaaattcttcaagctcttcttaaggttataagtatattgttttttatcaactttcttaaatcctggaagtttgtagaaccgaagcaagtcaccattcacgactttatctgataatccaagatcagttgtaacgtatttttgaatcttaccaatttctttacgttgcgctgcggtttggtgagtaatctgcttaccattcttagtgtaatagtagtcaccattatacttagtgtattttggcgttacccaatcaccatttctaaacggtacaatttgcttattttctggtgagagcaagtcttggccgaattgaatataattcttagagctaattcctaacaaatcctcaagagtaggtaaaacatcaatttcaccaccatacgtatggttaatgccaccttttaggccaggcatattaatcataaatggtactttttggaacattgctagatcataattagttactttcttcttacctaagatttgcgcaatggctggttggtggttattagagattccatagtggtcaccataaagaactaacacactgttttgccgtaaccccgtcttatcaaggtaatcaagaaattcgccaagtgattcatctaagtatcgtgcagtttgaatataagggtcgaccgtgtcatcaccagtcttccacgcttcgatatccttattctttttatcaagaatatatggatagtggttagtaactgtgatgatctttgcatagaatggttgtggaagctgctcgatatagtgggctgattctttcatgaagatcttatccttcattccatatccagcatcataatccttggtctttgggtaatactccttactaaagaagtattggtaaccaaaagacttataagcattatcacggttccagaaactaggaacatccccgtggaatgaggccgtcgtataacctagtttttgatgaagaagcgctggcgcagattggaaggtattagtcgtcccatcagtaaccattgctgatccttctggaagaccaaatagcgagttttcgagcattgtttctgcatccgccgtctttccttgaccaacttggtggaagaaattatcaaacgccaaagtatcattagcatggtacaacttattcaggttcggcattacttcttgaccatcttctttatagtcgatcatgaattgctggagactttcaaggtgaatgataaaaatattctttcctttagccttaccgtaatattcaacgtttggcgtagcataattactatggatgaaatgcaaaaccggctttaattcgtcacgattagcacgcgcttttactacactgttattagtcgtcttaaccccatcataaactgtatatgcttcgagtcctagatacttaacaatataattattatcaaatgttcgcgtaagtagttgtgaacgatcactttccgccattcctaagttaactccaaatagaacaaagccaagggcagtaatcgtcatcgcatatctaaccttaaagcgtcgcatatcaacacggacaaagtggaaaaataagatgagtgctaaaattacaacatccaggtaaaccaaaaagtcttcgggacgtaatatccccattaaacttttaccaagattatttgaagccgctccagatccctttattacgttaaaggtaatgaaatctgaaaattctcgatagtacaaaatatttgcaaaaagccatgtcgacaatgccgcattaattatcaacatcatccaataggacaagcgtccacggaaatataatgcaattcccaaaaatacaagggcacttggaatcgtattaaatgctaaaaggaattgttgcatgcttccttttacacctaaattaaattcattttgataagcccaatagctctttaaacaaaataaaagtacaacaagcagaaaaaaaccgagcttggtattcaagacacggcggagcttctgcaacgctgttttcatagtcgttcctccataaaaaaatatcattattaacaataatacactaactagctaaccgcaaccgtacaattttatttttccaaaaagttaaaaattctgtcacttttctgtcgtagttaaccttttgaaaatagatcttaaatgttatgattgagtgtcgttaattaacagaagggactgagcaccatttcaaagaaaaaagcgaatttaatgttattactggttgctattctatggggaagcagctatgtatttgccaaactaacgattcaagcagggatgcattctggagttatcaatgcttgccggggaacaatgtgtgtaattgccggttatcttatcttccataaacagatcaacaaaatgacttggctggatttcaaactaggagtccttatgggaacaattaatttcctgggttattttttgcagactgatgctctccgttatactactccggctaaaaatgccttcttgacaaccttatatgttgcaattgctcccttgatcttgtggttgttttggcatgagcgtccacaacggaagacatattttgcggtcgccctcgctattatcggaatggctgtcatcactaatgttgctaatactggccttcaattaaattttggggactttctaactgttgtttctgctattttttgggccttacaattaatcttctttggaaagtacgcaccgaaagtttctagtccctgggtggtaatcttcatgattggcctatgtcaaggcacgttcggttggattacgactggattatttgaacgtactaaccttacacaaattcattgggttcaagccctgattcccctggctattttagcgatcgtcgtaaccttcttagcgcaaggaatgcaaattacagctcagcaatatactgatgctacatctgctggattattattgatgttagaatcattttttgccagcaccatgtcagttatcatgggctatgatccccttacaccacaactaattttgggtggtttaatcttacttttagccaatgcaattatgcaagttaatctccaagatgtgccatttttaagaaaacagaattaaaaataacgaggatgaaaagttttttcatcctcgttatttttatttgcttactttcttatcttccttggcaaccgctgcttgagctagcaagttgacatagttaaatggtcggtcaaagtttggctggaacattgtatcatacattccaagaaactcaattgtattttggttctgaatgcataacgaaatcagacttaaagtttctgaaatatcgtgtttactcatcatctgtgctcccaagattcgttgggtatccttatcccaaaccaatgacatcaggaccggcgtggtagttggtataaagtgcaatattactcttgccatttatttatcaacattaactttttcatattcatctgtcggcacttgggtcagcaaactagttgtcctgccaattgatactaagcttaactcatgcattgctcgagaacaaattgtatatagcaattgtcgctcatcgttaccatggtattgctgatcattcgcattccagacaataaccgcatcaaattccaacccttttgctagatatgccggcacaacaattggcccctttactaaccgttgattctctgtccgaataacggtggtcttgatattattggcatttaacttttgatacaactcttcactgtctttgagatctttaccaataattgcgacggcatcatggtcattctgatacttattaagaatattaataactgccgctaccccttcttgttcatccttagtttgataaacttgtggcttattaccttcacgttcaaaggcttcaattgcttcaccgtcaattaaaatatgcttagtaaagtcggtaatttgtttcgtggaacggtaagacttagttaattggacaaccttcgtcttttctggatcaaacatcgtccctaactgctttaatagtgaccgactattctcatgagtgaaaatcgcctggttaaggtctcctaacaatgtgaatttagcacggggaaaacgatatttaaggtaagctaactggtaagcatcataatcttgaacttcatcaacaaaaacgtaacgaatatcacgttgaccacgctttccagtaatcaaatcatacaggtacaggtaaatggtaattccgtttgcactgatatttcccttctttagctcttcttttatcccatcaacataacctttccattgctctgcagaaataccgtattcagcaatattaacaagttttggagttacccggagaaagtgtaaaaattgtccattgatgttaagccactgattatgatcgatggctttttttattggcataaatgcccgcataacgatttgacgcgcaaggaacttgtattctttatcttcatcctcaaattcacgtggctggttattaaataggttgtcgatttcttctttactcaagctttgaatttcatcctctacccatttgttgcgcatttcagatccaacacggtgattaaggtatttaataagagcttctttcgttccatccaacctatttcccaggttatagttattgttaaatgagtagtaaatctccttaatcttctctttgctcaaaaagactttaccattaaacataaggttgcggaaacgcatattagcatgaccaagatggttagcataacgctctgttgctttgaaatattgtaagctagttaatagttgttgtgcattcttagccgtttcatcttggtgactttcaaaccgttgttctaagttttgaacatgaagctttggtacccgacgattagcaaactggaagtaagtcatctggaccatattatgctcacccaattccggtaaaacttgatcaatgtagtcattaaataattggttaggtgaaaaaagaacaacttgtgaagaggtcaaattcccccggtaacggtaaagaagccaggcaacccgttggagaactgcagctgtctttcccgagccagcagccccctgaacaaacaacaattcatttttagtgtcacgaataatttcattttgtttccgttgaatcgtcgttacaatgctcttcatcttggtacttgaatggttaccaagagcatcaagaagcatctggtcgcctacttgttcgtcggtatcaaagatggttacaatcacgccatctttaatttggaattggcgcttaagagtaagatcaacctcttgttcacctaccggagtctggtacttaactttcccgagctttccttcatagtaaacagacgaaatcggtgctcgccagtcataaacaagaaagtgatctggcttatcggtaaaggatgcaagcccgatatataccttttcggattcattggcacctttttcacgaaaatcaatgcgagcaaagtaaggtttcttttcaagtcgctgtaaagttgctagccggtctgcagcgtgttgccagctattttgacgttcatctagcatctgctgttgagcacgaaaagacatggccgtatccatcatgcctgaataagtagtggtatttaagtggatatcatcaatttgcttattgatgcccttaatatcatgttgagccgttttaatctttttttctgctttttgttcggcctgttttactttatcaatcacattatcaaggtacttttgttctagttctttttcagttttcgtagacattacatactccctacctttcatcttcaggtcgacttacttaataatttatcttaaaatcatccaattattatatcattttcgccaattagtctgttaactttccgccttctattttttcaattattaaatgtcgtttaattttaatcctaagatcatcaaaataactaataataacgctacaatatattgaagccatgatccaggaggaggaaaacaacaatgagccatattttttatcttctaactcatattgcggaaataattattcccatgtttgagtggatgggcgcttggagctatgttctcctttttatcctaatttttatggaaactggattagtgattttcccatggtttcctggtgaatcactcgtctttttaacttgttctttcattgcttttaacccgatcttaaaaatggaaatcgtcatccccgtcttcttttttgcggcgctaattggtgacacagttaattattatattggtcattccctttctcattggcaatggctcaaaaaaagaatggccggtccccgttttgagaaagcacaagaatttttagcccgtcatgggatcaaagctgtagcattagggcgatttgtaccgctcattcgtacctttgtccccttaattgctggaacaatgcagtttccgttccatcgtttcacagttggcaatattatcggcgttactttatgggtagcgattggtgctggatgtggatattactttggaacaattccgtttgttcgtcagcacttctcacttatcatcttagcatttgttgtgtgttcactgttaggagttggcttgttagcacttatcaaagcgattcgtcaacgaattattaagcgaaaccgaatgctataattgctttttcttcagcgaaatcatgttaaaatgtaataagtatttttatttcgcttaaaggagtgctgtaactatgacaatcaacgtttattttgtacgccacggacaaacctatcttaatctctacaatcggatgcaaggttgggctgatggtccgctaacgccaaagggtgaagaagacgctaaacgagtaggacgggcgcttgctcctattcaatttgattatgtattttgcagcgacctcgcacgaacagtttcaactacccgtttcttgcttgctgaacatcctggtaataatccaacgccaattccagagccagcgtttcgggaagaattctttggctactttgaaggagaagatggccaacattttgctgactttcttggcggcccagatggttatcatagctttgcagaaatggttgccggttggggtccagacaaattaaaagataagattgcagccgcggataattatggtactgctgaagaccatgttactttctggaagcgggtagataaaggttttgaccgtttacgagcattgccagacggatcagaagtactagtagtttcacacggagccactattcgttcaatcgtccaacgctattctgacgcttacgatccaggcgattcaccacgtaacggaagcatcactaagctaactttagataagaataatactactgttgatttttataacaaacttgaattaccagaataatatccataaagggggaacactattcttcaatggagactaacatacaaactgcagaaccagtaattatcactggcttaaataccggtcaagaagactttgactactcaatggtcgaactggctgaactagcacaagcaaatcacatggaagttatcgatcggattgatcaagtcatcgatcgtcctaatcctgctacctactttggaaaaggcaaagtcgaagaaattcgtgacgtggctgatgctaatcacgttcctactattattactaatgatgaattatcaccaagccaattacgtaatcttgaagaaggaaccggatgtcgtattctagaccgaaccgctcttattttagagattttcgcaacccgtgcgcaatctagagaagccaaactccaagtacagatcgctaaactgcaataccgtttaccacgattgcaaactagtgcaagtgagcggttagaccagcaaaccggtggaggaagcggctttactaaccggggtgccggagaaaccaaacttgaaatggatcggcgaactatccaacatcaaatttcccaccttcgtcaagaactggctgctattgctaaatctgaacaaaccaagcgaaaacaacgagtaaagagtgcaattcccacagctgctcttgtcggctataccaatgctggtaaatccacgattatgaatggcctcgtaagaaaatatggagctgctgaagaaaaaactgtttttgaaaagaatatgttatttgccacccttgatacaagtgtccggcaactaacacttccagatcaaaaacgcttcttactcagtgacacggtcggttttgtcagcaagttgcctactcaccttgttgaatcatttaaatcaacacttgcagaagccgctaatgctgacttactaatccaagttattgattattctgatccacattacaaggaaatgatggaaacaactaacgagactttaaaacagattggaattaatgatattccaatgatcaatgtgtttaataaagcagataaaactgaaatagaatttcctatcctcgaaggtgacgatcaagttgtaatttcagctaaacaagatgcttcattagatcttctcgttgacgttattaagaagcatctctttaaagactatgttactaccacgcttttaattccatttactgatgggcacgtcgtttcttacctcaatgaacacactaatattttagatactacttatgaaagtgatgggacattattaacggtagaaatgtcagttcaagattatcaacggtttggaaagtatgaaaagaactaacataaaaagcagcgatcaatttttggccgctgctttttatgttagtctatctctctgcttttactccgaaaatcaaggagacaatcattactaagattactgctccaataatagatggaataattgccattcctgctacttgtggtccccatgcacctaacactgcttcaccgattgacgagccaaccagtccagctacgatattactgataactcccatcgatccaccgcgacgggttaatgcaccagcagcaagaccgatcaatccaccaacaattaaaacccaaatccaatgcataattatccctcctttttatcttccaatgtctctttaagatcagttgccttatccttagcttttcctttagctttctgcaactttccctcagtttcgcgggtcttgtagttggttattttaccttcaacctcttttaatttacccactactttatctttaattccatgtttatcgctagccaatatcatcagtcctttcatctattcttggctactagtggctgacaacattttattaatttcgctcccttctataatgactagtgctttcaacagttttaagtttaacagtctcccaacaagaaagcgatatcttaataggttacttaagttttctttaataattttatttatgtcttaattaaaaagaaactctaccttcataaattggtagagtttctttttattcttgaacttaattacattcttatttcatttcgtgaatgtttgccttctaaaatcgtaacagcatcattcaaactaatctcgaccatattgcgaatagatgtttcggttaggaacgcaacgtggggtgtaacaagaacatttggcattgccgctaatttcttgtaatcatctggaatttgatctggtgtaacttgcttcccaaagaaagaagtttcgtcagctaatgtatctaggccagcacccgcaatttctttattttccaatgctgaaattaagtccgcggtatttaccagttttccacgagccatgttaatcaagtaagcattgtctttcatcatcttaaattgtggtgctgcaatcatgttttcggtacttggtaacaacggtgtatgcaatgataaaatatccgcattcttaacaacagtatcgaaatcggtatattcaacgtatggttcatattcgacattatacgatgggtcatacgcaagaacttttgcgcctaatgctttataaatctgagcagtggccccaccaatattaccaaggccaacaattcccacggttaaattgtaaatttcattactgatcaagtcatcgctccaccgaaagtcgccatggctcatgcgttgttcgaattcaccaatccgtcgtaacaagtacatcgcctgtgtgacgcccatttctgcgattgcccgtggtgaataaatagggacattcgttacaatgatgccatttgctttacatgcatctaaatcaaaaatatcaaccccaaccattcgagcagctaattgctttattcccatggctgctaattgttcatacagttgttcatccccaagttttgttgtttgctgtaaggaaattccatcatatccctcagcaagcttaactgtattagcatttaatggttcagtaaccatcttgacatcattgtctgtcttctttgcccatgcttcaatataaggcttttcagtatcacgaacgctatacattattaatttcatcagttttcccattcctttcataaaaactgcttacattaatagcttagcactcctttacttaattatcagtatttaagcaacaaaaaagggtctgtgacttaagccaagttactttcataaaagacaaatggcgcagtacaacaatggcctccaacgcccggtaaaaccgaacgttggaggcctactgttgcttgcgggggctcccagaggctagcttcgcgtcgaaaaacgaagtcacgagtgacttctgtctcgctccctctgttatctttaattattgttcaccgttgtctccttggtttgggcgacgttgttgaaggtgcatgccgtcataatcgccttctggtccaagtagttcttggttattatccaattctgagcgaccagcatagtgatggtgttgtaaccaaatcatgccaactaataacaatgcatagaagacaattgcgattacgatcagaacagtgttacagaacatcgtgtaatgtgctcccaaaccaccagaaattgaatcacggagtcctaagattgagtaagtcatcggtaagtaccagtgaattacattatagaacttcattgtaatttccattgggaaggtaccaccagatccacctaattggagcattaagagaaccatggcgaagaatcgaccggggttatcaaagagcattgaaaggaacataacaattgccattgaagctaacccaaagcatatggttgtcgcaaagaatgcaactgggtgaataactgtaagtccacaagccatcataattgcatcttccgcgattgccattgcagttactaccagtgatccaactgttaccttacttgcccaccaagcgattggagctttaccaaattcagcaacccgacgaattgggtaaacaaagttaaatacaagtgccccaacatagattgctaatgatagaacgtatggtgctaaggcgtgaccatagtttggtacataactgtaatccgtgtgcttaagagcagttggttctgcaaacatcttggcagtccgtggtgaagtcttaataccgttgatttgctttgcaccacctgcaagcgatgtagccagttgagaagcaccagcattcaaccgcgcaattcctgaaataagagcaggagaattatcttgaagttgttgagttccggcagctaattggtttacaccagcaataagagcaggaacttgaccgtttagttgaccaagcgcaccagctaattgagctgcaccagaattcaaggccccgctattagcgttaagctgggcaattccgttacccaattggccaactccggctgtatattgaccgattccgctagccaattgaccagctccggctccagcttgggcgaccccagctgtgtattgaccgattccgctagctagttgattagcaccggctccagcttgagcaaccccagctgtatattgaccaattcctgaattaagcgtaccagcaccggcagcagcactatcaacaccattagtgtattggtttacaccactattaagcgtgcttgctccagaagaaatccgacttgttgcttgtttaagttgatcaacagctcctggcattgccgctagggtacctttatagccatttaaggttgctaataatgagttagcttgacgaatagtcccatctgcattatctaacacagcagacatttgtgagagctgacctaattgttgctgcataccactcaagcttccttgaagattgtttaattgaccaagagttccacttaatccttgaatagcagcaacgttagcactagcattttgtacaatttgttgagcggccttcttagattgatcactagctttatcatcactaagaatttgttgtgctaatccagcaatttgaccatcgttaattgcaatacctttaagcttgtcaccagcaccggcagcaccagataatgctcccgaagcttgttgaagactagcagcactactttgaacaccagcaagagcattcttggcagttgccaaaccggtctggagttgacctagtccttgctgaagattttgtgcttgatccatggcccccataatcccgttaaagttaatgtttcctaattgactgttaacggttgaattcaactgattagcaccggatgctagttgaccagaaccgttccttaagttctctgaattaccacttaacgtattcaaaccactgcttaattggttagcaccggagctcaatgtacccgagttagccattaaagtatttaacccagcattcaactgactagcaccaaaatttaacgcaccagagttagccattaaagtgcttaagccactgctcaactggttggcaccggaatttagtgcaccggaattagccattaattgaccaacaccattgccgaggagactaaccccaccagtatattgcatgataccatttgctaaggtttggctcccggtagcaagttgttgagcaccagaagctaatggtgcaacactaacacgcaaggtttgaaccccgttatttacttgggaaactccggcaacataacgatttacaccatcacttaatgtcaccattccagtaccaatttgttgggcaccatcagcggccttgttcatccccttacctacaacatgcaattgcttaaacattaccgttgcgtaagcgttagtaacttgggcacgaattttttcatttagccgtgtcatcccagtttggacaattacctgtccaatgtagtttaaagaaccattagtttgataatgtaacttcatcgtcttgggatgtttttgtaaaacagtcgttgcattttcagagaaatccttaggaatcgtaacaacagcatagtacttacgatggctcataccatactttgcttctttagcggatacgaattcccactttaattgatgatttttcttcaattcatcaacggtctgtttcccgacatccattttccggccttggtactcaaccggaatgtccttatttaccaccgcaaccggtaagtttcgtgtacttccatacgggtcccatactgattttaagaagaaaatactatataggaaaggtatgaagcaaataaccgttactgatagaagcagtaaacggttatgaataatatgacgaaattcgcctttaatcatgctccacatttaatacttcacctcaaaatttatcctttcataattttagtttgttaatgacttggtagctgctctcgcaaaattaataacgtcctcagttggtacatcataattattgccttgccaccagtaaaaggtcccgataatagcgccactcaatacataagcaagcatctcgggattatcagacttttgcagcgccgttacaattggatcattagtctcaagattgcgccgctctagaagaacctgacttaaaatatttaaaatttcggtatacaaagagctccgtgcactattaggtgctaaatgacggataacatctttatttttatcaatgtatgataataattgcttaataatgtcatcttcagaatctgtattctccgtcaatttattaatttgtgcatttaacgtttgctctaagagatcgtacttatcactaaaatagcgataaaaactgctccggtgcatcaatgcttctttacaaatttgatcaaccgtcaaactttcaaaagaatttttctctaataacgttatcaatgcattttcaaagtcacgaatagttctcgtaacacgcataactcttccctccccaaataatacaaatttaacatgattattctaacttgttgcaattcagtacaacaggggtaattaaagataattatttcatagcgagacaaaaatgaccatttgtccgtaaaaagacttttgtttgtatcttaatcaaacgaaaacaataatatgctcctaaatttaaatggtcaagcacggcagtaataactttatcgctcttttatagtaaaacgtattaaataattattaacttgctaaatctcttttctaaaatacggtataataaaagtattaaagctatgcgattggaggcttcataatggcaaaaactaaaaaacatttaactaaatccaaagataaagtatttcttggtgtctttgggggtatcgctgactactttggtcttgacgaaaccctcgttcggataatcggaattctcattttcgtctttactggctttttcccgctaggagtcttctacctcttagctgccctcgtaatgcctgaatataatggcaataagacaaacaatgatgacaatatcgtcgacggtgaattcagagaaaaataatgttgattgcagcaaaaaagggactgtgacataagttaagttactttcataaaaagcaaatacgcagtacaacaatggcctccaacgtccggcaaaaaagccgaacattggaggcctattgttgcttgcgggggctcccaaaggctagcttcgcgtcgaaaaacgaagtcacaagtgacttctgtctcgcttcctgaactaatcttaggttgttttttaagcattatttcgttgtttataagctacttgaacttgtagtccataatcttcttccgttaaaattgttgagccgcttcgcccagcaatcttattcgggcccccagtaacaactactgttgcaagatacaattgatacttatcatgagcagtatggacatcggttaggccgattttggtaatatgaccaactgggcgccgttccatttggttcatcccgatgtagatttcaagacggtgttgcaactcatcatgaactaattcaaagtatggcggaacagattgtgaattcaaagccgtaactggtttttcagttgcttgatactgttcaacgatttctttttcacttagaccatcatagccgttaacaaacacaccttccattaatagttggtcaacaacacggtgtaagttatgttgttcatgttcgtcaattgctactgctgctgggatcgtgtcggcattagcaaacaagccatttgaccggtttgccaattctgccgctagtcgttgttgtgcatcaagaggcgtcttagctttgccgtcctcaaatttttgaccagtaatctttgcgacacgcggtgaaataaaatcaaatcgtgaagtcttttcaagaaagtaaaagacgaaattaagatagataaaatatgttaatccaatcactgctaagcaatataacaatgcccgtagccaaacatgattcataaagagtcggaacgtaacataaactaaataaatatcgcccagaaaagcaataatgatataaatacgactctttaactttacgtcaaggttaaagtaactcaatgacgagttaatcatatcaagaaaactaaacattaataacccgcctccttattattcagtcgtagtcgttccggtagtattaccaccagtcgtgtcttgtgtcgttgtattattgttagttgttgtaccagtcgattgtgaggtactgtttcgattagcactcgtactttcgtttgtatttgctgatcgatttgtcgatgcttctgtgccagtgtttcctgctgaccgtgtaggttgattagtatccccagtatcgtccgttgtattgttgctattacttgtccgggtagttgatgaattacttgcactctcatcattatcatcacgatcgctttgtgaattccgacttgattgattgctttcctcatcacccgattgctgaaattggcgacttgttgatactgatgttacttttgcaccctcagaagtatgcgttgctttattaactactacattggtggcacccaacgcaagtaccaatgatacaagtgcaaatggggttactaatggcggtatctttgctcccatgtctcattctccttttccagagtatataatacacgaaaactggcccaataaatatgaatttattgtaaagattttttctggcattgggcacatatcccgtgcaattcaaaccgatgcccagtgattttaactcctggcaactgtttctcaaagaatttcttatcaattggtggcatttgaatttcttgaactcgtccacaaatatcacaaataaagtgatggtgatgagtaaaatcacacgaatatttaacctgcatctgatcatgatgttgacgcaattcgacaatgcccaatttctcaaattctttaaaattccgataaatagtatcgtgacttaatccagggaattgttctcgaagatattggtcaatttctacaatattaaagtaacgatcagggtgtcgcgcaactgattcaatcatcattttacgttgcttagtccaccgcaaatgatggtctttaataatggcctgtgcttgatcaattaatttctccaatcttttttcctcccgattaaagatgatattgtatcatattttaattctttttggataatatctgcctaacaattatatctatttgttgtttagtatttttccattgatcattaactacaacatgagcgatcccttttaaagccgctggtaaagcaagatcacggtgatactctttgctatgtaaacgagaacgaatcgcactcaatttatcgccccgcagtgtcattctcttagctaaagaagccatatgggtaacggtcaagaaaataatcactgcttgagcatcaagttgttgatggtaagtaatcgcaccagctgtgtcaagaacaatcacatcattttccccttgtttccatccttcttctaaaccttctaatgaagaaccatattgaaactggtcataagttacttgctcaagtaaatggagttttttcagggaagtcggtgtttcaaaatgatagtctaccccatcttgttcccctgaacgtggtcgccgcgtcgtatgggtgattacccggtgcatatcataatgattttgaagatagttagcgatagttgttttacctgagccagctgctcctgtcacaataaacacatacttattatttttcataattgcttattttaaatgatcgttaacttgatccaataattcttttaaattctcgtaggttaaccgttcacgagcatcttgatagttgaaccatccacaattcttaatctcttctgcttgcagatgaatgtcttccttgttatctaactcggcagtataaagggtcatttgcttatgattgccatttggtaagtcgtattcggtatacaccttaaaacttgtatcaattggtaattctaattgcgtttcttcctttatttcacgaattgctgtttcttctagtgattcattgccttcaacgtgacctttcgggaatccccagaagtgtcccttattttgactctctaagagtaaatactcaattccattttcaccttgacgatatacaactgcgccactagtaacttcaattgccatttttatccctcttttgtaattaaatttttctaatttacttttaatattaactacggtatcattattaattataaacgtggcgaaccatttcggcacgtacaatttattatagcaaaggtgggttaaagatgagcttaaacattatgcgaaaagaaagtcttgatcgatatcttggtgaagacaagcttttcgttaaatcaatgaatgctcgtgatctcatggcaattgggatcggtactgttattggtactgggattttcattctccctggaacaattgccgcaaattcagctggaccaggagtgtcattgtcatttctgttttcagcgattgtctgtgcgctagctgcaatgtgttatgccgagtttgcttctgcattaccggttgctgggagtgcctactcatacggaaatgtagtgtttggtgaattccttggctggttgctgggctgggcgttggttcttgaatacatgttagctgttgcgtctgtttcaacaggttgggcagcctacttcaatacattgcttgaaggatttggtattcatctccctaaagcactctcaggtccatttgatccagctcatggtacctacataaatatcgtggcggtcgtaattgttcttttgattacagtaatgcttgcacgggggatgcaatcctcattgcgtatcaataacattgctgttttccttaaaattgcaattatcttgatctttattattgttggtttcttcttcattaagcccaaaaattaccatcctttccttccataccacatgaagggtgtgattcacggggcaacgatcggtttctttgcttaccttggtttcgactgtgtttccagttcggctgccgaagttaagaatcctaaacgaaatatgcctctaggaattattgggacacttgctgttgcaacaatcttatatactggtgttgccgtagtcctaactgggatggttaagtacaccaaacttgacgttgccaatccagtggcgttcgccttacagatggttcatcaagactggttggcagaattattgtcaattggggctttgatcggaatgttcacaatgatggtttcaatgatctattctagttctcgtttgatctatgcaattggtcgtgacggtctgcttccttcattcttaggaaagcttgataaaaagagccactcgccacaagttgcattatggatcgtggcgattattatcgctatcatgggcggacttgtttcccttgatcaacttacaagtttagttaacatcggaaccttgtttgctttcatgctcgtttcatttgggattattccgcttcgtaagcgaaaggatatcggtaatcgtggaggctttaaggtgcctctctaccctgtgcttccaattctttctggtctcgcctgccttggcatgatgacccagttgcaaaaagaaacatatattggagcagcaatttggtttggaatcggaattatcatctacttcacttacggctactggcacagtaagttagcagataagaattaatagcgtgaactactcggccataaatgaccgagcttctgggaacacgaagtagtatttaggatattacacaagtattcttgctacctaacttacagaactccgttcttttaccaaggctagttcctagccaacggcttttaatcctttttgcaagatgttaactgccgcattaacatctcggtcgtggtgaacgccacactttggacaagtccattcgcgaacttcaagtggcttcttgccactgttaaagccacaatgcgaacagatttgactggtatagtttggtttcaccaagactagttgtttgccataccaagcacacttgtattccagcatcgtccggaactgataccaactagcgttagcgatcgacttcgctaagtggtgattcttttggagattcttggctttcaaatcctcaataacaatcacgtcgtactgcttaactagagccgtcgttagcttgtggaggtaatccttgcgcttgttggcaattcgttgttgataatgggctttaacaagtcgggcgcgttgccagttctgataatcattgagtgctaacttggtatcttggtggttgtgattccattggcgaacggcaacggttgcccggtggcgccgcttgctgaatttactttgccacttcgttacttgatgttctaacaatttagcgttgaaggtaccgtacttgacaccatcagaactaatcgcaaggtcggccaggcctacgtcaagcccgaccatttgccccgttttcggtaaccgttcaacggttgtttcaacttgcagggagaggtagtaacgacccgtcgggtcataactgaccgtataacgcttaattttggcctcaccaataagagtcgttttactcgtgcgtatacttccgagttttggtaattgtaaccgccgcttggcaagtaccttgcacgttgatcggccagtgtaggcctgataggccacatggcggctcttaaagcggggatagccaccttggtgcttaaacaatcgtttaaaggcctcggtaagattatggttcaccactaggaaactggtggaatcactttccttgagaaagggatattcacgcttgagctgtttcaagaggtagttcataccatactcattgacgaagtggctactgggattgttttggtaacgctccttagccatactgagcatttggttccaaacgaagcggtcattaccaaacatttgccataactgatcccgttgggattggttagggtacaagcgaagtttgatccctttaatgaccttgttcattctagttccacctcctttttccgttgatcatcaatgtacttggcaacggcttgttcattaacggccccaatactttcaacatagtaactgggcgaccacaagtgacggccctcctttttccaatagcttcgctgtaattccggacattcccgaaatagctgataggcagtaccgcctttcagccaacgaacaatattcgtcaccgataatttgggtggtgcactcactaacaagtgcacatggtcgtccttcccaatttccatgtgggcaatttcaaagccatatttagcggcgatctcatggataatccgtttgaaggcgatctcgacccgaccggtaaggactttgtttcggtatttggttccccaaataatgtggtaattaaggttgtagaccgatgttcggccatatgtaagtctgtttgtatctttcataccaacgattataccataattcacgtttcccatatacgcccgtcgggcgtaaaaaaggggggcaattcatcacgtccttaaaagaacgtgtttccttgccccttttcaaaaaatttaagagttacgtagagagtgagaaaattatttttccactccctttttatttaagatagtaatttgcattaaataccattttttgttaaggtagtattacttacttttttattcacaaggaggaatcaattagttaggccaaattttgatcacatacgcctaattttttatggaatatacaaagaagaattacaaaaaagcacctttatcatcaattcattttcgaatatattttgccttggctcttggacaaattgcttgtggttttgctcttggaattagtggaactgccctttcccaagcaaccgattatatcaatattaccgacttttgggttggcctaattggtgctgggagtttaattggactcgctgggagtgctttaatgggtaaaatcgctgaccaatttggccggcgaagaatgttgatgctcgatatgtatcttttttctatattttctcttttacaattagtaacaatgaatcttattatcctgtttatcttacggattttaattggtttaatgattgccattgactatactgttgggaatgctctattggtagaatggttaccagcaaaagaaagcggacgcctacaaagccaactaatcatttattggacaattggctttattacttcatatattgctggaattttagtaacagggtttggtgttcataattggcaagttatccttgcatcaagtgtcgttccgggactgatggctgcaatctatcggtcaatcttccgaattcctgcatctccgagctggttagcaagtcaaggtaagaataaaactgctcaaaaactaattcaaaaacaccttggaaaaaaatggggattatcattaaaacaaattcgtagtaaaaagccaaaagctgtctctcttaaaaccctctttaatcccccttatcgccgaaaaaccattgttggtggtttattctatgcttgtcaggcattttcatttttcggtatcagtatcttcttaccaattctcctaaaaagtatgaatcttggtaataacaacctctctgggattatctataatagttgcgtccttatcggtgtaattttcggtagtttaatcttcaagattcttagtaggcggatgtttttggtaagaacatttttcctttcagcagcagccctcattttattaataattggcaataacttttcacctttcttccaaattagcgtttttgcgatctttgcgatagtcttatcctcaggacttgtccttgattatccatatccaacagaactatttgatgttaaggttcgagctagtggggttggtacttgtatcactatcagtcgttttggagctgctagcggaacattcttattaccaatcttaactcatctcggcggtccaattttagcaatgctaatttgtactcttgttttacttataggtggtactatctgtcttttatgggcacctgaaacttcaccaaaatatatttaacattaataatagaatggtcgggaaaattttaaatttttcactgaccatttttagttttaaacatcaatccaatagactaatcaatttttaacaattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccgcagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcatctaattgccgtggaactaacactttattatgatgatcccaggcgatttcctgctgagcctttaagaaccgacgactacgtaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcactttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgattttgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcataattccattcttgcaaattaatgccgtacgcttgtcccacaactacaaaacgatgtttaagatattcagatatttcatcgttaattacttttcgacgatacttaaccaccattaccaaatggtaattaagcaagtatactgaatgctgatttctatctaattctattgttatcaccacattttatagatatatactaaatatatcatagaataaaagaaaaagcactaacgtactttaagagagcgattcatcccctacttatagaagtgggggatgaatcgcaaatttatggataaaataatttgattacaaagcgaaccaaatacggatagtttttgattaatactgctatatttatcgggaacttgttttcgtgcccactcctaataagatggcacaaaagactgttatagcggttccaagcaaatataggcggtatacgttaagaataagccaagagtaagacagataagggtagtcttatagcgagtagttaatggaatcttttgcaatttaggactcaatgcgcctactaacattcccgaaagcatcaattcgataaaaacaatgaaaatccaataagctttattctgttgaaaagcaaatagtaaagtatagataatgacataattcttgatcgctccgagccaaatacgaaatagtttaaaaggttgttccagaatatttcgtagttcaaggataatcccaataattgctagcacgattagggcctagccaaaatcagaaatttgacccgtcttcttaaagaaactaataataaaaaccacggtaagcacagcgatggcaggaaaagccgtttttaaattaaaagagaattttaaatccaatggtgtcttatctcgtttaacaacaacgtaagcgtaaataacttccaagcccaggaaaaaagtataaaaaacaaaaccgacaactaacggcagcttcatcagtaaaatcccgagggcgatcagtccgataattacactaaagcccgcgataacatttactcgcttcaaatcaatcccggaaatttccttattgggatcgccgagcaattttaatcctgtcacgccaaaaccgatcaagatcgccgccaatctagcaagccactcaaagcgaaaataaattccaatagaagcaaggactcccccaataaaagcaataactgaacaaaacttagtaacacctgaccaagaagctaaatttaggcgcccatcgagaataaaaggcattactttttcaacggtgtaaacaaaaatgaacggccaaacaaatgtgattatatttgcatgggcaatgatagagaatgcaaatagtaacgttggaaatagaatatagcttcgagctacaaattcatggttaattgctaaaatcttcttcataagcagcctccgatcactttaccttttatttttagtaaaccacatccccttataaaagaaaaataataggactcctaacatgatttttaatgctagaagtcctagtagctttttatttagcaaacatcttaaattctaaaaataaatcattgtattcacctaaaacgcgtaatggcaaatcacgatatacttgcaaatgcttcatcgttgtttcaggaggatagaaagctttatcatcggtaattttcttgggtaattcttttttagccgctttatttggtgttgcgtatccaacgtattgagcattttgagccgcattttggggatctaacataaagttaataaattcgtaagccgcctttttattacgtgctgctttaggaatcaccatgttatcaaaccatatattgcttccttcgcttggcacaacatagtgaaggtgcggattaatattcatcatttcgcgcgcgtcaccagaataggtcacacccacggctgcttcattttgctccatgtacatcttcatctcatcagcaataatcgcttttacattgggcgtcaactgctttaaatgggcctgcgcaagcttcaattgatggtagttagtcgtattaacagaatgatgctgggtaataagggcaaccgcaaacacatcccgcgcactatcaatcagcatgacattattctttaagcgcggattccaaagttgttcccaatgctggacgtctttgccatttactttttgatcattatagataatacctaacgttccccaaaagtatggtacagaataacgattgtcggggtcaaaagaacgatttaaaaattgcggatcaatatacttaaggttaggtaatttctgatggttaagaggtgcaattaaatgctcctttttcatccgttgaacagtgtattcactcggcacaacaacatcataattagtcccgccttgccgaatcttggttaacattgattcgttgctatcaaaggtttcataatctacatgatagccagtttgatgttcaaatttcgttatcaatgctggatcaatataatctccccaattgtaaattgtcagagtttgttttccaccaccagttttttgctggttgaaagcaacatccccaagcgctagcaaaatacaaataacgataattgcaaggaatgcagtaaatatctttttcattgtgcatccccctctttaacagccacaatccgtgtccgtcgaccgccccgtttactaataaggtaatagccaattactaacagaagcgaaacaataaacatcaacgtagagagggcattgatttcaaggttaattccttgccgcgcccgcgaatatatttccaccgataatgtcgagaagccatttccagtaacaaagaaggtcacagcaaagtcatcaagtgaatacgtaaaagccataaaatagcccgcaaaaatacccggggcaattgacggcagtactacccgagaaagaacttgccagcgactggcccctaaatcataggcagcatctactaatgttggggacatttcatttaattttggcaacaccattaaaacaacaattggaatacaaaaggcaatatggcttaagaggactgagacaaagcctagtcttacccccagcatggtgaaaaagattaaaaagcttgccccaataattacatcgggcgagaccattaaaacattattcaaagataacaaactattcttccacgggcgccgtgcatccttaattgccaaggctcctaatgttccgataatcgttgctaatagtgacgccaaaaatgctactaacaaggtattaataacaatggtaatcattcgcgtatccgcaagcaaatccgcatagtgttgccaagaaaagccatggtatttttccattgtttgtccgctgctaaaggaaaaaacaactagatacaaaattggcgcatataagatcacaaaaactaatgccaggtacgcttttccccatgaccatcgctgctttttcattaatggcgtcctcctttctgtttcttatcaccagtcataaacataataataaacattgcgataatcagcacgaccccaatcgttgaacccattccccaattttgcgttgtgaggaaatgttcttcaatcgcagtccctaaagtaattacacgatttccaccaatcaaacgggtaatcataaagagggagagcgatgggatgaagaccgcttgaattccagcttttacgcccggcatagaaaggggccaaatcactcgacgaaaggtttgccaatgagtagcacccaagtcatagctagcatttattagtgacgggtttatttcagccaggttattgaaaatcggcaacaccataaacgggatttcaatataagcagccacaaacataaaactggcatccgtgaacaaaagctgatgactcccaaggcccataaactggaggaaaccgttaattgtccctgttcgactaaacaagccaataaacgcataagtcttcaataataagttgatccatgttggcaaaatcaccagcaatagccaaaactgcttattaggcaatctattcaaaacataagctgtcggataactaatcaccaatgtcacaagggtaatcaaaaaggcataccagacagagttaagcgtcatcttaagataaacacccgatgtcaggtattcagcatagttattaagggtcagctgaccattgatattaaaaaatgattgataaaagatcaataccaatggcgcaatcacaaataggataatccacaatgcatatgggacgataaacatcgctttttgccgcattagtctccctcctcgtagctatcaaggcgagcatcaaaatcttcttcgctttcgttataccgcataacgtgaatatcttcgggatcaaatgtaatccctactttagcccctacctttgttttatgaatagaattaatcttccacttatggttacgttggtcaatcaccgtaatttgataatcaacgccacggaaaagctgcgtttcaacagtgccgactaattttcctttctcaaccgtcgtaatgtcaagatcttctggtcggatgacaacttcaaccttttcgtttggtttcatccccgcgtcgacacaatcaaagtcttgaccattgattgaaactacatagtcttttttcataatgcctgggacaatattgctttcaccgataaaatcagctacaaaatggttaagcggttcatcataaatatccacgggcgtcccactctgctgaatcttaccatcattaataatcataatctggtcactcatggctaatgcctcttcttggtcatgggtaacaaagataaatgtaatccctagccgccgttgcaattgccgcaattcagtctgcatttgaactcgtaacttatggtccaacgcagacaaggcttcatccaacaatagtactttcggcttattaactattgcccgggcaatggcaactcgctgtctttgcccaccagacatcgcggtaatttcccgatcatcatagccatctaattgaaccaggtgcaaagcttcttttacgcgttgtttaatttctgattttttgacacccttaatttgtaatccaaaggcaacgttttctgccacattcatatgagggaaaagggcgtaatcttgaaagacggtattgacttgccgttgattggctggaatatcattgatttgctttccatcaaaataaatttttccactactaggatgatcaaaaccagcaattaagcgcaaaatcgttgtctttcctgatcccgatggtcctaataaggtatagaatttaccggcctcaatttcaaagcttatatcacgcaacacaacgttatcatcatactgtttgcttacatgctgaaattccattatgttttttaccatcagcgtttccccaatcatcattttttaaactaagtcttagtataaagtatacgccttaaatcgcaacactgtttatcctaagcaaattattttgaactactcccacttagctaaacctacggtttaatgcttgaagtgggagattctggaaacatcgcatacttaccctactgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagttttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcgtctaattgccgtggaactaacactttattatgatgatcccaggcgatttcctgctgggcctttaagaaccgacgactacgcaatttctcccaacgatacaactttttacggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagctttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgcttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagatgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctgggaattgttttttgaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgattcctatctaattctattgttatcaccacattttatagatatatactaaatatatcatagaacaaaagaaaaagcactaacgtactttaaaagagcgattcatcccctacttatagaagtgggggtattctcgcaaatttatggataaaagtgcgataattaatatatcaaattttatacgaggtgttccagatgaaaatcaatcaatttagtattacttcgactacaccacaggcacggcgccaagaattaatgcagattcacttgcttcggaaaaacgaagaacaaaatttaacaccgaacgcaatgtttgaaatcttcttagcacgaattcatatggcaagtgcccagccgatcatcactaaacagtggcttcatgacctattagctactcctgaccttgctcttgatgattggtttgaccagaatcaaatattaaccgatgaagtattttacctcgtcgctctccaactactcgattttgaggccgcagttgattttgatattacagatccccttgctacagttaagaaaattggcttgccagtcgaatcacatcaaaaatggacaaccgcaaacgttaccgatgctttttaccttcttttaaatactcataacaaaaatggtcaatcgcttattgatcatttaacggcagagggctttatggcttggagttaccagcttccagctgaacaaaaaccactctttttcaatggaaagccacttgctagttttgaccctgctaaattcattcgtgaggttgtttacattgagaccgatatggatactgattttgatggtaaagcagatttagttaaagcggaaattatgcggccaatcgaatcggaccatggactaaaagttcccgttgtctttactgctagtccttataatcaaggaacaaacgatgaatggggcgaaaaagcaacgcataacgtcaatcttcctttgaaacataaggatcctgattatcaggccccgactgaagaaaaatttccgactgacttttcacgccaaaaagttactggcgaaagccggcaagctactgagacatttagtaccacgccagcctacacactaaataattacctcgccgcccgtggttatgcggttgtttattcagccggaattggtaccaaagattcggatggtctgcaaacgtgtggttcttcagaacagactgatgcgatgaaggctgtcatcgagtggcttcatggtgatcggcaagcctttactgaccgtcatagcggtaccacaatcaaggcgacctggtgtaatggtaaagtcgcaatgacaggacgctcatatctcggcactctagccaccgctgtcgcaaccactggtgtacctggcctcgaagcaattattagtgaagcggccatttccagttggtatgactattaccgggaaaacggccttgtccgggcacccggtggctttcaaggggaggacgcagatgttttagctgacgaaacattcagtcgaaccaaacgtccagcagactaccgccgaattgaaaaagtaaatgataaatatattgctaaaatgcaaggagcaatggatcggacgtctggtaattataacgagttctgggaccaccgcaattatcggcatgatctcgaaaacatcaaagctgccgtgatgatggtgcatggccttaatgataccaatgtccgtcctagtaacgttaaagcactttatgacggcactcaaagtttgccgattacaagcaaactcatccttcaccaaggacaacatatttatatcaatgcctttcgttcattagatttctctgacatggttaatctctggcttgctaataagctctgggggcaagaaaatcatgctgatgataccctgccaagtgttcttgtgcaagacaatagcacccccgaaacttggaccgcatatgatcaatggactgcaggcgaacaaaaacagtaccaatttaacgaccatcgcctaacgaatttgcccggactaggaatccaaagctttaatgaccaacaaccagaagaaaagtaccttcaatggtgtaaacaaccccaagcatgggcaaaggcactcgtgaatgataacggtcaatttagtcggcgcttcgtaactgctgtatttaataatgatacgcttctccgtggaactccgactgtcacattaaaagtagcttcttcgaaaaattatggaatgattagtgcccggcttgttgacctgggcagcagcaaacgccttacaatgtcgcctgttttgtttaatcgtaatggtcttgagctaggttatcactggaagacagatgaccttcgtgaatttaaattagcaaaagaaataactaattataaggtaatcgcaagtggacatattaatttgcaaaatcgaaacaatccagcacagattgacgaattagccgctaatcaatttgtcaccgttaagtttgatcttcaaccaattttccaccgaattgtagctggccatcaattagggatcattatttatagcactgattacgaatacacgcttcgtggcaacgaacggattgaatatcaattagagctgaatggctgtcatcttgacattcctggcttcagcgttttagcttaaaaagacagcgcgttaaaactagttttagcagaattcagctaattgcggtagaatagttagtattaccaataaaaaggagagattcgagaatgaaacaaggcactaaaattattacccttgataacggctatcatctgtggacgaatacccaaggtgaaggtgatattcatttattagctttgcatggggggcctggtggcaatcatgaatactgggaagacgctgctgaacaattaaagaaacaaggtcttaacgttcaagtaacaatgtatgatcaattaggttcactatattctgatcaaccagatttttctgaccctgagattgcgaagaagtaccttacttacgaatatttccttgatgaagtagatgaagtacgaaaaaagcttggcttagacaatttctatcttattggtcaaagttggggtggccttttagttcaagaatacgctgttaagtatggccaacatcttaagggcgcaattatttcttcaatggttgacgaaattgatgaatatgtcgaccgggttaatgaattacgggaaaagactctttctccagaagcagttgcctttatgaaagaatgcgaagccaagaacgattacagtaatcctaagtatcaagaatacgttcaagtaatgaatgaacaatacgttgaccggaagcagccatccaagctttatcatcttaaagaccttggcggcacagcggtttacaacgtcttccaaggtgataacgaatttgtgattaccggtaagcttaaagactggcatttccgtgaccaattgaagaatattaaggtgccaactttaattacatttggtgaacacgaaacgatgccaatcgaaactgctaagacaatgaatagtctcattccaaattcacagttagttactactcccgatggtggtcaccaccacatggtagataaccccgatgtttattacaagcacctcgctgacttcattcggaatgttgaaaataatacgtttaataattaataaaaagaccgaggaaacgtttctcggtctttttattaattattcatgaatcatattttaaaaatatcttaactagaactaaaatattaaatgaatatggtacgatatttatacgataaatacgaaggaatgattaaagcaaaaacttaatacggcttcactgatgttgttcgcttaaggtgtgggacctttaagcattagttactttactcaatttatatatttaaggggaaaaatgaaagaaaattatcaactaacaactgacgaaataaagaaagaataccaattaactgattttactcacggcctatcaacccaagctgtcgaaaaacggcttgccgatgaaggacgtaatatcattgaagtaaaaccaacacccaagtggaaactattcttacgccagtttaacaatattgttatctacattttattagccgctactttactgaccgttttaattggtcactatactgatgcgattgttatcggggcggttgtcattctaaacgcgctcattggttatttccaagaatcaagcgcagcgaatgccctcgccaaaattaaagagatgatggcgcaacatgccaccgtctaccgggatggtaaacgacaagatattgatgccgcggatcttgtccgtggggatgttgttttcctcgaagccggtgataatgtaccagctgatttacggattgtctcagctgataacttacgaattgaagaatcggctttaaccggtgaaactaattcggttatcaaaactgatgaagcaattaccgaccaagacgttcctctcgctgatcgtgttgatatggcatatgcttcgacttcagttacaagcggaagtggcctaggagttgtagtcgcaactggtgaacaaaccgaaattggtaagatttcacaagaagttgcgcaaatcaaatcaaagaagaccccattaactaaagaaattgaccatgttggaaaggtcgtttcttacattacaattactgcttcagtgattgttttcgttgtcggtttcttcctcgaaatttactccttgcctgcccttgcgcttgcagtcgtggcaatgttggttggtgcgatcccagaaggtttgcctgcaattacctctgttatcttagcctttggtattagcaaaatggccaaagagcatcagacaattatcaaatcaatgcctgctgttgaaacattaggctcggtcgatgttattgctactgataaaacaggaactcttaccaaaaacgaaatgaccgccattgagttatgggtcggcgataaacactacacggttaccggaactggttatgctcctaatggtgagattctcttaaatggcaaaccagctcaactgacagatcagctcaaacttttcttagaggctggataccaagcaaatgatacggctttaactgatgaagacggcacctggcatattaatggtgaaccaactgatggagccttcttaactctttatcacaaagcgtttggggctaaatatcaatcgccatataaagctgttgacctccttccatttgattctgattaccgttacatcgctgaattaactcgtgatccagaagataaacaacaagtaatctttgttaaaggatctccagacaagctctttgaaatggccgcaaaggaagatccacaatttgatactgccaagtggcaacaacgggtagatgactggtccaaagccggaaaacgagttattgcggttggctatcaacctgttaatggcaaaaatctaatagaagtcgaacatgaccacctctacaggggaattcacttacttggcttagctgctcttcaagacgcaccacgcgaagaagtgattgttgcgttaaagcaaatgaaccgtgctggtgtttccattaaaatgattacgggggatgacccgcaaaccgcccgtgcaatcggtaagcaactaggcttatcgacgggcccgatcaacgcaatcacaggtgcagaatgggataaactttctgccagtgaacgagaagaggccgctttagataaccaagtctttgcgcggacgactccacaaaacaagcttgaaattattgaagcgctccaaaatcggcaaaagatcaccgcgatggttggggatggagttaacgatgcacccgccttaaagaaagccgatattgggatttcaatggggatcaagggaacggacgtcgctaaagatgctgctgacatgatcttaggaaatgataactttgcggtaatggctgctgttatcaaagaaggtcggcgaatttacgacaatatcaaaaagagtatcttattcttattaccaacctcctttgctgaaggattggtggttgccttctccattcttactggtcagcaagttcccctccaaccagctcagctattgtggattaacttaatcgccgcaatcactatccagtttgcgttcgtctttgaaaaagcagaaaagggcatcatggatcgcaatccgcgccctgtgacccaacgattaatgaatcgacatgatttaatccagatgggttatgtctcagccttaatggcgctgttcgccttaattggttacgaatggttcatcagtgctggggcagacgttgtcaacgctacaacaatgatggttaataccattgttattagtaaggccttctacttcttcagcattcgaactgaacgatatggactaaaagaagttggaaatattggcaagaaagcctggggcgttattggattgatgattcttttccaattgatcttcacctacgttccatttatgcaggctgccttccacgtgaccggaataagtttactggaatggctagcagtaattgtcttctcttgcttaatcttcttatgtactgaatctgataaaatgattcgtttccgtctaaatcgacggtaaaattaacgccactgaatgagatttttcatcttcttcagtggcattttttaattcataagctttcgtaatgttttgaccaaatctatgtaagcgtattccaaaatctgatataatatacctaacacatagaaaaggagtcttatcatgaaatatcaagaaaccaaagaaacacttaatcaattagttgctgatctgagtcaaatggcaatgataattcatcaaactcactggtatatgcgtggcactaactttctaaagcttcacccattaatggaccaatttatggatgaaatcaacgatcaacttgatgtaatatctgaacgattattaactctcgacggtgaaccttattcgacccttaaagaagtcgcaacccatacgaaaattaaagactggccaggaaactttgataaaacaacgccagaacggcttgcgcatttagtcgctggttatcgttatcttgaggacctttatcagcatggaattgaagtgactgacattgaaaaagattattctacccaagatatcttcattggatttaagacggcaattgaaaagaaaatctggatgctgcaagcagaattagatcaggcaccagaaattgacaactaataatgaaatcggcaccaaactaatcgagattcgaacgtttggtgccgatttattgtctaaaaattattttttctgattatctaggagtccttctttttcatcttttaatcgcaagtcatcaagccattctacatgcttttcttcataactacgatctttcttgataaagaagtatgctaccgcggcaagaatggcgatgacagttccgacaagcaaggtcttagccgtaaaattagtaaccatgtaacaagaaactaacaatgcaaaaatggggataagatatttcctgggtaatttgaaaccatgtgttggatattcgttactatgttcaaatttaatgacggcaagaattgagggaacatattgaatgaatgaagctaagactgtacaactaaccaagaagagataactctgggtagcgaataaagcagaaaggatggatgttaataaaattccgactcatggggcatcattcttattcttcttcccaataaactttggcaacatgccgtgctcattggccattgaagtaattaacgatggcgtgttaaacgaagatgaaaaggcaaccccaaagatacttacaagcatcccgaaaataataaaggcatatccccacttaccaatagtggttccgagtcctttcgcaagggcacctcccaaagcattagccagtggtgtcgagtagccgcctaatttagtcccggaaagtccaacggcaacggtcatcatcaatgcatccaaaatagttacactaaccatgactgcaattaacacccgaggaatattcttttctggattcttcatttgcttagcagcaattggtaaaaatgaaaaaccagtaaaaagataaaagatcggggtaaaggcttcaccaaaatgatgaataaatgacattggtccctttaaagctgcttggggaatcactggtgagaagttagctttatggatgaagaagaccccaacgacaataaagatgatcagcgtaaggatcttcgcagccgctgatacattattaaccagtttaacaaggccgtggccgaagaaattaataactgcaaagagcacaattaagccaaaagcagcggctccatagataagcggccgattaaagattggcaaaaagttcttgagggtagttaataaggcaacaatttccgctgaatgggtacagcagcctaagaaccaggtaaaaatccctaactcataaccggtaaatcggccaaatgcatgataagaataaagccatgctgcacctgagccggtaaaacgactagaaagatcggcataacatagggcgatcaatgaaacggttattgctgtacatagcaaaactgctacagccgataagttcatgtaccgataaataacagatggcagtaaaaatgttcctgaaccaattactccattaattcctaaaaagtaaatcgaaatgaatgatagctttttaggtactgatttttgattactgataatgaccaccccacataaaatttataattccatttatattgtagtcttttcaaataaaaaggtaatttatcagctattctaatctcaatcttttctgaaattgttatacaattaagaacgtacttatattttataaaggatgaataaaatggcacagaagattgagaattttatttttgatattgacggcactttaattgatactattgatatgtatatgccagcaatgattgatgttttagctcaacatggtcacccagttgcacccgacaaagtagagcaaactaagcatgacttatttggtattacgggacaagatgccctccgtcttgctggaattagtgaggatgaaattccggcgatccaacaagactggtttaagctggcttatcaacgtgctgatcaagtaaaagtgattgaaggaattccggaaatgcttaatacccttgccaatcgtgaagatgcaaggatcgccatcgcaacttcaaaactcgctgacgaataccaagaatacttcgttaacaaatatgactttgcaaagttatttaaggttgccattacgtctgctgatactaaaaagcataagccagctccagatcctattttagcggcaatggataaaatgggagcagatcccgccactactgtttatgttggagacacgatcaatgatatgaaagccgcccatgcagctggtgccaagtttgcaggcgccctttactcttctgcaaatcccgatagtattaaagatgcggacttcccattaatgaagcccgctgatctcttagaaatttaaaacaaataaggagtctctggtgtttagaattcaaacgttagagacttcttttaattgttattcatgtccaccttaagaattttattaataatactactttggagtctttacatgctctgcaacatattcttgagccgttttttctggcatttggtaaacattaacgagagcgaccactatttctgacggtgcagtcttttgactggctaaaaacttaactaatttttgtttcgactcttctctttcttctcgccgtgcgtccattaaatcaagctcgaacttcataaagcctcgtctcctctctggctcctgcttaatcttaataatctcgtcttgaatcttaataataaacttactcttattgtctactcgactacgcattaaagcaaggaagttcttaatcggctgctcatctttagtaaattctttagccaaggcattaaagatcacaactgtccgttggtcgcctaatttcaactgatgattacaagtacacgccatttcaaacacataacgggcccaaccatagccaaaataatcaaaatcacaaaacatgagcacataggtcggatgaagacttaaatcgcgataatccttgcccggcaagagtaatccatgatctatttgctcttgacaataccgcaagcgataaggcaaattctgtcggtcagctacctgcatctcaataacaataatgttgccatcttcatcctacacataaacatcataacggacgcgccggccagctacgacattaatatccttttgagttgttaactggacgatttgagttgcctttaaatggggtaatgcacgattaatcaattctaaacaaatttctttattctgcataaccatcccgaacattggatcactcgtaatagtcatcttttcccacttttcgagggccttttcatagttctctggcaatttcttacacatttcctcaatcctttcacttctacctcactataaagatatatacgtaaaaaattgccttttgcactaaaaatccctaagtcagtattgctaccaacttagggacttcaactatccaactgaaatatacattaattgccggccttcgtaatctacggattatcctcgccagctatctcttcattcagcagaatagccagtcagcaaatcattctgttacacaagaaataattattcattaagaaaagacttaagattaagctctcataacttaatcttaagtctttttaatagtcgtcaattatagttatcaatcaaaattaacgtctgaattttgatgaattttacttgtttattgcctttgaccacacaagagtccctttctcgttggtaaatcttatcatgtctaccaggattcatagaaatcgtcttggcaccatctcttataattaccctttggggaccatttactattgcatccctttttctaacttgaactactcccacttagctaaacctacggtttaattgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgagcctttaagaaccgacgactacgcaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgttctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatactaaatatatcatagaacaaaagaaaaagcactaacgcgctttaagagagcgattcatcccctacttatagaagtaggggtattctcgcaaatttatggataaagcgagtaatgtttgttttgacgatataattttttggctttctttaagcttactactttaagtggtcgggctccctacgcgtctcttccgatatatgcaatactgaaatgttggcgcaataaagtgtttgtagcgttaaaaatataataataattatagagcacttttttatctttatcgaagtatctaaattctagtgcttcagtcttatttggagtcaatgaattactggcgtttttggttcctaaataagtaaataaagcaattgaaaggccaaaagcgatgagggcgatatacccccaccgcttattatttttttctgggtgtaattttgcgtgaaactagccgatgattaccttgacttagcttcgtatgacatactgaacattctcgtgaccctaatgcattaacttttccacaattaggacagactaaggcaagcatctgtcctttaagggatttcccacaattctcacagacttcggcatcgtctggatttaatgtattacagtagggacattttttcatttagtaatccccattgaagagctgtgcattgccattcgcttatcgggatagagtttcttagctagggcggttaccgctgtcggtgcttcaccaaagccggccgcaatcaatgcgactttccccgggtaggtcacaccatccccgatcgcatataccccttcaacactggtctccatcattgaatcgactttgatcaagttgcgctctgctgctaagtcaagggaccactgatttaaggccgcattgttagaagtaaagccatagttaaccacaatcttatccacattcaattgtgcttcgtcgtcactacgcatcttcttaagatcaagcgttaccgtttcatcgtcttccaccgttaatgcgcgtggtaagaaaggcgtatctagttgtacagatgactgtttaagctgagttacagtatgctccagaccgcggaactggtcccgccgatggacaaggtggacttccttagcaacgggttcaagcatcaaggcaatatcaatcgcggagtcgcccccaccaagaatggcaacccgcttgtccgcataatcagctttatgattaacaaaatatgaaagctgcttgccttcaatctcagctgctccctctaaagcaagcttacgcggagtaaacgccccgttaccaagagcaatgattactgctcgtgaccgggatacccgctttgctgatttgatggtaaaggttccatcgtcttttttaatgacgtcctcaacagtttcaccgaggaattggtcgatcggtgccactgccatttgctcttctagcttagcaattaggtcatgtccagttacacctggcattcccgctacatcccaaacttgtttttcaggatagagtgcccctacttgtccgccaagttgtggaaggctttcaattagctgggcatctaattcatgaaggccgcaataaaatgaagcaaacatccccgctggacctccaccaataattgtcacatcgtaaattttctctgccatttctcctctgatcctttcattttcatctctagaagtattatatcatctttatttttctaaaatttagtaagcggtctcaaattttaattgtaattattcaaaatttaaattaacatattatatacagagattgattttgcttaaaattggaggaataaatactatggcaaaacgtaaaatgattcttgatttagatactggtgttgatgacgctttagctattgcctatgcgctcgctgacccagaagttgatctaatcggaattgtaagttcatatggtaacaacctattagatgtttgtgccgaaaacagccttaagttattggaattattaggtcacactgatattccagtatttaagggtcttccacattcatgcactactgaacactttgatgtaatgcaagtttcaaaggatatccacggtgataacggtatcggtgatgttgaattacctgcgccaagtcgggctcttgaagaacaatccggtgttgatttctacatcgaagccgctcacaagtatggcaaggacttaatcatcatccctactggtccaatgactaacttagctgctgctttgaagaaggatcctgaaattgctgacttgattggtaatgtcacattcatgggtggtgccttaactgttgaaggtaatgttactcctgtcgcagaagctaacattaaccaagacccaaaggctgccgatgaagtaatgaagtccaatttgccacttacgatggttggtcttgatgttactcttcgtactcttcttactaagaacgaaacaaagcaatggcgtgaattaggcactgcttccggtaaggcttttgctgatattaccgacttctacatcgacgcttactacaaccttgatattgataagcgtggttgtgccctccacgatccattagctgttggtgttggtattgacccatcatttgtttcaactattagcttattcatgaaggttgtttaccaagaaggaccttactatggtcggacaatcggtgacaacgctaagttaaacgatcctaaccctaatgttaaggttgccgttaacgttgacaaagaacgttacctcaaggccttcatggaccacctaaacaagcttttcaaagaaaattaaagtaagtgggaattaacctcctcgacaaggcggtgggctaaggatagaacggtgattagcacggcacaggctgattatcgttcggacttagacttgagtcttgtggttaatttccacgatatcttaacaaatattcgcattaagaggctgttgaaaataattctccagtctcttttcattttacaaggcgttattctcctgtttttcttcgatagttgttatattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgtcgtggaactaacactttattatgatgatcccaggcgatttcctgctgagcctttaagaaccgacgactacgtaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacaataatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttttggatttaaattgagggaatttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcataattccattcttgcaaattaatgccgtatgcttgtcccacaactacaaaacgatgtttaagatattcagatatttcatcgttaattacttttcgacgatacttaaccaccattaccaaatggtaattaagcaagtatactgaatgctgatttctatctaattctattgttatcaccacattttatagatatatactaaatatatcatagaacaaaagaaaaagcactaacgtgctttaagagagcgattcatcccctacttatagaagtggggtattctcgcaaatttatggataaaatttgtataagattgttttgattttactaaggaagtgtcttatcaatgggtcgtttagataataaagttgcaattgttactggtggttctaaaggaattggagctgctgtcgcaaaaaagtttattgaagaaggcgcaaaggttgtttaaccgctcggaagatggatgaaggacaaaaagtcgctgaccaattaggtgacaatgcgatctttatccaacaagacgttgctcggaaaggagactgggaccgagtaattcgtcaaactgtccaagtcttcgggaagctcaatattgtggttaacaacgcggtaattgccgaatacgccgatgttgaaaagacacctgctgaaatttgggataaaacaattgctgttaacctcaccggtacaatgtgggacactaagcttggtattgaagcaatgaagaacaacggggaaaagaatttgatcatcaatatgtcatccattgaaggactaattggggatcctgatctctttgcctacaatgcttctaagggtggtgtccgcctcttaactaaatccgctgcgcttgattgtgcccgaaaaggctatgacatccgtgtaaatacaattcatcctggttatatctcaactccactagttgataatttggttaaggatgatccaaaagcagaaggacacctagaaagccttcatccccttggccgtcttggaaagccagaagagattgctaacctcgctttataccttgcctcagatgaatcaagctttagtactggtttggaatttgtcgctgatggtggctatacggctcaataatattcataaagggagcgatcgtgacttcgtttttcgacgcgaagctagcctctgggagcccctgcaagcaacaataggcctccaacgttcggttttaccggacgttggaggccattggtgtactgcgccatttgtcttttatgaaaataacttggcttatgtcacaatccttttgtttcacattaaattccgaattaccaatgaaattgccaaaatcaatgatccaatcccgacaattatttgcataagacggccaggcaggtggcgaacaataatcggtcctaagtaacccccgattacatttccaatcatcaacggaataacataattccaataaattgtcgtctcaagggcgaacactatccaggatgttgtatttgtaacagtcatcgcaacattttttagcgcattattaactgcaaagctcttttgccgattgatcactgtcagcaaggttagcattaacactccggcacccgcattaaagaagccggaataaatcccaacaataaaaataccaatgattgataaaaattggccgatccgtgacttaccaaataatttactgtttcctgccatcgtccctgtactttgcttcggatgatggggaaacaacaagataattccggctaacgcaatgcataatggcaccagttccgcaaaccacttactggggacagcaaatagcaaaaaagccccaataatggaaccagcaaataccaatggcaaaataatccataattgtcgccgattatgctctaattccttaaacgatgaaaagaccgaactatagttaccagtgactgtcgaaaaagcactcgttacgtttgccatcactggcggtaaccccaatgcaagcagtgaaggataggagactagtgatgctaaaccagcggctgcactaataatccccgaaagaattccaattcccagtaataataaaacaaaaactactccactcatttttgaaccatccctttaaatgctagtactaattgtaaaccacttttctaagataagtaacctaattaacgatttgcattctgttataatattagctatgataatagagaataaatctggggtgccaaacggctgagataatacccattgaacctgctctggttaataccagcgaagggagattcagtgatattaacttaatgattaactccatgattttttgtcatggagtttttttgcccttatatcttaaggagttttattatgactaaacgttcattacatttgcgtgacattattttgcttgccctgattggaattatttttggtgtaatttattttgcagccagctttgtctataacgggctaactgttctactgacaccaattggttatggtccaatggctaacgatttaacaatgggaatctggtgtatggctggaccgcttgccggctttttgcttcggacaccgggagcggctttccttggtgagtttttgggagcagccgttgaaatgcttctcggcgatcagtggggagcagccaacctaatttctggagcggttcaaggtatcgggtctgagctaggttttacttttacgttctataaaatgtataactggttaaccctcctcatctcatccctcacccttacatttgttacctttggctgggattggttccgcaatggctataaccacttcagcggacaaatgctaatcattatgctcatcgcccgtttcatttcaatgtttgtcttctctggaattctggttaaattgattactaaccttctccaacgagcccacttaattaaacactaagactatgaaaaatatacaatttaatgatctttcatttaattttgatcagcaaccgattcttaaaaatatcaccgccaaattcactgttggaaagattcacttacttaccggggtttctgggagcggtaaatccaccattctcaagttaatcgctggtctcctgcctaaatatggtggtgaaatagttgctggagcagtcgatgtaccaacagatgcccatatcgggatggtattccaagatccgttaatgcagtttgctcttgatacgccacgccacgaattagaattcactctggaaaattgccaagtcccaactgacaaaattccagaacgcgttaaagaagctttacaattcggtaaagttgacgaccttgctaaccggttaatcaccacgctttccggtggacaacaacagcgcgtggctttagcagcagctacggcaatgcaaccgaacgtgcttttattagacgaaccctttgccaatattgacgaagaaaaccggcaacttatccttaaacaattagtccgcctcaacagtgactatcacacaacaattatcattactgaccatgatttgcatggttacgagcgactacatccattggtttggcaattaactaaggggcaccttgctcaactttccagtaaaaatagtagccaacttttaacagcgagcgcgactccccaaattaccactacccttcctccgtcaaccttgcccacgattatcaaatttgatgaattagcaataaaacgagagaattattccttacttttaccaaccaatttaggcattgttaaaaataaaataactttattaaccggaccaaatgggattggtaaatctacccttctaaaggcaattgcccgacttttgaaatatgaaggaaagattgactatgcggaggaaaacattcaaaaaatatcacctgggaaatattacaagcatctgggattgattttccaacatgccaacgatcaattcctaaatgtaaccgttggcgaagaactggcattaggctttaaaacttgccagaacccctattttaatcaacaacaagtcaacgaagcattagcagctcttggtctgaacggaagagaagatcaagttgtttattctttgagtggtggtcaaaagaaaaagctgcaaatccttctgatgttaatgcgcggacaagaaaccttattgcttgacgaaccatttactggtttagatccaacatctttaaagactgtcctgcaactaatcaaagcatcccaaaaagaaaaaccacaaactttgttgattgttagtcatcaattaagcggacttgatggtttcattgattatcatcttacaatgaatcatcaacgtcttaattatgttggagggagttatgaatcctagtttaaaattattacttgttattttgctttcacttgagctgacttttgtaactaagctgtggattaatctgattgtcattgtaatgtgtttgctaatccttattcatcagcgatttcactggcgacaattttgctggttggcttttgtccccctctttccggcactagctatttttattacaattgtcttcttcagtcctagtcacagtttctttgatggaactgttctttttagtcgactttacgtttatgtctgccttggaacggtctttacatttacaaccgataccttaacgcttgctcgctcattagaacaaaattgtcaccttcctagcaaatacgcttatggggtgctcgccgctcttaatctgattccgaaaatgaaacaagccgttacaactatttatacgaccggacaaatgcggggtgttaatttacattggtggtcaccaacgctctacttcaaagcgattctggttgctattcaatggtcggatcaattagcgcaagccatggaatcacgcggtttcgtagaaggacaagcacgaacagctaccgtgaatatcccgattaccagccacgattggctttcttttttaagtattatttgccttgtacagataattgtaattgcgctcccttgagttttcatgcgataataatataaaaagaagggactgatatagtgaacgataataatttaacggaccggatcgttaatgctttatcctatttaagcatcttatttttaccagttatctttccactaatcgtgtggataattgcaaaaagcagtgatcgaccaactattgctaaaaacgctcgctatgcattttggagtcaaattttcccattgttatatgtaataggcgcaattttagtctttagtgtcttttcattaacccccgctaacttccacgggggcgcattgtttggaattctcctaacatttgctcttttattagcccttttgttatttatttataatattgccatggccgtgaaaatgctgattggccgtgagtaagctaagagagtagtaagtgggaattaacctcctcgacaaggcggtgggctaaggatagaacggtgattagcacggcacgggctgattatcgttcggacttagcctcgagccttgtggttacgacgcgaagctagttccacgatatcttaacaatgttcgtataaataaagaggctgttgaaaaaaataaatttttccagcctcattttttatccaaaatatcaagtgaggtgattaatcgatggaaatgattttaggcattgttcttctattgactgctgttgttgcagctaatgttgttcatcttgtttaccctaagattccactatccatctatcaaattattgcaggaattcttttagcatccctgcctactgaggccactaactttaccatgcatccagaattattcatgatggtgatcattgctcctttaatgtttaatgacgggcagaaccaatcattccgttatctttcaagcaatattaaatcgatcctatcaatgactgttggattagcacttgtaacggttttgattactggtagttttttacattggcttcaaccaggaacgttctccttagcactcgcctttatgttggctgcgattgttacgccgactgatgcggtcgctgtaaagtcaattactactaatatgaaagtaccgaaaaacgttaatggtgctctggaatatgaatccctctttaatgatgcatcgggaattgtgcttttagatttggcgctggaaacctaccgttctggacaattttcgcttggtcatggaatctggatctttgtttatgttttctttggcggaattatcttcggagcagtgttagggagtctgttaattagtctccgtactagtttgatgcgaaaacatgttgatattggctccatcgttattccgatcaacgtaatgactcccatcgttgtttactggttagctgaagaactacacctttcaggaatcctagccgtcgttgcagcaggagttgttcatagtatcctctatgatcgaatgcggcttacatctactaaagtgcaaatgtctactaccactatttggaacatcattagcgatgcgttaaacgggttagtatttgttcttttaggggtgatgcttccgccggtacttggaaggacttcttggcaaaatctgggtgcaatcgttgccttagcctttgctatctatattattacaacccttttaagattcttatgggtccggtttaagctcgtcaacattcaatcgactaacctcaaccgtgatagtctcttaatggcgttaggaggaattcacggaacaatcactctggcattggctttctcgctgccagttctgattaacaaccatcaatttgcgttccgtaattcaatgatattgattgccgcaattgttattttgattagtattgctgttggcgcaattgggtatccaattattttaccgcctaaatctaagagttattcgaagagtgaatttcaaaaagaacttattaaaacagttcaatatgctattaatgagctacggacttcagaaaaatattccccagaaaaagccgttgttattgaccaattgagtagtcaaatgacgcaataccacgaatttaatcgtaatgtttatagtcaattaatgggtaaagctcatcaaattgaattagctaccttagaccgacttaacgaagaaggccgaatctctgacaaggaggccaaattcctcgttaattttgttacgcggtcgattttccgcgtaaataaacacagctttcttgaattatgggtcatcttatggcaccggttaaaatggcgctttattcgctaccgccatctcaaaaaaggctcccgctataatgtggggccaaaatatcaattaaccaaggaacagcgcgctgaaacagctgagatcctagaaataattaatcgtgaaatcgataaataccttcatttgattgaaactccacaaaatgcgaatgaagttgccatggtacgacggacgtacttccaacgaaaacgattcttcctccacgatatttcgatggataccgacctcattacttctttatttattgaggcatttcagcttgaacatagttatgttcaaatgcaacttgctgatgaccaattttcacaagaattagcaaacgcattaaacgaacagatctcaactgatgaattggtttatactcaatcattagactaaaaaaggaaattgctgcaaaatcttgcaaagcaatttcctttttatgtttaaagaaatgtaagtaaaaaagcaatcaatgctggtaaaaattgaattagaataatttttttggttgcagtaagtgcaccaaataatgcaacaaccatcacaaaaaccaagagcattcgccatactaatactaaggttgccccactaaataaccagtaactggcgatgatagctgctcctaaggcgccgttataaataccctggttagcaaatgaaacccgtgcttcatgctgttgcgtaaacttaagcggtaagtcaaacgccttggcttgctgtgccgggttaccaaagatttctaaggccataatacctaaatgttcgattgcaacaaacatcgtaacaataattgcaagcatctttttcctccaactatttaatatagtgatctaaaaattttgtcaaatggcgccgatactcgctaggatgggtcgcatatgacttcgcgtgcgctgctcctggcactacccataattctttacttccctctgttgcacggtaattgcgataaaccatttcagttggaacaaaattatcttttgctccatggataaatagcattggacgatgattatgatgcagcatatttaaggagctggcttcatgaatgtaaaaaccattcttcacccgattaattaaactcatcgtacttattaatggcacccgtaaaaacttcggaatcccatataaattaccggcttcataattcaattcatcattaagactcgtatatccacaatcttcgacaaatgcttttacttgtgacggaaggttaatgccactagtcatcattgttgtcgcaccacccatgctaacaccaaataagactacctgactatcttccccattatgccgaataagtttattaatccatttacgaatatcataacgctctggccatccataaccaatgtatttcccttggctttgaccatgagcacgcgcatccggcattagaacattataccccatctgatggaaaagcgcggcatattcgcccatcttctctttgtcacccataaatccatgggcaattaccacatttttagttgtcggtttagcagcagggatgtaatcagcaactagtttataatttccacttgccgatttaattgtccatttttcttttttggcatgcttaaaccacattttctgctcatacaatggatcatttcgtgaaattttagttgaattattaataaaatccttatgccccggtaccattgccaccgagaaaaaatagctactagcggcaaagattgccactgcgattacaactacaattccaatgagccatcgccaaggatgccactgtttcttttttgtctttgttttcaaaataattaaccccatgtcgtatcatttaatcaatgcgcctagtttagcacactttctgttattttgcatattcttttcattcaaaattgttatgctaatgttaaaatagataatgatatattaagggagtgaaataatgtttccagaacgcctacgagcacttcgcaaaggacaaaagataaccttaaaggagcttgctacccatctcaatgaaaaccttggccccaatgaaaagccaaacactgcttcgcaaatcggtaactgggaacgcggtattcggaccccgtcatacgttgaagcacgaaaactagccgaattctttgatgtcagtctggactatcttaccggaaaaactgatcgtgatgattttgatttagcaaaattatttttctcaagtaagaacctgtcgtttaatcaaactgtactttcaagtgatgatcgatatgaaatttttcaactaatcgatggttacttaaagggacggcataatcgccgggatacagacaccttctatggtaagcaagaacaactagatttaaaacttaaataaggagtttctgatgaatcctaaaaaattaaaacagctaaaaaagcgggtaaaaaaagctcatcaaattgttaatgagccttcatatattcaagaactaaatacttaccgtgacctattcgatgactttcctcctgtaaaatacctcattaataatgttttagaaagtgatcgactactcaaaaacggcttattgccacaacctctaccaaaattattattgccggataacattcaagataccattttcaaaaaggttaatgaacagttcccacaaggtgatccacgtggcgataaactttggaataaatatagtgaggcgttgccaaaattagataaggcgttgcgcaactatcgtgattatctcgaggaaacatacggaatgtggtcatacgtcaatgcaccttttgccaaagcactttctgattatttaggtggggcaccgacattagagattatggccggtaatggttatatttctaagggattacgcaataacaatgccacccaaaggatttatactaccgatagtcaggcatggataaaagaaaacgaaacgggcaaacaccctgtcactaagattgagaagttggacgctctagaagcaatcaaaaagtatggtgacgaggtcgaatatgtcattatgtcatgggctcccgataagggtgaaattgactgggaggtcctgaaacttcttcgttcaacattccctgaagtcaaattattagttattggcgaaaaagatggcgcaactaactctaagaaattctggcaagaagcccaattgagtcaagacgatgagttacagaaagttaatgctaacttgcactcgtttgatttgattgatgaacagatttatctagcaaaataaaaaagttgaggttaaaagagaacaaaagttttctcttaacctcaactttttatttaatcaattttagccactaattttccaactacttcatgatttttaatcgctgttaagcccttaataatttgatcaaacggaatcactttctcaatcaaaggctttacatccccattagctattaattttaacatttccgcattcattcggcccaaatcagcttgctgatttgggttgccactgagatgcgccccaccaagattaacgacatctatccctagaccgcgatcaaacattggaacattatcaagtgaaggaacgtcaacaatcgttactaagcgtccattataggctaaccgccacaaatcaagttctgcttcttttttacctaccgtatcaatgatcaaatcaatgccaagcccatcggtgagatcggctaactttttatccacatcttcagtttgatagttgatgattgtatctggagcaagctgctttacatagtcatatttactagatgaaacagttgtaaataccttacaaccatgaagtttagcaagttggatagcgatactgccaagcactaacgccgccttcaacaattttatagtcgaccggattaagcccagcagcatgcaccttaattagaacttcatgttcagccggcgtaggaactggggcttccgcaaaattcaaatcttgcaatgaacgatctgctgctttttcgactactaaggctttcattttttcgctctccttaattttataataattattataacactttgcctaggcattcttcatagccatcttattaaggtagtgccaaatttgcgaacgatatttccgtaatccgaataacatcacaagataaatgataattgctagtgaaatccaaacaggactttctgatataaaggcagcaaaaaccaatgcattcaatggtcgcgccactaaattaaaacttgttaccaggactaccccggttggaattgcaacgccatagtgggccactgctgcagtatagaccggactgagccaactggccgcatataagcctaaactaaaccacacaattcccgtcgcaattacttttaagatatttccacgagtcaccgcgacaattgattcaatcatgtacggaattgcaattaaatcaactaccggaagggtcttattgccaggaagaataaaagcaattaaaaccataatcgggattaaaatgattcctgaaattaaagtggctgattctccatagccaacgccatcatcaacagctaggaaccaccgctttttatcataacggctatttttattttcgccatgtcgttttttctgctgctcatcaatttcattcgcaatgggaataaatgcctttgcgaatacgtttgtaacaaggggaaagatcgccataacggcagctaattgaatcgcaaatttagtaatctgtccccaagcgcttattttccccagtgaagataaattacccaagatcccaattattaatcccaggataattcccattgtaattggttccccaaagacacctagttttttctgaaaatctttaggagtcattttcactttgttaaatcccagtaaattccataacggatctaaaataatcgctggaaccacttgctcgatattatgtaaggagtcgacagtggtattctcaattccataatagtctgcccaccgatctgcttgaatttccgctaagactagtgagtacaggagcataaaaaattccagccctaatgatagccaataattatgagttacataaaaagctagcgtgccccaaatcatatacccaaaattattccaaatattagaaggcagaaatactttggtaacgccaagcgcaaataaaattaattcagttagtaatccaaaaacaaaaaacgataaaccaaccgttgatccaaacgctgctaatgaccctgcttgccagccgatatcaaccactggtagtttaatccccgtattatcaaccatttggcggacaatcttagtcaccactggcgtaaattctgtgataatccaggtaaaaccagttaaaccgacaccagcatagaaagcactcatcattgctgtcttaggctgcactcgtagtaataaagcaatgataaaaattattattgggacaactacactcgcgccaaaagtttgaaaaatagcattaacttcttgaagcatgttttactccctccatcgaataaactgttacctatattttccctaagactggtctttttagcaaggcaaaaggtttatctgcgtttgctatagaaatctattcagaaatttgctacagtatgatgagtttaatctattagggagggtacattttatgaaatatcgtttacaagctattatttttgtcttcgttgcctttatgctcgggtgtaacgaatatatgattgtcggcgttttacctgatatcgctcacgaataccatgattcgcttggtaagttaggcctacttgtaactgtatttgccttggtttatgctattttcactccgattattacttcaatggcaaatcggtggcgacgacatcatgttttattagttctcatggtcatcttctttatcggcaatacgtggacagcaatggcgccaaactttatttcaatattgctttcgcggatcctaactgctagtgttgccggtgcgattatctcaatggtcctcgtaatggcgagctatgttgcgccgcgtgaaaaaagagcaagcctggtttcatgggtttttgctggatttagtatcgcttcagttatcggcattccaatcgggaccgttatcagcactacccttacttggcatgacagtttttggatgatttctggaattacgatcattgtttttggcgccttgatttggctcgtcccacgtgatacgcctcaatttaagagcacccttagtaaacagtttgtgttatttaaggattcacgaattattcttggtgttagtttcattgttgctgtttgtgcggccgactacacaatttatacctatattcgtcctttaatcactaacgaaatgggctttgataacacatggttgaattggctcctattcggaatgggaatcttctttattattggtaataaatttggtggatacttggctgaccgtggcggaattcatcgtctcagtggaatctacgcggcaatgacaatcttatttctcatctttggtcctgtcttaccattccagtggggtgccattattattgtggctgtcttatgtattgccttttcatgctatggttcttccacccaattaatgttccttgatattgccgaaaaacaatatcctcaatcacttgacttagcttcatccttaaactcaatttttgctaatattggtatttcactaggctcttttactgcctctcaggctgtcaccttcactgccatgaaaaatctcggttacgttggcgcagtctatgggcttattgcaacaatactagtcatagtcctgagtaaaaaatatacgggaatgcgcaattattaatcttaactttgagtacagatttttccatctgtgcttttttatttcccgggaaattaatatgcaactaatagtagcggggtgagcaattgttgttatctaaggattctattgaccttttgattagatccaattaaattctaaatatagattttgaaagggagctttttgctatgccgtattcttttccgcatcaactgctcaaattgcggactgaaaaacaattatcacaagctgaactagctacgcgtctattcgtttcccgccaggccgtctctaaatggtaaaatggggatgctgaaccaagtatcgataagctaattttgcttgccaaggtttttaatgtttcattagaccgccttatcttgggaacaaacgactttaatcaaccagtggtaaaacttaataatattgttaaaacttttaactcaccagttctcaacagccttgatttaactattcacaataatgaacgcattgcccttcttggtagcaatggcgctggtaaaacaactttagtaaaaataattgaaggtgctttgaaacccaacaaaggtactgttaaatggtattttagtaaaaatgattctttaaatatcatgtctcaagaaaatgttttaattccaaccctaaaagttaaagagcagattatcttgacagccgccataactaaggtcggttcaaagcaacgaatcaattatcttcttgatcaattcaaattatcatcccagcaaaatacaattattgcgaaattatcaggtcgacaaaaacgtcgcctttcgctcttgcttagtgtcctccgtcagtccaagcttctgatcctagacgagccaactgttgggatggatttagaatcaattgactatttttggcattttattgaaaaggtttcgggaagtattttagttattactcatgatttcaatcaaattgataaattcttttcccgtgttctgctccttaaagatggccaaatctctcaagacatccctgttaaggaaatccaccaacataatcagacaatcgaacaacggtatcgtcaacacaatcgttaggagttttcttatgagcattatagcaattcaactaaaacaagttttgcgcaatcgtcgtttctttctttttactattctactgccaggtatttggtatgtgtttatgattcaagttgctagtacatccctccccgccactggcaacttccagctcgctttacttttgcttgctctcctgatgggaatactcggtaattcgatcgttactttcagcaaacggatttgtagtaataaggacttctatattcttcaatcgcacattagccattattctctgtgaaactatttattttcgcaattaattacccaagtcatcatcaatttgttcatcaccatcgtaattatgattcttgctattttccttcatactatcgagttcaacttcattactatcactagtattttgttaaccaatatcatcggaatatatctaagcgtgatcgggtttgcaattgggctttcctttgacgcaccaactatcgatgccgctggaaccccaatcctatttataatcgcaacttttattattccgtggaaacacctcttaccagctaattcttttattgatttctttactaatgttcaaaagctatttccaacttattatctttacgacgaccttgaccatctatcggttagtcatcttggactactatttgtaactgcgattattactctgctaccttggcttagctttatctatcgaaaattaatcaactaaaaaaccggaatacctagtactaaacatactaagtattccggctttttcgtgtattgatattatctcaagtcaatcagcactgtccacatggccgattaactagacacctcacaatccggtgagttaatgtgtcccacttgtcaaaatgtcaatggtagctcttagggtcgctaccagacctctcgactcatcgcaaattataatttagcatatttgacctatggatgcaactcttatgctcttgcttccattatatctgcaaggtgttcggctacccattcttgagttttagtaatcaaatcagttgtctttccactttgatcggtttcatttgctaattcatcgatccgcaatcccgttttattaatatcttcactctccattactaaataaagattaacagggtactcgatctctttatccaataatttaacatctaatcgctctgcctcatccatcggtatgttgattaggttggtttctaagcgaaagctaactggatcaccttttttcattttaatgttcatcttatattgaccaaggtgtcccgtatcaagttgttcaatcataaaattaattgcagttgttaatactgttttttgctgtgattgggcagcagttttttcaacttcttctgtcacaacctgatcgctcgtcaactgtgacaaataatcagctactgacatcttcattttttcatttgctccttcattttttcaattttagcttttgtatagtctgcacgctgttttgcaccataataaacaccagcagctcccactaaaattccaacaatacttagtgcttgaataaataatccgtatgcactttctcgtggacttaccatttgaaatgcggctaaactagcgattgcaaaataaagatttactaaaatcgttgcatatccacaaaagcgcatctttaaaaacgataatccgttaacaatgattgctaaaacaataaagaggagcagccgcggccatacagatgatgatgtcagcgagtgaccatgctgaacaaacataaaagcatcaaggactaatgcaattactgctgctactgatgttacaataacaactttttcattatttttcatttattttgccaactttcttttttgctatccccgcggatgaccaatatttttacatcccttaattaacgaaaagtaagtgggaattaaccttctcgacaaggcggtgggctaaggatagaacggtgattagcacggcacgggctgattatcgttcggacttagcctcgagccttgtggttaatttccacgatatcttaaacaatgttcgtataaataaagaggctgttgaaaaaacaaagttttttctcagcctccattttactaaattaagttaaaaagctcaattatgcgagtaaatcagctacttcagcggttggaattcccgtaatatattgttgggttccttccgcttcaaggactttagcaatttcatcatggtcatacttaatcccttggagcttttctgccagttggttaatatcctgtgggccaaagaaatcgccatagaatttcacgtttttgattacgccatctttaatatcaaagcgggcatcaattgtccccatatcaaagtgtttccgccgcttaaccgtaaactctggcgacttaccatagacccaatcccagttgttatagtactgctcatagatcttatcaatttctttttgatcttcaggggtaaccatgtattgcttatccttaatctcctcaaggtcgtcaacatggaagagaccttttagcaattcatccctaaatgttggcacatcaatatcttggtacttttcatccaagtatggacgaagattcgtaacccgtgatcgaactgatttgatcccctttgaagcaatcttatcttttgccacatgaagggcatccgcgacgacacttaagtcaacatcaagcattaaagttccatgggagaacgtctttccattacgtgaatacatcgcattccccgagaatttcttaccatcaactaaaatatcattacgaccgctgacttctgcactagtagcacccatttgatgaagaacattaacaattggctgggtaaacgatttaaagtcaccgaattcttcactatcacttgggaccacaaaactaaaacagaggttccctaagtcttgataaacagcaccaccgcctgataaacgtcgggttacccggatattgtgttcctttacataatcatgattaatctcttcaagcgtattttggttccggcccacgataatacatggttcttcataataaaatagtactaaaggctctttcccaaaatccttattattcattaaatattgttctgtagctaaattcattccaatattatgagaagtcattgaaacataacgcataactagcaccctcttataaaaacatcaacataaatagactaaaaatttacttttgtcatttagtcatccatttgtagtgtacgtcttttcgtaagcgtttgcaatatattatcgacaaagcaaaaaatactttcttttttacatctttttagggcgaaaacattttataataaaggtataaactttcggaggtgtctattatgacagaaatttatccatacaaacacattctagttgctgtcgatggctcaaaaattactagtaacgtcttagaaagtgccattgattctgcactacggaatcatgctagccttgatatcttacggatcgttcaagtaacgcaactaacagatggctatagtaatgcggcccttagcaacgaagaaacatataacattgttaaaactaccaaggaacgactcgatgacttgaaaaagcgcgcggtcgatgcgggggttgaagatgttaacgttcatatccggtttggaaatccaaaacgtgttattgctcatgaatttccgtcagatcacaacaccgacttgattattctcggtgcgactggtgtatctggtcttgaacgctttgttcttggctctgttacccactatgttagtcggatggcaaaatgtgatgttcttgttgttcgcaaaaacgaccatgttaactaggtgaaaaaacggtgaaacaaattgttactggcatcgttgctcatgtcgatgctggaaaaacgactttaaccgaagcactcatgtatgaaaccggcgctattcgaaagctaggtcgcgtggataatggagatgcttttttagatcctaacacactcgaaaagcaacgtggaatcactctttttactcatcaagctgagctaacatataatgaccttgcgcttacccttctcgataccccaggacacgtcgattttgctagtcaaacagaacaagtcttaccagttcttgattatgcaattcttgtcgtttcagctactgatggcattcagggatacactcgcacattatgggatcttcttgctcgttatgatatcccgaccttcattttcattaacaaagaagatgtgattggtgctgatcctagcagtgttatcaaacaactgcaaaaagaattttcgccggcttgccttaattttgctgatccattaactgacgaagttcgtgaaacaattgccatgcaagatgataaagttttagaaaactacctcagtactggtagccttagcgatcaaacaattcagcaattgattaaacaacgtaaagtgttcccttgttataggggagcagccctaaagttaactggaatcactaatttcttaaatggacttgagaaatggacagttacgcctgcgttttctgatgagtttgcggcgcgggtattcaagatttcccatgatgacaagggtaataggcttagttgggttcgtgtattcggtggcaaaattccagctaaatcagttttactaaacgaagaaaaagtgaaccaaatccgaatatataacggggctaaatttagcccaactcaggttttaaacgcaggtcaagtcggtgctcttactggattaacttccacatcccctggacttggtcttggtaaaacaaagccactccctgcgccagtcataaaaccggtcttaaattatgccgttaaagttgctaaagaggaccttcatgcttgtctcaacgccttaaaagagcttgaagatgaagatccacaactacagatctcttggcatcctcacatccaagaaattcacgttcagattatgggagaagttcaacttcagatcctgcaacaattgcttcaagaacgttaccaattggaagttacatttgatgagggaaacgttctttatcaagaaacgattactaacaaagtcgaaggggtcggtcactttgaaccattacgtcactatgctgaggcccaccttcttttagaaccaggaaaacaaggctctggaattacaattaacagtgactgcagtcttgatattctggatcgcaattggcaacaccagatcttaactagtttacaggccaaagaacatttaggagttcttataggagctcctcttaccgatgtcagaattaccctcattggtggtcgcggccatattaaacatacagttggtggagattttcgtcaggctagttggcgagcggttcgccaaggattgatggaattgaaggaacaaaacgaatgtcaattattagagccttggtatgctttccaccttaaagtaccgaatgaccaagtaggacgcgcaattaatgatattcaacaaatgcatggtacgttcgcgcttgatgaagctaatagtcaagacctaaccctgattacgggaactgctcctgttgtgggcatgcgcgactatgtccaaagcgttcgcacctacactcacggccagggtcagctcgagcttgttgttgctggctattatccatgtcataatgctgaagatgttattaaagatgttaattatgatccggttgctgacctaaagaacactcctgattctgtcttctgtgctcatggtgctggtttccccgttccatggaatgaagtccccgcaatggcgcattatccgtatagaaaataggttgttgataaagagagaggctgagaaaaaacttcgttttttcaacagcctctttatttatacgaacattatttaagatatcgcggaactagcttcgcgtcgtaaccacaaggctcgaggctaagttcgaacgctaatcagcccgtgccgtgctaatcaccgttctatccttagcccaccgccttgtcgagaaggttaattcccactcactctcttttttcattcaattgtcaatagcaatccatacaatgcacctaataaattagcctcattgccaaactttgcggtcattatttctggcatcgtaacatcatcatgaagacggtaatcactcttctgcagaatcataaattgcttctttatttcatcaattaaaattttttgcgtactaatgccaccaccaatgagcacacgttcaaggtcaacaactgtctgaatatttaaaatcaaaacagctactcgccgacaaaacccttcaaataaggaccaaataactggattatgacaattaatttctttaaatactcgtcggccatcagttttatccttaatatcacaaatatcagccatggtttcaatcatcttaactgctgaagtagtagcccccattgtcgaatagtgaagttcaggcgcatcattatcaatgatcatggcacttaattcaccggcctgaaaatgcggtccatgcaagagctgattattaataacaatcccgccgccaacggaagttcctaatgtaattacagcaccattactgataccgttgagattgccaagccacatttctgctaatgtcgcacaattagcatcattaccaacatatactggacaatgagctcgtgattccagataggctgcaaagttaaaggtccccataaagccaagggcgccagtaaattttacctctccagtcgtcggattaacgactcctggaagactgacacaaatcgcagtaaccttttctaaaactggttcaaccacagcaaagattgcagccagaaacgcttctttttgatgaggagttgggacatggtttctctcaaaaatattaccagagtgatcaattaatgcactctttatctctgtcccaccaatatcaatactcaaatactgtcgttgcataactcctcacctcatttctcttatattatacacgactccgctgttgagggtaccaaatacaaatactgatgaataagcccaccagggtaaaaggcaaccaactaaagccaagttgatacaagggaaagtatttttctgcaaaatggattaatgacatgctaaatgtggtatcccgtaaaaccggtgggaaagtatttaccatatcaaaaaatgcaggaatcattgttatacctgtcgtgattcggtaaattaacgaagctcccttgaataggggcgaaaaaatacctagtaggatcaacacaatggctagcgggtaaagaaacattaaaactggtatcgaccatgaaacgatccggtccagtcccatgttagcaactagaaatgacaacaggcaattgccccgcaaaaaggctttataagaaatctgggggaaacgatagtggaagtcctgggcaaaagcgactactaaccccatcgccgttgtcatacacgtgattgtcgcaagggttaacaataatacatttccaaaatctcccatataataatgagcaatttggtttaatgttgttcccccattggctgcgattgtgaattgataccgactcgttgttcccaaataaattagtccaatatacaaaatcccaattcccaaaattccaatcattccacccttggtagtagcaagtgaaactgattgttgagatttaaaaccaagttggcgaattgcggtaataatcgtaacgccaaaaaccaatgctgctaatgcatcaatagtattatatccttgaataaaaccattactaaaggcatgattaacatattctggagttggttggggagtagttgtacttcccattggatgaacaaaggcgagaagaaagatcaaaaataacataataaggaaaattggatttaaaaccttaccaattatttcggtgatttttccttcacgcgttgcaaaaaagtaaacaattagaaaaaatgctccggtataggctaataatccccagccttgcatccctttacttaaatatggcgcaactccaatcgtataaggaacagttgccgtacgcggggttgcacataaaggtccaataattatttgaaccaggataaggaaaataagggcaaaccttttcccatttggtaaagctagttcatataatccatttgcatgtgtaatactaatcgcaagtaatgcaaatagcggtaaaagaacaccggaaagcaagaatccgcccgttgctgctatccactggttaccggctaattgtcctaaatgtacaggaaaaattaaatttcctgccccaaataacattccaaaaattagcgacccaattaccaagtaggttttacacgctgctttaattgagttcatagttaatcactcgctccttttctctcaatttaatctgacgctaaattataccatgaaatagtcgctggaacagaagtacattttaatcaaaaaggaccgttacatcctctcaaatgttaacgatcctttaaaactaattttttaaaaagttagctactagtttcaaaatttcttggcgtcgtgagccattaaacatatgcccttctccaggaattaaatgcaactcactgttaggcatgattacattatatttctttgatgcttcaggggaaaccacattatcagctaacccatgaattagcagtgtggggccactataatgttgcgctgtttcgtaaattggtaaaagctgcgccgttcggaagtagtcgccgccaacggtaaagccatgcatatcaaccgtttctggtatatggttaaggtcatattggcttccctgacaaacaccttttagtgcatcatcttttaaggttgcagcaggtgccagcagtactagttttgtaataatatcgctataataagccgccagcatcaaagcaactaccccaccttgcgaatgaccaattaggtaaatcttctttgcttgcatagttgtgtgagcatagtcaatgattttcattccatccagaatttcactaaaaactgtcatatccttgaattcaccatcactatgaccagtcccatcaaagtcaaagcgtaacgttgaaattccttgttgatttaaatagtgcgaaagagcatacagaattttagaatcatcatatcccagattgcccttaaagccatgcatcagaattgcgactgtatcgtttttaatcgtcgttgttccctcaagaagaccatatagagatcatctcgtttgattgttatttccatcaaaccacctcccacttattatacactgtttgatttaatgttttagcttctccaacattgcacggtggtgtgcctcgtgtttctcatccaccttgataaagaagtaagaaaccgcagccaatacggcaactacaacaccaactgtaatcgtcttaattgtaaaattggttctcatatagcatgagattaagagtactaacaccggaatgatatattttccgagaagcttaaacccgtgattagggaattcattagtatgtttaaacttaattactgctaaaattgatggaacatattgaacaaacgaagcaagcacaatacaagaaacaagaaagaggtaagattgagtaactaataacatcgaaacaacggctgtcaggataatcgctacccatggtgcatcatggcggttctttttaccaacccactttggtaacattgcgtgttcattcgctagtgagaaaattaatgacggagtgttaaaggaggccgcaaacgctaccccaaaaatactgatcaacattcccacaatcactaaaatgtaccccccatttaccgacaccagttccaaaagcattggcaattagtgtactatactttgacatcctagttcctaaaatacggattgctactagcatcattagcgaatacataatcgttacactaaccattacggcaattaatacgcgcggaatatttttctctggatcggtcatttgttttgcagcaattgggataaaggaaaagccagtaaacatatagaagacaacactaaaggctgctccaaaatgtttggcaagcggcattgccccggtggttgctgcatgagggattaccggtgaaaaattagcaaagtgaatacaaaaaacgccaataacaataaaagcaaggatcgtaatcatttttgcagctgaagagaggttatcgaccaacttaacaagcgtccggccgaagaagttaatgattgaaaataataaaattaagccaaaaacagaaacatagtatacccaatgagtattaaaaagtggtaaaaagcttcggagagttgtcaataaggctaccacttcggcagataaagtacagcatcctaaaagccacgtaaagatgccgagctcatagccagtaaaccggccaaatgcattatatgaataaagccaagccgcacctgatcctgtaaaacaactagaaaggtccgcataacataacgcaaccatgctaaccgtaatagcggcacagagtaagacaaggacacttgctaaatccatatctttatagataacttgtggtagcaaaaaagcacctgacccaataacaccattaatacctaaaaagtaaattgaaatgaacgataactttttaggatttttctttttcgtattgataagctccaccttctatcctttataacaaaaataatattatcttcatttaaagtctattcttattttaaaggctttacaggtaagcaagttaaccaatttttatatttctaaacaaaaagagaccgagttaaactcgatctcttttcttaatttattaagtgtttaattagcaatcagtagctgattacttaagacccttccaagtccagttagtaacttctggtaagtccttaccttctgaacggatgtagtggttgtgcttgttgatcatgttgtccatcttggcaacaaatgcagcactcttttgttcgtaaccaggaacactttggatagcgtccttagctaagtggaaccggtcaagttcgtttaatacacgcatgtcgaatggagtggtgatatcaccattttcttcgtatgagtgaatgtgaacgttacggttagcacgatcgaagaacaatgcttggatcatgtcacggaatccgtgccatgcaaagataactggcttgtcagtagtgaagtaacggttgaattctgcgtcagacaaaccttctgggttcttgtcttgcttcatcaacttcatgatttcaatgatgttgatgtaacgaatcttcaattcagggaagttgtcatgaagaatgtcaatagctgcaagagcttcttcagtaggttcagtaccagctgaagcaaatacaacatctggttcgctaccttggtcagtagatgcccagttgatgtagccaagaccattgtcaactaattcagtagcttcatcaatggagaaccattgtgcacgtgggtgttttgaagttacaaagaggttgatacattcttggttacggaatgccttgtttgatacagccataagtgagttagtatcagcaggtaagtattccttaacaaggtctggacgttccttttcaaataagtgagtcaatagacctggatcttggtgagtgtaaccgttgtggtcttgttggaatacagttgaagtatcaacaaagttcaatgctgggtattgacgacgccagtaaagatccttagccttacgtaaccacttcatgtgttgagtaagcattgaatcaacaacacgaccgaatgcttcataagttgcgaagaatccgtgacgaccagttaatgtgtaaccttcaaggaatccttcagcttggtgttctgataattgagaatcaatcatccgaccttgtggagcaacgttttcatcgtttggttcgtgaatgccttccatccattgacgcttttggttgtcaaggaatgcgtaaagacggtttgacttagattcgtcaggaccaaatccacggaagttagttgggttcaattcagccatcttgctgaggtacttaccccattcaagcatatcttgctttacaacagaacctggagtttgaacgtcaacagcaaagtcacggtagtttggtaatacaagtggcttaggatcgataccaccattagtgataggattcatagccatacgacggttaccttctggtgtgttctcttcaacaagagcaactgggtgaccgttttcgtcaaacaattcttctggcttgtatgacttcatccagtcaataagcatgtccttgtgttccatgtcatcttgtgataccggaataggaatttggtgagcacggaatgagttttcgattgggttaccatcaagatccttagtaggaccagtccaacccttaggtgcacggaagatgattaatggccattgtggtaatgaatcatcgttgttttcacgagcgttcttttggatagccttgatttcttcaacagccttatccatagtcttagccatttgttcgtgaacttccatgtgtggcttgtaaccatcgaattcaccatcacggtcagcttctttgtaagctgatacgaagtatggcttccagcccataccttcaaagtacttagtaagttcttcgtcactcatccgtgaaagaatagtagggttagaaatcttgaatccgttaacttggatgattggtaataccgcaccatccttgattgggttgatgaacttgtctgagaaccatgatgccattaatggaccagtttcagcttcaccatcaccaatttcaacagcggcgataacatcagggttatctaagatagcacctacaccgtgtgaaagtgagtaaccaagttccccaccttcgtggattgaacctggagtttcaggtgcggcgtgagatgcagtaccgcctgggaatgagaagtgcttgaataacttagccattcccttagtgtcttgtgtgtattcaggataaatttcagtgtatgaaccatccaagtatgagttgttaaccataacttggccaccgtgacctgaaccttcaatgtagaacatatcaaggtcatacttcttaattacacggtttaagtgtgcgtaaatgaagttttgaggaacaatagtaccccagtgaccaattggcttaggcttaacgtcttcagcctttaatggttggcgtaataatggatcacccattaagaacaaagtaccaactgaaaggtagttagctgcacgccagtaagcatcaacactttccaaatacttcttggaatcgtaatctactgccattctaataaacactccttctatataaatcaatacgtcctgtgctctataacaacataacgtaaatcattaaatttacaatgttaatgataaacttttttttcaaaaagtcaacctttttacaaattgatacggtccaattataaaaaattaatctttttaaggtgttctttaacatttttctatttatcttaatccgcagaaatgctaatttacctttgtttaaccccgttcaataccaacagtgtacaattaaaatttcttttgaaaaaaataaattttacatctattttaatactttaaatactgctatcatattcactagttttcttggtctaggctaacaaaagtactatatttcatgtatttatagtgaattcgcatattagaaacttcaaacggcgtcccatcatccaaaaagaaaatcccttcaattgttccaaccggctctgtttcattcaacttcaataagtcttgatcttcatttgttgacggcgaaacaccaatcgtcataaatgactttgtaacccttttccccatcatatcttctaaataattaaaaattgacccattaacaacttcgggagaaagagtgggcgtaattctaattggaataaaacccgtttcaatcataaacggctgatcatcaattaaccgtagccgtttaatctgataaacaaagtcgttatcattaagaaatagttcttcttgaacatctttacttgcaggaacaacttggtaatcaagtaattttattccttgctttttaccatctacttggaaactgtccgttacacccaaattactaccttcataatggaacaatgactggttttttaggtataacggattaataaatgtaccggatccgcgtttcttaaaaataattccttgctgagcgagcactcccaatgcccgttttatggaactgcggcttacctgatagatttcacttaagcttcgttcatcaggtaaacgcatcccttggtatttattgtctagtattttttgttttatatcacgcatcactgagcgatatactaagtctgccatctaattaactcctcggatttaattaattcgcaatttaagctacacttttagtatagcaggcctattttaaattgggatccttttgtaaaatattggtgcgtcccagataaacttaggaggaaatttttatgagtaaaaaaaataaaaaaagcaaaatgaaaaaaacacaggtagaacaaatcctcgataaaaataacattgcttacgagcaagctgaatttccgactcaccaagatggcgatgtacgttcaatgagtgttgatcataccggggttgacgaacatattatttataagaccctagtattaaccggtaacgtaaccggaccgctagttggcgtcatcccagtcgatacacacttagatgagaaaaaacttgctaaggtttcgggcaataaaaaggttaatatggtgccgctaaaaaatcttctcaaaactaccggatatgtgcatggtgctaacacccctgtaggaatttacgagaagtttgaataccctatttttattgataacgaggccagagaacaaggcgatattttcgtttcgtcaggtaaagtgggccgttctattaaattaaatgccgaagatcttgccaccctagttcatgctactttcgctgatttagaacaaaagtagtttcttgacgattgacccggttaatgttgaagattaaactgattattgtagtttgtttgatagaaaggtcctgaaaagatgaaaaagaatttatctgcttgtaccactgtccttgtgggtcgcaacgcaacgattgatggttcaacaatggcagcacggaatgatgatacatttggtccacttacgccccaacgcttcgttacttatcccgcatatcataatcaccctaaccaagtaaaggcatacttaaataaatgtgtaattgatcgccctgctgatggttatcgttatcaaggtactcctaatgttgattatcgaactgaaggggtattcgatgagagcggctttaacgaaaaaaatgttggaatgagtgcaaccgaaagtgtttatgcaaatgaacgcgtccttgcctgcgatccgcttaataccgaaaccggaatcaatgaagatcttgtggtcgctgctacccttccctttatcgatagcgctcgtgacggggttgcataccttggtaaactagtcgccaaatacggttctgctgaaggaaacggtattatattcagcgacaaaaaagatgtatggtatatggaaatcgtcactggtcaccactgggttgctcaacggatccccgatgactcttatgccgtaactggaaatcgagtagcaatccagcaagttgactttaatgaccctgataactttatgtggtctgacggcatccaagaattcgttgagaaaaaccacctcaaccctgataaatatggttgggacttccgccatatctttgggactgctgatatttttgatcaacactacaacacgccacgccaatggtacggtcataaggtattaaatccggaaactgaatttgatccgcttgattttgatattccatttattatgcaaacggaccatcgaattacccttgaagacgtcgaaaagatcctcagtagccactaccaaggaacaccttacgatccactaggtcatgaaggtaccgaccagcaaaagcatatgttccggccaatttcactaaaccggacgcaaaattcccacgttcttcaggtccgcaatgacttaccggaagctgcttcaacgattatgtggatgagctttggtattcctacctttaccccatatgttccattctttggtaatgctgaagacattgatgtaagctatcgtgaaacaccagagaaactcaatatggatttaaagagtgcttactggatgtatcgggcgctttcaatgattgtcgaatcacaccatgcagaattttctaaggccgacttggattatctcaaagatgcccgtgaatatctctaccgctgggtcaatgaagttgctccacaggttaaggggatgtcatcttctgaagtcagtgctttcctaagttcaaagacgcatgaaatggttgccgaaatggctaaacgaacaaaagctttaatggctgagttagtaatgaatggactcgaactttctaagttaacattccaaatcgataaaaacttgtaaaaataaagatgaggctgagaaaaaacttagggcattatcgccctctgttttttctcagcctcaactatttttatgaacaataacaagataacgtgcaaaacaaccacatttttctttaattatttccagcaaactgactattataaagattagcgtaaaaaccttttttattcattaatgattcatggttacctgtttcgataatcttcccatgattaaccacgacaatctggtcagccttccgaatcgttgacaagcggtgggcgacaacaaaactagttcgttcttgctgcagagcattcatcgcttcttgaatcaagacttctgttcgggtatcaacagaactagtagcttcatccagaattaaaatttccggatcagctaaaaatgcccgtgcaatcgttaataattgtcgctgtccctgtgaaatattagaagcagactcgtctaagaccgtttggtaaccatcaggcagttcacgaatgaaagcatccgcccgagccatcttagcagcatgatagacttcttcgtccgatgtattctcgttaccatacttaatattttcaaaaatcgtcccagtaaagagccaagtatcttgaagaacaatcgcaatatgcttacgtaaggtatcacgagtcattgaacgagtatctttcccatcaagataaatatggccgccttgcggatcataaaaacgctctaaaagattaataatggtcgtttttcctgctccggttgggccaacaatggcgaccatcttatctcgtggtgctttaaggttaaagtcttgaataagcggttcatcagtatagctaaacttaatatccttaaattcaactttcggaatatcctttccagtaagggatggaatattctcaaccttatcactcatctctggttcatctaaaacagcaaaaatacgttctgccgaagcaattgtttgttggatggtgttacttaaattcgcaatttgggcaattggttgagaaaactgattggtatattgtagaaatgcttgcacattaccaagagtaatctgaccatgaataacttgaatcgctccaaccactactacaacaaggtacccaagattccgaataaagaccatcattggcatcattaagctagagaaaaattgtgctttccatgctgcttggtagtactgatggttctctttattaaacttttcttcttcatcttgttccttgttaaatgtccgcacaatcgtatgagcagcgtacgtttcttctacttggtcattaatttttcccaaagcggcttgctgacgaccaaatagacgttgtgaagttgaggcaacaaaagcaactaccagaatactaagcggaattgtgacaagggcaatgattgttaatttccaactaatcgtaagcattaaaatgaaaacaccaacaagcgttaacaaactcgtaatgatttgaatcaaactttgctggagggttcccgcaatattatccatatcattaaccattcggctcataatatcgccattattatgggtatcataatatttaattggcacccggcgcattttctcttcaaaatcttgacgcaaattgtaaacaacacgttgcgatactcgtgtcataatttgtaattggaggaaactaaatagtccagagaacaaataaagcaaaatgactgtaattccaatttgccaaatccgggtaaagttaattggaagggtacttaagtgggcaccagctttcatttctgcataccctttaagcattccatcataaatgatcgtagtagcttcaccaagaatttttggtgctaagattgacaaaataacagaaataacagctaagagaattgaaacaataaccccaactcgccatggtcgtaaataggcaattaatcgctttgtggttggccaaaagtgttgagcctgttcaggtacttgtggtcctctacgcacgatcaacatcccctttctcgacttgtgacttaattatttgttggtaagtttcattatgtgcttttaattcttggtgagttccttgaccaactacccgtccttcttcaagcacaataatttgatcagcatcaacaacagtagagattcgctgggccacgataaccgttacagcacgttgaatttgtgggtcttttgctaaagcagcccggagttttgcatcagtttcaaaatccaaggccgaaaatgagtcatcaaaaacataaatcgatgcgggcttaataattgttcgagcaatcgctaaccgttggcgttgaccaccagaaaagttactcccgttttgctcaacaactgcgtccaatccgccttcttcacggacaaaatctgctgcttgcgcaatttcaagtgcatgccacatttctttattcgttgcttcctcatacccaaattgaaggttagaccgaatagtcccactaaaaagaactgcttgctgttgagtaatagaaataacctcatgcagattatgctgacttaactttttaactgggacaccatcaactttaatctccccgctttcaatatcaaataaccgcggaattaagttaaccaaagctgatttacctgaaccagtccctccaataatcgctaaagtctgacccgctgtaactttaaagtttaagtcatgcaaagctagtctttctgccccatggaaacgaaaatcaacatttttaaattcaagggaagctggttgattaatcgaaatcttttcttgatccttttccggtgcattatgaatactgattggctggtccaagacagcattaacacgggtagcagatgccgatgctcggggaacaaagacaaagatcattgaaagcatcataaagctaatcataatctgagtggcatatgtcataaaggcaattaaatcccctacttgcatgctcatattagctacaagatgaccacccagtagaataatggcaacatttgtcattcctaaaataagcgttaccactgggaatagtgtcgaaacaattgtaaaggccttgattccggtttgcgtgtagtcctcgtttgcttttttgaagcgattttgttcccaatcttcctgccgaaaagcacgaataactcgaactcctgttagcccttcccgaaagattaagttaatgcgatcagtttttttctgaatgctcttgaataacggaaccgcaaagtacataactgccatgacgataatcgctaaaactggcaaactaataaaaaacactttagttagttgcggttctcgaacatacgctaaaacacaggctgcaacaagcattacgggtgattgaagcatcatccgaagcatttgcaccatgacattttgaatctgcacaatatcattggttgaccgcgtaattaaagatgaatcgccaaactcatccatttcgcgattcgagaaacgtaaaaccttatgatagatctggcttcgtagcttttcacccaccttcattgattgggtcgccgcaaaataaacatttaatccggcggccactaatccaatcgcagccacaattatcattttaattccttcattccaaattacgcccatatctttttgcacaattccccgattaacaagatcggcggtaactgtcggcaaatataggtcacacgaaacttggattaataaaaagaaaactgcaccaattgttgcccaaaaggctaaattttttcgtgctatccgtatcattgctattcctcttcactttatcgtcaaattttataattgtttggtatctaacttttatatattactctatttaattaaaattgcaattaacctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcagaccgttggtccgcagtttgaggtcgttgagcaatattaggccctaagcaccttttagcttgcggatgagttcgatgatgcttacgtttaggtttttcaaagaggtctaaattggacgtacgaagcacaccctcattaatctattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccaaattgcaattaaaagctttatcacatgctttatttaaaaataataaatttttgttttaaccatattaaaataaaaattttaggctaaaatataagaaggaacatgaagtaaaaagctccagtctgtttatttttaagaaacgaggtttgatattatggctgaaacagatgttaacccagaattagttaaaaaaatcgttaaacaagtattggctcaatctgctaatggaggagatagcaccaaaaaaatttttgcttttagtatccgaaaagatgaagaaccttacgttaaagaatgggctaagaaccatcccgaaatagaagtagaatatacggatgaactcttaactcctgaaactgctgcaaaagctaaaggagctgacggggtagttgtttaccaacaactcgattacacgccagaaacgctacaagcactggctgacgaaggcattacaaagatgtcgctacgtaatgttggtgttgataacattgatatggctaaggcaaaagaacttggctttgaaattaccaatgttcctgtttactcaccaaacgcaattgccgaacatgctgctattcaaacagctcgaattcttcgccaaaccaaggtcttagatgaaaagattgctaatggcgatttacgctgggccccaacaattggtcgagaagtgcgtgaccaaactgttggtgttatcggaactggtcatattgggcgtgtttatatgcaaattatggaaggcttcggtgctaaggtaattgcatatgacccatttgaaaatccagaattaaagaagcaaggatattacgttgacagccttgatgatctatatgctcaagctgatgtgatttctcttcatgtcccggctactaaagaaaacttccatatgattgataaagatgcaatcgctaaaatgaaagataatgttgtaattgttaattgttcacgaggcgcattagttgatactgatgctgtgattgaaggacttgatagtggaaagatctttggctttatcatggatacctacgaagatgaagttggtatctttaacgaagattggcgtggcaaggacttccctgacaagcggcttaaaggtctaattgatcgttcaaatgttcttgttactccacatacagccttctatactactcatgctgtccgcaacatggttcttaatgcctttgacaataaccttaaattaattaatggtgaagaagctgacacaccggttaaagttggctaataattattaatctttcttaaaaagcccgactattagtgcaagactaataatcgagctttttttgttcactaaactagtgccgtttgtaaagcacacgcaagaaggcccccaacaattgggccacacattggaacccatgcataccaccattctgaaacacccttattaggaattggcaaaatagtatatgctaaccgtggtgaccaatcacgagctgggtttaaggcaaagccagtagttgtcccgagacatgtaccaacaactgcaataaccattcctacgataaatggcttcaatccctgtgtaaagttaccaagatttaataagatgaaaataaatgcaaaggtcgcaatcacttctgagaaaaagttaaaaattggactatttatcgctggacgagtagcaaaaataccaacattatttccttcttcttcatttggggttgctttaaattgtggatagaattgaataattactaatactgcaccaacaaacgcaccaagaaattgaccaagtaagtaaggtataacgttactccatgggaataagccaaaaatagcaaaaggaattgttacagcaggatttaagtgccctaatgagcccagaaatcctgcaacataaactcccatcgtaactgctaagccccatgaaatacagataaaccaccagccactttgtttcccataagttttatttaaactattaccagcacaacatcctgctcctaataagatcaaaaccatggtgccaaaaaattcgccaataaatccatgcatgtctaaacaccaacctttttaatttttcttcaaaataaaacctaacatcaagagaataatcaccaagaaaatcccacagtaaatatatctttgcggatgtccttttacgtgtccgtaccgataatcattattataacgttgcatggctcctattattaatccactgattccatttattgttggactaagcgcaaaggacgccgacacttcgcttatttcattattaataaagctaaaaataataaaaaggactccaatcatcaccgttgaaattatcgttgcaagattaattccaactaacatttcatagataatactgttattagctggaaccttaacaagtattcttggcatctcttgccaacttcttgcaataaagaagatgagtaaaaagcaattaccaataataaacggtaaagtccaaccattatgtaattctaaacttggcggaattacaatccctgcagcgcatagaactactattggccaatacatcgaagcaaattttcgacgtgattgcggtcgttccaggagagcaaaaaattgtcccaaaagagcttgtaagaaatttaaaacgataaatatcatgacccatatatttaagtagctaggaattaatactactttaggctgtccccaggccaatacaatcgaaataattaaaacaatagctaacaacaaagcccttggtgcataaggggacagatttcgatatttttctgctcgttgataaattaatatcaggttatacatattcatcactaaaatgacagctgaaaccagtaaagtagagtcctgcaactgatttggggatgggggttctccacctaaaataatatatgctgacattgtacaaagccatcccactgtccacatcaatggaatagttggtgtcaagattaatggctgacgcggcaaccattgttccatgtgaaacacctcctcaatatggtatcttaccataagaaattgctcaaaatctggtaagataaatagtagttagttttaggaggtaaatttttatgtttttaccacaattaggattaaaaggaagcagtcaactagaccaaattgaggatcgcttacagtataatcctactatttatgaattttatactaatgctgatgactttactgatgaaggctaccaacgcctctatgatgctattcaatacgttaaagatgctggaattaaaaatattattctacatcacccaatgaagtttcaggatcatcattcagaagtagtggcccctgaaaaacagtatcctgacctatatcgctttatcgaatttacaactgaaaagctcctttatttagctgatgatcttgatgttcaagttttggttcatggtggttatgctggtcctgagtcacgttactttgtttcactctaccctagtgtagaagacgcccgaaatgctgtttatcagcggttggatcgttttgcagatgctggtggagagcatatcatgtttgaaaactcaattgcgccagtttttgcttatggcgatccccttcaagaagatgaaattcttgcacatgattatcgacttgcctttgatacatcccattgttttattgaacttcatgggaataatcagaaattggccgtatccctagcgcatttaaaagatcgtaccgttcattaccacctagttgattcaatgggcgaaactcatgatagtcttactctcggcaccggtaaaattgactgggctaacgttttgcctcacttaaatccagctgctactagtatttatgaaattaacttacacgatcaaaataattgtcgtgaacaaattgacagtcataattatttagttaaactttaccaaaagcttaataatagaggagtttaatcgtgaagcaatatattaatcaccgtcatatttctttagtattagccctatttatcctctacttagcaatcacttactgggaagttgttgctaaatttatccaaacaattttttcggcaaccatgcctcttttaataggaggaatagtcgcctatatcgttaacctattattaagacagtatgaatacctttactcgcatttatttaagaagccaagtttgcaaaaattcaagcggccagttggaataataatgtcctacttaacaatcctcctaataatcaccatcgtctttgctctggtaattcccgaacttattacgtgtgtaaaactacttattgcaaatcatagtcacattatcaaccattttattgattactttgaacatagcagtgattttaagggcttcatcaatagctttgataccagtaaaattcaatgggataaaattggtaaataccttacatctggtgttggtggaactttccggacggttatttcaacagcctcgtctgtattttcagttgccacaaccgcaattattgcgtttttcttttcaatctacctcttgatttataaagagatgttgcaacgtcaatttactaaattactttcaacatactttagccgataccagacacaaataattaaagttctgaaagtttttgatgaaagttacagtaactatattgttgggcaatgtaaagatgccgctattcttggaatctcgtgttttattgggatgacgatcttacgaatgccatatgcttcaatgatcggagttgtaactgcatttggtgcattaattccaatcattggggcaatccttggagcgagtgtcggagtaattatcattttcgccgtttctccacttcaagccggtattttcttgatctttattattcttcttcaacagttagataaccgcattacctatccactagttgttggaagatcaattggtctcccaagtgtatgggtatttgctgcagttattattggtggaggaatttccggaattcttggaatgatgttcactgttcctttatttgcagccctttataaattgttaagtgctgatgcaagaaacagaataacaattcaaaaaatgagtgaaaaaccgtagcatttttcactcatttttttataagttatctggaacatcagcagcaggttggtccttagttagtcgataaacttgcgatgtatttacaccaaagtactggttaattaacttactcaattcttccatcgcttcattagcgcgttcaatttgttctggattaattgcttccataaccgcaactacattttgagaatcttctgtcaacattgttcgttgagcttcacgccaatttagacaacgacaaacagcaccttcatcgtcataataaataacttcccccgccaaagcaggttcatcttcttcagcaccgactggccgaaatgcttcgccaccttttgcaacaccaagatgaaggttgccagcaatcttatttcgatcttcaatgcccactggaacaccgtagcttaaagaaatactattgtagacatccacaagaggttcaattggttcaaatttccgtccttgattggcacgcttcaataaggcctcaattgatgagcgcgcacctttctttttcttaaattgttgaaatgcttgacgccattgatcaacaactggattcaaacgaaaagtctcattggttagaaacttatcagcctcatgagtagcatttgctaatagtttctttcgttcatcatagttgtcatcagtatcatggttatcaatgccatttgcaaacaagatatttacctgtgcatctggaaaaagttcccaaaaacttggatcaatcgtcacttgcttcataaaaataatctcctctttataaattaatattgacgtttgcccccatgctttacggtatcccaatcgccatcaatattttggcggatacgaactagatagtcatgaacctgctgagcctctttttccgagaagcctttcaatgcctcactatttgaaaattggttttcacgaataataaaaggataaatctcttttcctttttgagtaacataaagtcgtttaattttcttattcgttggatcactttttctttcaataaagccatttttttcaagcttttttacagcacgggcaatcgttgttcggtctacttttatcaagtttgataattgttctgaaataattcctggatgctcataaatacgaacaacatacaggtattgaccacgtgctaagtcgatttgcttgaactcaatattggcaatcgaatcgagtgctcgatcaatcatccctatttcacgtaaaatatcaatcattgataaaaattctccttaactacaatattaagttctttttgttgtaattgcaacaaaataattagctttaattattttccaacggcgcaggctgagcgactttttgcatggctgttaataattgagctgcatccattcgcgataaaactgatttcagtgctaatgtcattaagcgatcattttgtgtattaatcacattattacttggaatttcttctccagctaaaagtgcattcaaaatttcaacaaagcggtcataggcagcttgcgggtaagaattcatagtaacctgagcaattcctgcacgaatatcatccagtgaaaaattcgattttaacaatccaataagcaaaagatctactaattggttaacggcatactttttcttaatcggtgcttgaataactttctttttcacataattatttaccattgattttgtaagtggctcaattcctaaatgatttaattgttcatttacaatcgccaccacctggtcaacatataaacctagtgtaggtaattctttccatcgtggaaaccgcacccgtgctaaattattttgccatcgttgatattcttctaatttatccatatcacaacctgctttcttatggtgcaattccaatcgattgattccgaaaatcatcggtagtaactgcctgttcaattatctgtgctacttgtcctaatccaatctctttaccttctaaaggattgccttcactaacaaccttaagtgaagtttcttcattagtaattggcaaagctctaataatagtatagggcaactcaaattcatcaatcattttaaccgcatattgatgagcaaggacagtctgagttgcctgttgcccataccattcctgtagttgctgatttgtcgcatcatctgctgttcctgcaatcgaaagcattactatttttgacggtaaaaacagtgagtgatcaatcaattcggctaactcttggacttcatcatctacatactcattaacagtgggaagccaacataatatatccccacgctgaatttcaaatttaaaactagtaagagcaactgcttctggaacccttttgataatagttggtactaaatcgtcatgccggtgactaataaaaactatccgacccatcacaacctccaaatctattagtaagccatcaattcatcttcaatcgttgcatcttcaattctgacatcagtaatggtgctttgctctagtaatggcagtaatgtttgaatatttccagtgaaaaggaaacgggtctcattacctgcttcttccaacatgtgtgcccctaactttactgcattgtcgattgggaaaccagttcccattactgtcacagtacaatctactccatcattcatcgacaaatcacgtgcagaagtcaaatgactgccattaaagtaataaagagtatgagcaaaccgcatcaatgttgaaatatttttgcttgtgaaaagcactaaggcatcgaccttttgagcatagtctttaacaaggtgaccaatcatttgccgtttattttcctctaagccatcaaaggcatcattcaaaattacgattggacattgccaagcaaggagaagtgctatccgcagttctagtcgttgtgcctcgtttaatgaagcaatcatttgatcaggttcaaatttcaatgatttaagcatttggagtgcttgttttgacttcaaagcatttttacgatgacgtaatgcgtggtcaacagcttttgccactgtctttccttttaaaaccacatcatcaattcggccgatttcatttttgctttggcgcttatattttttgaatggaaccccgttaattgttacatccccatttaagatttttccacgaacagataataaatcttctaatgcagttgctgcgcctgtatcgttactgcaaattccgactacttgtggtgactttagttctaatgaaacgttatctaattgatctcctgatttagcatcatagactaaatcattaattgtaatactgctcactatataacctcttttcttaagctatctacctttactaatcttatcattttttaggtaatgaacgaaataaacatgtctttctttttaatatgctttaatttataacgacttatttgaatggtaaaataatatacataaattgtacttatcaatcgaaatgaggaatgttattttgaatgagggccaactattcactaattttgtaattataatcattacatttatctttgcggcattttttgtggcagccgaatttgctttagtgcaagcacgggtaacagccctagaagaaatgcaagcaaagcgcgataaaccatctaccaaaataaaccgcgcaatcaaaatggtcaccaatctaacagaatacctttcgaccactcaagtaggagtttcaatttgtggaattattctcggttgggtcggtgaaggaacgattgaagcactcttagctgatgcactttcgttaccaagctggtcactaaacaatagtgtcatccatgttgtaagtgccattgtgggagttcttcttctaacatatttcgaagtagttttaacagagattgtacccaaaaacatcagtattgatattccaattaagaccctgatgttcgttaccaccccactgcactattttcacattactttttatcctttcgtttggttgcttaatagttctgccaacggaattgttaaaatgttaggcatgaagccagctgacgagagccaagacgtcctttcgcaaagtgagattattagcctatctcgaaacgctgttaaaggcggtgaacttgagcacaatgacttgctatatatggaacgagcctttgactttaacgataaggttgctaaagatattatgatcgatcgtactcaattaacagttattgatataaataaaaccgtaaatgacgcgattaaactatatcttaagacgaaatatagccgcttaccggtagttgctgataatgataaggataagattttaggttatgtttttaactacgacctaattcggcaaaagcaaatcaacggagatgtatctttagcaaaagttcttcgccatatgcctactactcctgagactacctcaattaccgaagtccttaagttaatgattagtactcgggtgcccatggtagtcgttgttgatgagtatgggggtactagcggaattattactgacaaggacatttatgaagaactatttggaacagtaagagacgagatcgacaaggtttcagataacatgatttctaaaattgatgaaaatcaataccggattgatggaaaaacgaccatttatgattttgaacgcttcttccatgttgaacttaaagattctgaagatagcgatgtagtaactttatcaggatatgtgttagataattatcataatattcatgaaggagaaacgatcaaactagccaaccttgagttaaaaattcaagattatcgtcattcatatattgatagttttattgttaccactttatcaaagtaaaattttacattttggcagcaataagaaaattatccttttatttaacacttaattctactaaaataattttgtaatattaaagtaaatctaaactagaaggaagaaattcacatggcaccaatgaatattatttatatctcgcttgagggaaatacccgttccttcttaacgcggatgcagggatatgctaaacaacagcacagtattagtgaagattgtccacttattgaattaaaagaagttagcgatcaaacgcttcctgccgatgaaacagaacccttctttgccttcgtacccacatatttaaatggtggtaacggaatcgattctggtttcactgaaattatgacaaatgcattaggtgaatatatttcctacaacgataacgctaaaaaatgtgtcggctttgtaggtagtggtaataagaattttaacgaacaatattgcttaactgctcgtaaatacgcgcgagactttgacgcaccatttctcgcagactatgaattacgaggcacttcacaagatattgagcgaatttatactatcttagctaaacggtggagcgaagttaacgcctaacttctaaaataaaagcgacttggaaatccaagtcgcttttatttttagccttgtttattagcacttatcagccatgttatcccatacttatctacaatctgccccattacattatttaggatccaatcaccaaatggtaccgtcacacgttgattgtctgattttgctaaacgattaaacaaatcacgtgctttatcttcctcttcttcaaaatcgagtaaaattgaaattagtgtagacgtttggggattgcccatcgttgcatctgcacaaataatcttttgtccagcaatcataaattcaccacgcattgttgtctggttcaattgatcaactggtaatccaagactttccgcctgctcttttgtcagagactcgtgatatgtaatctgagcgccaaagtcttgttcataataagccattgcttccttcgcattctcaaatgttaggtatgggtatatagccgtcatagtgttcctccaaaaatattcattgttgattatatattttgaatcgctttccgtcaaactagcttccaattggattagctacttctaaccgtatattaatcataactaaggccccattatgatataattgtctagtctattatcaagctaattttaagatggaaggatgaattttttgaaaaaactcaaaaagcatagtccgcttctaatccttggattattcttccttgggatctgtatgcggatgccgattacagcaataccgtctgtcattaaagatattgcacaaacttttaatgtagaaactactagcttaggaattttaaccactattcccctcctttgttttggattattatcatcagtagtttcagcactcgctcaaaaaattggtaatgaactaacgattgaattagcaatgattttaatgtttattggttcttacctacgaattttaaatttctcctcgttaatgatcggaacaatattagtcggggctgccatcacttgtattaacgtcttattacctgcgattatttctgacaaacttcctaatcaaattggaagtgtgaccgggatgtataatgtcgcgatgactttatttgctgcaattggtgcttacgcaattactccaatcacccatgctactagttggcaaaccgctgttatcattattagtattgttgctttaattgcagcaattatctgggtaccaaacttacgctataatcaacgtgccactaaagaaagcagttctactgagcgtggaactaacatgtggaaaaatgcaaatgcatggtggttactcttattcttcgggggacaatgtttcgtattctatagtatcgttgcctggttacctacaattgccatggacgctggattaagcagtgataatgcaagtttagttgctggattactacagctattatcaatgccattcgcctttgtaatcccagtgattgccactaagatgaaaaatcggcaaccaattatgctatttgcaggaatcatttctttaattggaactggaatgatgttcttccctgtaaattctcttgtttactatatatttgttgccctatttcttggtgccggtacaactactactttcgttcttgcaatgaccttgttcggactaaagactaagagttctgccgatacccgaaacctttctggaatggtccaatcagtaggatacttaatttctgcattaggtcctatcgttgttggaaacctttattcacaaacacataattggtttgcaagtttaatcgtgattgctattgcagctatcttcttcacagtctgtggtgtaatagcagaacgtaaacaatttgtttaagatatctttcaaagctgcggaatttttcccagcttttttagttagttttgttttcataagctataattttaaccgattccaaatttcttttaaaagtttttttgatctagaccattaattgataaacgcttaccaaagactaatcaacaagccatttagcggtagtggtccattttaactttctaagacatcttctcagaaaacgtttcctttgatagtgcagattgtgctttaagagtatataattgtcacggtataagaattttctgaaatttcagaaggagtgaacattttggctacagaaaataaggctgtcattacattatttggtgcgactggtgaccttgcaaagcgtaaactttatactgctttgttcaagttatatcaaaagggttacctagctgaccattttgcattactaggaacctcccgtcgtccattgactgacgaagaattccaacaaatcgttcgtgaatctattagcaatattccagaaactgaggatggccaagcagaagcattctcaaaacactttttctacaagtcacatgatgttactaaaccagaacattacgaaatccttaagcaacgccttgccgaattagatgaacaatttggcgctgaaggcaaccgtctcttctacatgtcaatggcaccacaattcttcggtactattgcattgaacttgaagaagcaaggattattaactgacaatggctttaaccgtcttgttattgaaaagccatttggtcgtgactttgaatctgctaagaagcttaacgatgaattatcacaaacatttagtgaaaatcaaattttccggattgaccactaccttggtaaggaaatggttcaaaacattcaagcattacgttttggtaacaccatgattgaatcactctggaataatcgttacattgataacatccaagtaactttaagtgaaaagcttggtgttgaagaacgtgccggttactatgaccaatctggtgcattacgtgatatggtgcaaaaccacatcatgcaaatcgttgctcaattagcaatggaacaaccagttgcatttactgatgctgatgttcgagttgaaaaaattaaggctcttcgtagtcttcgcctctacacaccatcagaagcagctgctaactttgtccgtggacaatatgatgctggagaaggaactaacgcttaccgtcatgaagatggtgttgatccagaatctggtactgaaacctttgttgctgctaagttaatgtttgataactatcgttggtctggtgtaccattctacgttcggactggtaagaagttagcagacaagtttactcgtattgatgttgtcttcaagaagccattaatcgatatctttgctaacccacgttctgaaagtgaccaatcccttaactcaaacgtattaactatttttgttgaacctaactcaggttttgcaatccaattaaatgctaagcgcgcaggtcaaggcttcacaacagaacctgttgatttacgcttcttgcaaagtgattctgataagaaggaatctccagaaccatatgaacgtcttttccatgatgcacttgaaggtgaccacacaaactttgcctcatgggctgaaattgcttatgcatggaagttcgtcgatgttatccgtaagctttgggatattgaaaagcctcaattccctaactacactcctggttccatgggtccagcagcttctgacgaactcttggctcgtgatggacgtaagtgggtttatcgtttaaatcattagttaataaaagtaatttatagcattcttgctgtaaattatttttttataataaaaattgatatttagcgtttgcactatctttaatttttgttataatcgaggttgtgaattatattacataagtattgaggagagtgactttaatgtctgatcaaaaagcacaaattggtgttgttggtttagctgttatgggtaagaaccttgcactaaacatcgaaagtcgtggcttcacggttggtgtatacaaccgtcaccgtaaccgtactgacgatatgatgcgtgaccacagcgataagaagttagtacctagctacactgttaaggaattcgtagactcactagaaaagcctcgtcggattcttatgatggttaaggccggtaagccaactgatgctcttatcgacgaattattgccattacttgacaagggtgatgttttaatcgatggtggtaacactaacttccacgatactatggctcgtaacgctaagttagacaagtctggtatcaacttcatcggaatgggtgtttccggtggtgaattaggtgcccttcacggtccttcacttatgccaggtggtcaaaaagaagcttatgacttagttgctccaatccttactaagattgctgctaaggctgaagaagatggcaagccatgtgttgcttacattggaccaaatggtgctggtcactatgttaagatggttcacaacggtatcgaatacggtgatgaagaattaatcgacgaaagttacaacatcatgcgtaacgtattaaagatgcctgttgatgacattgctaagacctttgctgaatggaacaagggtgaattaagcagttaccttgttgatattactgctgatatccttactcgtaaggatgaccttggtgacgacaagaacaagcctattgttgacatgatccttgaccgtggtgctaacaagggtactggtaagtggagttcaatgactgcccttgatggtggtgctcctcaatcagttattacagaagctgtttacgctcgttacatttcaatgatgaaggacgaacgtgtacaagcaagcaaggaattgcctgttgaaactgaagctatttcaatcgacgacaagaaggaaatgattgaaaaggtacgtcaagctctttacttcggtaagcttatgagttacgcacaaggtttcgaacaaatgcggatcgactccgaacgttacgactggaaccttaagtatggtgaattggctcaaatttggcgtgcaggatgcattattcgtgcacaattcttacaaaacattactgatgccttcactaagaacccagacttgaagaacttgcttcttgatgattacttcaaggatattgctaagaagtaccaaaaggcaactcgtgacgttgttactcttgctgttaaggctggtattcctgttccttcacttagtgctgctatcagttactacgactcataccgttcagaagtgcttcctgctaacttgcttcaagctcaacgtgattacttcggtgctcacacttacgaacgtactgaccgtcctggtaacttccactacagctggtacgaagaacaataatcaaataaattttgatttaacgactgagatctattctcggtcgttttttattttaaatttcttaacaagaaaatagaaacgtggtttgattagcatagaggtgagtataatgaataaaacatttatgagcggctattaccaaggtgtcatcgaaacagcccctactactctttcggctgctaaaacagaacagttagcaattacgatgacaatcctccatttacgtcatgctggaataaacattacatcaatccatgattttcttgtcaacgatcttcatgcaaatgaacgccttgtaaataagtatattaatttaaatgctgatgggttagaaactattcaggcccaagttatagcaatcgctttcaaccaataattattttgatattacttcctttttcgtaaaactttactaaaattgcattgactttttctatgaaaacgcttaccattattcgtgtaagatattattatatgttgttgtagaaaaggggagttaacatgaatacaaaaatcgatactgcaaaaagtaaacagcatgttgcccgttcccgttttgcctattcaatgggagccttcgggcatgatgtcttttatgctttactttcaacgtatttcattatgtatgttactggacacttattcaattctagtaacaaagcattcaacaatcacatggttctatgggttacatcaattatcgctgtattacgaattgtggagttgttagttgacccattaattggaaacgcaattgatcgtactaacacacgttggggtaaatttaagccgtgggttgtcggtggtggaatcatttcagcaattattttagccatcttattcaccccaatgggcggtttaagtctttctaatccttacctatacctattgatctttgctattttatatatcattatggatatcttctattcatttaatgatgttgccttttggtcaatgattcctgcgctatcatttgattcacatgaacgtgataaaatagctacttttgcgcgggttggttctactgttggaggaaatattgttggttttgttattatgccaatggttttattcttctcagcaaatcaaaatggcggtaccggtgatgatcgtggttggtttatttttgctgcaattgccgctgctgttgctgctattactgctgttggtgtcgggcttggtactcatgaagaaaagtcattgcttcgtgaaaacaaagaacaaactaaactaaaagacgtttataaaattcttgtcaaaaatgaccaattattcgctatagctctctcatatctattctatacaacaggaatcacattagttaacagtatggagctttactactttacttatattttaggtgattcaaaggctttctctattctaggtggattaaacactgttattggtgttatttcagttcttactttccctctctttactggtaaaattagtcggcgtaaattattttacgggtcagtttcagtacttttccttggcttattaatctttgcatttgctggtaaatcactcattttagttttagttggtgcagaattattcttcattccacaaccattagtatttttagttgttttaatgactattactgattctgttgaatatggtcaattaaaattaggacaccgtgacgaatcacttacattatcagttcgtccactgctagataagttcgctggtgctgtttctggatggattattggaccaactactattattgctggaatgactgctggtgccactgcagcaacagttactgctgcaggtgctgctaagtttaagctagtaatgttcctagcccctgctatcttgatcctcattagtgtatttatctttgcaaaaaaggttaaacttgatgaaaagatgcacgccaagatcgttgctgaacttgaaaagacttggggagatcaccttgaagatgctgacagcgacaaccctcaaacagtatctgtttctaccccacaacctggcgttactgatattacatcaccagttgccggtacacttgttaacttaaaagacgttaacgatgaaaactttgcttctgggaacatgggtaaaggattcgctataaaaccatctgatggtaaagtaattgctccatttagcggaacagtacgagcaactttctctactcgtcacgcaatcgggcttgaatctgacaatggtattatgttactgatccacgttggtattgatactgttaagcttcgtggtactggattcattagttactttgataaggatcaacactttaacaaaggtgacgaattaatggaattctgggacccggcaatcaagaaagctggccttgatgatactgtcatggtaacagttactaacagtaaagacttcgatattaaattattgaaagatgctggtgaaaaggtaactactattgatatcgtcatggaagttactaaaaagtaattaaatatcttctctgttaaaaaagaggctggaaaaataatccaacctctttaccattttaaagtataaactgccagaacgcagtagctggctggattctgaacgttgataaatcaacgtccagaacacctagccatccttgcgggggggtgggactaaactcgcaagcgagtttagtcccactcctttttaatctacatattttattctaaatcttgttaatgttacggcattaatcaacgttacagcagtcataataataaccacaggcgtaaacgctgaataaaaccaggaaattccaaaaccggcaattgttgaaacattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgtcgtggaactaacactttattatgatgatcccaggcgatttcctgctgagcctttaagaaccgacgactacgtaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacaataatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttttggatttaaattgagggaatttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcataattccattcttgcaaattgatgccgtacgcttgtcccacaactacaaaacgatgtttaagatattcagatatttcatcgttaattacttttcgacgatacttaaccaccattaccaaatgataattaagtaagtatactgaatgctgatttctatctaattctattgttatcaccccattttatagatatatactaaatatatcatagaacaaaagaaaaagcactaacgtactttaagagagcgattcatcccctacttatagaagtggggtattctcgcaaatttatggataaaaatacttacaacggttttatttacttttaccttattgtaatagttagcaattgcaaggccaatataaagcaaggcaaaacccaggtacatgcaggttcccgcaaatcgcggatgtgcctctgcatcatcaatgaatttcattgccacagttattaggctaagaccaaataaaataaagtaatgaagatagatcattaaatttcctgtctcatggcgttgatgttcattaattaaatgatcaaattcaacaatgtaggtaaagaatagcgctgcaactgtggtaagtataagaatagactgaattgaaaagctggtggcagtaaagtaatcagcaataccgacaatcgtctcaccaaacatcacgataattaatgccgtaagccgttctagcaagtgcgaaaagatgataggatgatgctttgtatattttccggtaaagccaggcgcaatccaactgataataataccagcaaaagcaatcctcactctaactcggctttgataaaaaatcccaccaataaaaagcgtaacggtcctaaaaattaaaattccagcaaatgctcgtgtaatctgtttatctatcttcttttctgcctaaaagtaaactaaaacatattggatacataacgttaatgatagcaatcctgcagctatgaaaaaaattgctaaatgccagtcaaatgttgttgaaaacgaatttgacatatagagaagaattgccatatcgacgaacgaaaagataacatttgttcctgaaatctttccatgccgatttgtaaaaaccatctggaccatccaggaattaataaatacaatcacgacaattgcaaagattcctaaaaccggcaatcccacaatcccattgtgcaaatggtgaatcatttctgttgctcggaaaaccatgtaaacgaacactaaatcgtaaaataattctatcaaggaaactcgcttagtaatttcatctgccacgataacacactttcttttttataaaaaaagagttaatggtaatatttaccactaaccctcattgataatattcaatgactatttaacctgatctacatcagttcggacaactaacacatcaacaggcgcattacgctttacatatgacgtaactgaacccattacagctcgttgcatccgtgataatccactagcaccaataataatcatgtcgttgtggtgatcacgagggaagtcaaatgaaataattgtctttggattaccaagacggatatgaatgtcaagattgtcaaaaccatccttatccttggcagtcttcaacaattcatcaaggtattgctttgacttatcaactaactggtaagcaatacttccatctgacataccagcaaagttataagccattgctcgtgtatcaattacgtttaaaatatctatatgggcaccattacgctttgcaattgcgattgcacgatgcaatgcaaattctgattcctgagagccatcaactggaactaggatgttttgatattcttgatccataggtttgaacctccaaacaaacaagtaatatatttacttaaattataccatttttttaaagaataaagcgaaggaaaccagaataatactgacctcagataaaattccaaatttcctaaaatttagactatacattaatctttaattagagtaatcttaatatatccaatatacctttaatatttgaaagtgaggccgcatcttatggacaagatcgataggaagattattaaccttcttcaaaaaaacgcccgtgcttctttaaaagaactctctaaagaatgttttatttcatcaccagcaattgcggcgcgaattaataaacttgaacgaaatgggattattactggctaccatacaagtgttaacatggaaaaaatcaactttcatgttaaagcttttattcaggtgcaacttgagcctcgccaaaaacaagaattttacccttacattcaacaaattcccaatgtgattgaatgtaactgtgtaactggtgattattcagaaattatggaagttgtttttccttctaccaccgatttagataacttcatcaataatattcaacaacgttttggaaagacaagtacacaaatcgtatttagtacaagcgttgaccaccgaggagttaagctagcaccagcccaagataccgttagttcagaaaaagagtaaacataaaagcgaaggtgaggatttccccatcttcgcttttatgtttatttaattttattcagcttcaacgtcagtttctgttgatggtttttcctttccgtaattatctaaatatgcattatatttttcacggtcaagagtaccttcagattcaccgataacaagtgtggcaattgaattaccaaccacgtttacggcagttcgtcccatatcaacgaaacgatcaattccggcaatgaaagtcaaaccagccattggaaccccaattgtagaaacactagcaagcaatacaacaaaagaagctcctggaaccccagccattcctttactagtaatcatcaaaacaaccagcagagtaatttggtgagaaatactaagatgaagtccatatgcttgtgctaagaagatcgctgctaatgattgataaattgcagatccatcaagattaaaagtataaccagttggaataacaaaagctgtaatacccttgcttactcccatctcgtgcgtctttttcatcaaacgaggcaacgtaacttctgaactggcagtagtaaatgccaaaacaatctcatcaaggatagcgcgcatcgtcttccaataacgtaaatgaaaaatatgagcagtaataccgaggacaacaataataaagattaacattgtcacatacgcaatcacaataaataatcctaatggcagcagagcactaatacccatttcggcgattgtcattccaattaaaccaaagaccccaattggtgcaaacttcataacccaattagtaactttgaacataacttctgaaactgcatttaatacatcaattaaaattttagccttttccccaacagctgcaattcctaatccgaaaagaactgagaacaggataacaggcatcatgtcaccatcagacatggatttaaaaatgttcgttggaataatcgacaaaattaatggccagaatccgctactatgttctgcagattttgcagtggacatgtattgcgaaatatcagttgcatgaagtttatgaatatcaataaacgaacctggatgggtaatgttagccattacgatccctaaaattaacgcaattgtggttaaaacttcaaaataaattaatgtttttccaccaatccgtcctaactttctaatatcaccaatattagcaattcccacagtcaagcaagaaacaacaattggcattacgatcatttgaatcagccggataaagattgtccctaagctctgcataacagtgatggcacccttattttgatagaaaattaatccacaaataataccaagggccagcccaatcataatttgccagcccatactgaggcgtccgaaacgatatcgcttcactttatatcaatctcccttatgtagtcttattatactttagcacatttttagtaagattttagcaatttttaagattttatttaattaaatccgaacactttttgctctttctaggtattttattcacttcaatataataattctaatttataattcgtaattttcactaaagaaaaataagaccgctactaagtatttctctaatatgatagagtgtttagagaatatttaattgaacaggagtaatttatgaacgcttggataacggaatttattaatcagtttggttattttgcaattgccttactaattgcccttgaaaatgtctttccaccgctaccatccgaaattatccttacaatgagcggattcatgacgaccaccacctctttatcaattgttggagtaattatcgccgcgacaattggctcacttatcggggcacttattttatatgctctcggccgccagttaactgttaaccgccttgaactccttcttagtcatcgtttatttaaacttctaggctttcatcaagatgatgctaaaaaagcagtcgattggtttaataaacatgggacaggcggcattctctatggccgctgcattcccgttatccgcagtttaatctctattcctgcagggatcgcgcaaacttcattaggaaaattttgccttctcactactatcgggagcaccatctggaacacactgcttgttgttcttggcgcttgggtcggccaatcatggaataaaattgtcattatcttcaacgattacacgactgttgctattatcattatggcgatcgttggtttatactttgcttatcggtggtatcaaaaaagaattaagaaataaaatgattcagtttcaattagtaaaagcaataacgccattactatcaaaactgaatcatttttcatatgctatcgggttgtttgccgtttgatcaagtgagttccgacaactgtcttgcatgggtcattattcggattttgcagccgtttaatcatcatatcaactgcggcatgtgccatttcatcagtggcaatgtgtactgctgacatacttggataaacgtacttaacgattgccgtatcgttaaaactaatcaaggcgattcgatttggaacgttaattttggcttcttgaatcgctttaagcgcgccaactgccatcggatcatttgctacaaagattccatgcggcatacggtcaccaagcgtcgcaattgcctttttcatcgcgttatatcctgacatcgaggtgtagtcgccagcaaatataaattctggatgataaaggttttgttgacgtaagttactttcaaaatagaatcgccgcaaatcaggaacaatttgttgatccgttgtcttttcagttcctgccaacataccaatatcgttaattccttcgctaacaaattctgaaataactgaccgcactgcattttcaaagtccggtactaagcaatcgtaaccggcagccaaactatcgtaatcaacaaacacaatattagaagttactaaccgcaatgcttgaacttgcgaatcactaaattttccaatcgcgatgatgcccgtaacatcacgaggaatctcttccatattgttttggtaaacgggaacagtctgtagtccctgttgttgcgctgctcgttcgattcccatccgaattgccatgtaatacaggtcatctaattcttgtgtaagagaataccattgaacaacagctactcgttgtacttggttattacgtgctcgcttatgcttagtatagttaaactcttcggcagtggctaacactcgctgacgtgtcttttcatttacagaaagtgtcacatcattatttaaaattcgcgatacagtcgcaatagatacccctgctttatccgcgatatcatgtaatgttactgccatactgcttcagcgcccctttcttcattttaggttaaaactattttaaagcatcaacgaatcgttgccaaccttcatttccagctgtgtcatccttaaagactcccgcattttccaaaacattggcaaagacattagcaagttcttgttccataacctcatcgacattatcctcggtgatattaatccttgactgaacttcttttgcccatagaagatgactatctgcaatcttattttcagcaccaagccaaaacttcttgacttcatttaactcatccttaagccgcgctggtaaaatagcacgacccatcacttcaatcaaaccgatattttcctttttaatgtgccatagcttttcatgtggatggaagattccgagtggatattcatcattagtattattatcccgcaaaactaaatcaagaacaaacttatcgccttcccgatgcataattggggtaacagtatgatgacgaagttcaccatcaaaagccttaatatcaagactttcatcactgtattgatcccataccttaataatatgtgtgccaagatcaattagttgctcagtatcggtactagttaaacgaatatcactcattggccagttaacgattcctgcattaacagctggatattcatcaaagtacaattctttcttaatagaggctttcatcattgggaaaatatgcttaccaccttggtagtgttcatgagcaagcattgatccaccaacgattggtaaatccgcattgcttccaacgaaataagctgggaattgcttttcaatttcaactaagttaattaaagtttgccgattaatctccattggctcatgcttactatcaaggaagatacagtgttcgtggaagtaagcatatggagaatactggaatccccattgttgcccccctactgtaattcgaataatacggtggttgcttcgtgctgcctgtccaagacgtcccttgtaaccctcattttccatgcaaagagcacattgtgggtacttcttagcggtatcatgagcagccgctgcaattgctttgggatccttttctggctttgaaagattgatggtaatttcaagattgccgtacttagttggtttatcaaagacaacattcttcttgatagcagctgctttaacatagtcgttgctagtacataagttatagaaccaatcagtcgcacttgatggagattgttggtacttttcccagaatttatgattaactactgatggcgttggggtcatcaaatcataaagctgatcgtttaaaatttccttagcagtttgaccatcatcaattttcccgcgtttaacagctaaatcaacaagttgactaacaacagattcatcatctttagcttcaacatcttcatcatcaacaaagccccgaatcttgtttaagacatagatccggtcgagtggttcataagttccactagcaatcacttggtcagcaaacttttccattaacttcattttctcattcccccactaaaatactattaaagcttatgtggtccatcaacaacttcagcatcatagaaactggcatcgtaaccaatcttgtcccggtagatctttccaacattctttttgaagttttctgcttctgacttcttaacaatggcaatcgcactgccggcaaatccaccgccgaccattcgagcaccaaggcagcctggttgaccccatgcattttctgctaaggtatcaagttctttaccagtcacttcataatcatatttaagtgatacatgagaggcattgatcagacggcctaattcttcaagatcgcccttttccattgcatcaatggctttctttgtccgttcattttcactaactgcatgacgggcacgacgaatcagcgtgtcatcatcaattaagtaggtgtattgatcaaatgtatcggagtctagttcaccaagtttgttaatattaagcttcttgttaagacgtttaactgcttcttcacattcttggacccgttcgttgtatttggaaccagctaaggagtggttcttattagtactcatgataatgatttcataatcgccaagttcaagtggcaaatacttatattcaagagtgttgcagtcaagataaattgcgttattttctttacccattccgacagcaaattggtccatgattccggaattaagaccaacgaaatcattttcagtcttttggccaagtttaactaattcaatttcatcaatatcaagattaaattcatccttcaagatatttcccatcaacatttcaattgatgctgatgatgataagcctgaaccataaggaagaaaaccgtggatgtataaattaaatccgtgatcaatcttgaagccccgttgctttagataaaccagcatccccttaaagtagttaacccacttttcatctttagcactttgcggttctgtatcattaatgtcaaaagtaataatcttactgtcttcttcttttgctgaattagctgagtaaatggcgactgttgtgtcctcacgcggtccatataccccataggtcccaatactgattgcacatggaaaaacatgaccaccattataatcagtatgttccccgatcacattaatccgtcctggtgagaaaaatacatccttccccggttccttaaatacatcttggtattcagctaaaaattgttgcttatccatcagaataacctccatacatcaaacaaacattagtaaacttttactaaatataatttactactttttaaccatctcgtcaataagcgcttacaaataattcaacacacctaagaaaacggttacaaaggataagggatgatatacataatttcttctttaatgctacactagtcataaataattggaggatttaaatgaagaactaccaaccaactgatctaattaaatttgcttcacgtactggacgctggaccgttaaaaagattaataatatgcccaccttatacaccactaaccttggaagctaccttcgttttaaggtttcaaatgctaaaaaatgtcaaattactgttttgccaaatcaaaattccctatctcctagccaagtgtttgcatttcgaattgatggcggaaagtggcaacgggcacaagctagcttagaaaaatttgatattccacttgattcgatattacataccatcgaaataatggcagccggtaattccgacattgacgaagtgtggaaaggtaatgaaggctttgcaattaaaaacatttatcttgataacggcgcaattatggcagccccgcagcgtcctgtggtcaactttatcggtgattcaattacggccggttgttgggtagttggcaatcatcctgctgctgactaccgaccagaaactaactatgcgggaatttgtgcagatctgcttaatgtcgatagtgttcgaatagcctactctgctgggggagtgttaagacctgctactggcggggtcccaactgccgatgtctttttaggaaaaattgacaatcagacattatggacgcctaatcaccctgatctcaacgtgattaatttaggcgttaatgaccgtcgtttccctctaactcaatttattgccgctttcgatctttttatccagcaagttaagctaacttttcctcatgctcccttagcaatcatgattccttttagtcagacctttgcttctgcgatccgcacaattgccactaaacataactgttcgataattgaaactaaaacttggcaccatagctttactgatgggctccatcctgaccaagcgggcgctattactgaaggaaaaatgcttgcacaagctttacaacctcttttatctcaattcagtgtacaatagtagtaagagttaatacgaggaggattctcatggctaaccaacgcttacttccaataaagaatgggtacaactttcgtgatcttggaggttatcccacagcagatggtcatcaaataaaatggcatcgtcttattcggactggttcacttgctcatttagatcaaaatgatctcaccgttttagataatattcctatttcgctcgatattgacctccgtgctcccgacgaagtaaagaaagatcctgatcgagtgccttcccaagcaaaatattatcatttacctgttttcgaagccgacgaaacagacgcctcgcatagtgatgaggaaatcgccgcacagatgcaacagccaggaaacggttatcaccatatgattgatgtttatcaccgaatgaccacggctgcttcagctaagcaggcttaccagaaattatttaatctcttattgaataatgaacgcggtgccttgctatttcattgtactgctggtaaagatcggacaggaatggctgcttatctcatcctcagtgcccttggcgttgagcaaaagattattatggaagattacctgctaacgaatactgttactcaggattttcgtaatcactggctgcaagatatgcggaatcatggagccagcgaggcactagtgacaaatcgggctgcccttgcctcagtagctcctgattacttaaatacagcaatcaaaaatattatccagacttatggaaatattaatcagtatctcaacaactaccttgatattactcctaccgaaataaaagatttacgaaaattgtatttagattaggctcgattataattgtcttataaggaggaatttttatgcaaatctcagtaccattagttaatgggatgttagcagatgaatatggtaaatatgcgccagcagctgatatgctagctgaccatccaattaagtcatttccaattaaaattaccgacgcaccagcagatacaaagacatttgcactcgtctttatcgattatgactcaacccctgtctgtggcttcacttggatccactggttagccgccaacattccagcaacgttaacagatatccctgcaaatgctagtcgagaattagcggataaatttgtgcaggggaataatagcaatgccggctcgttggttaatggaaacccattgattactagtggttatgtgggtccacaacctcccgacaaaactcatgattatactttaatggtgtttgcgttagacgatactctacccttagaaaataaatactggctcaatgacttcatccacgcagccaaggatcatattctagcaaaagcacaaattgatttgccaagtcgtgcatgaggaggaacttatagaggaggaacttataatggaaacaagaattttctttaatccaggcgattcagtcgctaatattcatgactataatgaagctgttcgaaagggacaaatttttaaacaagcacgtcacaatgacgaacttgtcatcgccaaagatcctaacgataaagaatacgcaattttttacgctaaggatgccttaccagctgagcacgaaaaatcaaagccctacgaaattaaaaatcggctttaaaatagaaaatgactcgcggaaatttccacgggtcattttctatttcgataaaaagcttaacgaccaccaacaattttggctgtcgcattttcaagccgttcaattaatgaatcagcatcgttcttaaagtcatcaacaaatgagctcgattgtggttgaatgcgtcctacttcatcacccataatatccgtaacgactaggtcatccccatcccacttcacatcatcataatgaccttcaagagcttcatcaaaaaatgcttggagtatatcccgaacagcattttgaataacagtcttttcgtcaacttgctcaccacgtacctgatgttgagccagctgcattgctacttcttccatattttctggaatttcaacgctcattgtggattcctcctcttaaaaaattaatggcgacgtaatttccgccgagcctttttactaaacttgattccttgaagggacttctttttccgctttaattgtgaatcaattttgttatcgctactcttagccacttgttgcttttgttgcatttcgcgttgacgcttgagcaggcgtttacgttcatattcgccccatggattcaagaggccacgcataaagtcagcaacttcctgcttatgttcgtccatccacgcttctgctacatctgcatcatcagtatcgataccattactattgatgaatgataaaactaattgagtttcacgctcatcacgatttaatgaggcaagcatgtcttctgatggttgcatattagcaattgcctttaagcccaacttgtattgatccatgttgatgtaatcattttgcttcaagtattcaaacaaggcctgcgcgctcggtacgatgttgtgaatttgcttaattgaaatatgtggatctaatggcatcatcatgcccaatacgcgttgcaagttgctgaaagtccattgacctggatattcattgcattcttgtaccattaattccaagaactcttgcacaacatagttcaactcaacatcatctaattcaagattattgaattgggaagcagacttaatagcttgttgcacatttgctaataagtccttgaacttctcaggtgtccatgtaatttcttttttagcaggacttgcttgaaccgaggttgcttctgcttcgtcattttccgcatccccatgtaattgggcccatgtcttatgtgctttccgacactcgttcatctttgtccgttgttcttccattgcttttacaacttccgcaagattttcaactttcaaaaattcttgataagctcgcaaaactggaacaaccgcaattccaaattgattagttagtgctggatcagcgatgaattccccgaccatgaccgcttttactgcttctggtgtccaagtagtatcggtcaaatgctgatcatttgccatctggttattaaaacgcgtcaaaatatcctgtgcatgcttttgctgattagcagataactgatgatagttggacgaagtaagaaactggtcaatatgttgttcttgttcgttcattatctatatatcctccgtctccaaattgaattttcctttctatcatatcataattatatctagtaaatataacaagattgctaatatacaaggagaaactataccaatgcaacgaaaaaagatccaagaagcaatgaaaaatgtctattttcaaaaaatgactgcaaatggctatcatgaaattgaagaacaaattgcaaaattacaacagcaaagacctgcaaaaattggacaattaaaagcagcccgtgcgcttggtgacttatccgaaaatacagaatatagtactgctaagcgtgaattacgccaccttgagagcaggcttcggtacctcaataaacagcttcaatatgctgaaattgtgacccccaagaatgatcacactattgatttagggacaaccgtgataattgaatttgaggatgaccatgaacaagaaacttatcatattgtgggaaagcaggaagctgatcttgccaaacaaaaaatctcctttgattctccccttggtcaagcccttcttcacaaaacagctgggaccactgtaactgttgaagcgccgcaatcttcatataaagttaaaattgttaaaattgaattatagtattgataagtcattcgatatttcgtaatccgctaaaggaaatttttaaatttattattttcaacgatagggttaattttccgcccttcaattaatctaagcgactgattaaataaacttttgggtattgcatccctgattttgacccggtatactattaaacgttgcttttttacatccacaatatcttgtggttactagccggcagtaaccacaaaattgcacaacatatagtagagggagttagattaatgattagcgattattttaaatttcttgcccaccaattaaagggctggccacaacaaaattattacctattctttttcagtcttggctgtcaggtaatgactttagttagtgctccaataacgcgggtaactgtcattacatttattggaaccacgcttggagtactttgcgttttagcaattaatgctgctaagtcggtaaatggtttcttaggtattttatcggcattatgtttcatcattgctggttttagtgctaaaaattatttaagtattgccgaacaaatcgcctatgttattaccctcgatttaccagtattactttccgcaaattggaatgttaacatggcatcaaagatccgtaaattcaatgctcgttcatggacggttgccatcattgcaacaattattgtctatctcgtttctggttatttaatcggtcatcttactgacgatccacgaccatggattgatgcaatcagcttttctattagtctttccgctggtgttatttgcttcttgcgttttaacaatcaatatttctggtggcttgcatctggtcttgcacaactagtactctggtttgtttcttacaagcaaggatctgctactttagcaatggccgttaatagctcgatttaccttattaatgatgttctcgcctttaccatttcaccatggtacaacgaacgtgaacgtcaacgtctcagtaaagaagaagcagcctatgccaaagcaatgggcttagaataaatctaaaaacagcaaagagattgaaaattcagtcaatttgctgttttttgtttaatattgtttattgtattcataaactaattctggttcacgaccagtacgatgataagcatttaatgcatctatctgtgccatttcttgggcgttaagttcaaaattgtaaatatcagcgttttgggcaattctctcttcatgaactgacttgggaataaaagaaacaccattctggagatgccaccgcagtataatttgcgcagtagatttattatgagcagcagcaatatcttttaatactggttcattgagaactgctcctcgccctaatggactccaggcttgcgttactatttgatgttgacgattaaattctaatagtggtttttgtgttaatagcggatgcaactcaatttgatcaacaactggcatttcatttgcttgggttgccaaatattgaagatgaatcatttggtaattacttacaccaattgacctagtaagcccttcctttttcatttcttcaaaagctcgccaggtgtcaaaaaatgatcgttcaattggccagtgaacaagcaacaaatcaacgtaatccatttgtaatttacgtaaggattctttgacagattcaatggccttatcgtaaccttgattttcttctgccactttagttgtcacaaaaatattatcgcgcggaatggctaattgcttaaaagccgtccccacttcttgctcatttccgtataactgagccgtatcaaaaagccgatacccatcttcatatgcctttttgactgcttgattcattgtcgcttggccatctaccttataaaggccaaaaccttcttgaggcatttcatttccatcggcaagagttaataggttgtccttaatatccattgaaaatcacttcctttccttatctttaatcagtaactgaggattgtcaatatcgaaattttcctttctgaacaaactaatgtatgatgagtttaaatctatttacggggaaacaattatggctaaaatatttatcgctgaagataatcctgatattatccattccacaactcaagaattaaataaatggcaacacgatgttatcacagttaacgactggaaaaacgttgcaaatgaaattcttgctacaagcccagatctggtcttatttgatattaccctcccgacgttcgatggcttttattggattcaagaggttcgtaaacatagtcaagtgccgattatagttatttctgcggctgaaattgataccaatgtcatgcatgcagtggccgcgggggcagatgattatattatgaagccatttgcgatgacggtgcttttagctaaaattcaagctttattacggcggaataagcaaacgactgacgcagaagaaataatgtgggatcataattcattcaatccccttactaatattcttatgaacgaaaacggtactgcccagctcactccaactgaaggtgctatgctccaagttttactcagtcaccgtaataaaaccgtttctaaggagcaattacttcaatggttatggcaaggtggcaaataccttaatgagaacacccttaacgttaatattagtcggttaagaactaagctaagcacaattggtttacggcaatgtattcacacagaacgtggccttggctatcgattggtggaaaacaatgaataaacgttattttaaattattttggcgttcaatccttcttcctactattggctatctttttctcttaggtctggttgggcttttagtaattttatataatctcccaactgttttttggggcgatgtgattcgcttttctcttcccttttttatagtatggcttatcggtagtggtgcaattaaatattatcgattgcgccatttaaatatttctcagctcgataaattcactcctaccaatatgactgagggaaaacttgttgaactattgcaagatgaacaagcaaaaaacattgacacaattcgacagttacaagcaactcagcatgaacaacttgaccaccttgaattatttactcatgaaattaaaaactatttgactagtcttaatgccgcggcagaaaattcaccaactgtcgcaagtacagaagtaaaaaagaatatccaccaagctaactattatctcaatttgttgttaaatgacgaacgactagcgattaataatcatgattacaattttcaatggatcgatattgccaacttaattaataatattttgcaacaaaattctgcggtcttcattcataaacaattgattccagaattaaccggcttggacggaattaaagttctcactgatcgtaaatggttgcatttttgcattgaacaactactttcaaacgcaatcaaatactcatcccctaatagtacaattaatatttcctgggaaatgaattctttgcggatcgctgaccatggatgcggcatctcaatgaatgatcttccgcgaatctttgataatggttttaccgggaaaaacgggcaccgaacaactgctgctaccgggatgggattgtaccttgttaaaaaagttactgaatacttaaatttcaaggttagcatctcatcagttcaatcccagggaacgacagcgattctatctttcttaccagataatatcagatcatcaaactaattcttacaaaactgtaaggttctgtacacttccgtaagtaggaagttgcacagaacctttttataattaagacataatcaaaacaagttctctaccagaaaggaaaattactatgacattattaaatcttcaacacgttcaacgcgtctataatcgtaactctgccaatccagtaatggccttaaaagatattacctttaaagttgaagagggagagtatgttgcaattatgggagaatctggtgctggtaaaagtaccttattaaatataattgcaactttagaacaagctactaacggacaagcaatccttaatggccaagatctccggcagctttccaaggacgacgcagcacgatatcgacgggaacacctcggctttgttttccagcattttaacttacttgatagtctctcaaatcgcgacaacatttacttaccacttgttctagcaaaaactccggttgcaacgatggaagaacggattaagcctttaattgatcgcttacgtattaataaaattattgaccgttttccaagtgagatttctggaggacagcaacaaagaattgccattgcacgggcgttatttacccatcctgacctccttctcgctgacgaacctactggagctctagattcgaacaccagtaacgaaattcttgagctctttgatgaagttaatgctaacggtcaaacaattattatggttacgcacagtgccgcggctgctagtcatgctaagcgcacactcttcattaaggatggacgaatctatcatgaactctatcgtggtgatctttcccttaaagactaccaacaacaaattaatcagacaatgatgactttaacgaatggcggtgaataatgatgctctttctcaaactgattaattcgagttttaagcgtaatcttaaagtttacgtcccttacctcatctcaatgacaatgctagtcgctattaactatatttttaaggcagttgaaattaatcgcagtcttaaagatttaccaagtgcgacagttactaaagcattaatgcaaacaggatcaacttttattatccttgtaacacttgcgtttatgatctacgtcaatcgtttcttatggcaacagcgtcaacaagaaatgggtctttatagtatgctggggatgacgagacataacttacaagtgctaacagtcattgaaaagtgctatcttttagtaattagtctttttctcgggactttatttggtattatttttgatcgcctcgcttttcttggctttgctcatctcttgcaaattgatcatttatctcaaccttggattgaatggggcgctgtgataaatacaatcgtcatcattggcggctttttcttaattttaatggtcattgatctgatcaaactatttcagctaaatccaaacgaattataccacccccaacaaactaaaatcgcgcgtcatggtaagttctttacttttgccggacttttgggtgttgcagtccttgcctacgcctattatcttacaattacagttaaaccgcggatatctgctttaacaacattcatgactgccgtcttcttagttgtgattggaacatacctcatttttattgctggtagcatcattgtccttaaactcctgcaaaaaaacaaaggatattactatcgccctcgccactttatcgcggtttccggaatgttacaacggatggaacaaaatggtgctagtcttgcaacgatttgtttactctgtagctctgtccttgtaattttatttacatctttaactatgtatgccggcattaatgatacggttaattcttatgccccacgcgaccttacaattatcacctcgcagaaacttactgcacaacaagaatcgaccatcaattctgttgccaaaaaacaccatgctcaacttaataagcctgttacctttacaacgagcgctccgcaatacggatattgggaaaataatcgtttcatcaaccagggtaatttagagaatatgactaatcaaactaccaatacagtcattaccatgtcgacagcaacttataatcagattacggataaacatgttaaattagcagcaaataaggccttaatttattcccctgctaaagagcatcgcggtgctttacagattggtacacaaaaataccaagctactcctatctatgactttcactactatttcaatccaagtcacgcgatttattcgccaatttttataatcacaaatatgcttccggcaaacactaccacaattaacttcacaggaattaattatcacttaaatggtagtaagaaagctcatcttaactttgaaaatgaccttcaagcccagcttcacttgccaaaccaagtatattcttcccggacaaaccttcgtagtcaattgaccagtctctatggcggaatcgtctttttaggaattctcattagctttgccctaggaatcacgacaactgttgtaatttactttaaacaaattactgaaggttatgaagatcaatatcgtttcaagacgatgcaacaagttggtttaagcgagaaagaaacaaccaagagtattcatagtcaagtattgatggtctttatgttgccagtagttggtgcaataattaacctttgctttgcgatccctgcaattcggcaaattctaattcaatttaatttctataatgttcgattgatgataataattgccgtctcaattacctttatcctcctatgcctctactttgctatttacggacttactaccaggatgtatcgtaaaatcgttgagcaaggttaagtactacaaattgacatttcttattttaacagttacactttaattactataaataagtacgaccgataaaataaggagatgtcgttcatgattcttattaacaccaccattatagaaaaaattacaagctgttgctaaactactcacgacagattagactgcccttatttaggcgtggttaatctacggtattgcttagtgacagtttttaatttggtttagattatatcgaggtggtttcatgacggcagatccattaagaataggaattcttaacttaatgcatgacaaagtagatactcaactgcgatttacaaaagtactttctgagggatcctacaatgttgatgtacaatacttttaccctcaaacacactatacttctcgccctgtccctgacattgttcaagagatttcccagcctttagattttaaacaagttgccacaatagatgcttttattatcactggcgcgccaatcgaacaactcacatttgaagaaattatatatcttgatgagattcatcaattgattgacgtattagttgccaataacattccacaactttacatttgctggggcgcgatggcagctgctaactatctttatgatattccaaaatttcaattacctgaaaaaatttttggagtcttccacaattatttgcgcgcgcaagaccctctcttaaaaggattacctgatggctttcttgctccccatgctcgttatgccgaacttgatattgacaagattatgaaagatccacgattagttattaatgctgtgaccaaaaataatttcttattctcgttccgcgctcgagaaaagaatcaatactttcttttctcccatcttgaatacggaaaggatgcccttttaaaggaatacttacgagagcggaatgctaatcccggtgttgagtatatcaagccgcaaaactactttcgcgatccgcttcatatgaaagatcctgaatttagctgggcaactacccaacgagtattctttgataattggcttcattcagttgcggatcacatagctacacaacaatttgtaaaggagtaattaatatgacaaaaatcactaattcaatcgtaaatttaatcggtaatactccgattgttaagttaaatcgcgttgttcctgaagatgcagcagacgtttatgtaaaacttgaattctttaatcctggtggttcaattaaggatcggattgcccttgccatgattgaagaagctgaaaaagctggtaaattacaagcaggtggcactattgttgaaccaacctctggaaacactggtgttggcctagccatggttgccgctgccaagggataccatcttgtcatcaccatgccagaaacaatgagtgttgaacgtcggaaactcatgcaaggttatggagccgaacttattcttactcccggtgccgacggaatgaagggtgcaattgcaaaagcagaagaactagttaaagaaaaaggctactttatgccaatgcaatttgataatccagcaaatccagcaattcatgaagaaactacaggaaaagaaattcttgaagcatttggcgatgatattcctgacgcctttgttgctggtgttggtactggaggaacacttaccggggtgggtcatgcattgaaaaaagctaatcctaatgtccaaatttatgctcttgaaccagcagaatctccagtattaaaagaaggaaaaggtggcaagcacaaaattcaagggatcagtgctggctttatcccgaaagttcttgatactgatgtttacaacggaatccttgaaattaagagcgatgacgctattacgatggcacgtgaagttggtcatcaagaaggaattcttgttggtatctcagctggtgctaatatcaaaggtgcgattgaagtcgccaaaaagcttggtaagggtaagcaagttattactgttgctcccgatggcggtgaccgttacctttcaacagaattgtttaattactaaaaatttaaaaaggaaagagactaagatatttttaatctaatctctttcctttttcccattgaccgcgaccttacgtcattagctacacttgatagtatgaaaggagtggtcaatatgtatacgactggtcaattagcaaaaaaatgtaatgtttcaatcaggacaatccaatactatgaccgccgtgggttgcttcatgctaaacgaactgaaaacggattgcgccattataattatcaagaccttaaacaacttcaagaagggactgtgacataagttaagttactttcataaaaagcaaatacgcagtacaacaatggcctctaacgtccggtaaaaccgaacgttaaaggcttattgttgcttgcgggggctcgaaaacgaagtcacaagtgacttttgtctcgctctcagcttaaaagacattcaacagattattaatgacactgacaacaatattctaaaaagcctaattgttaaccaacgaagaaaactcaagcaggaaattaaagacgcttcagaacaattagcaagtctatctcaattagaaacttttttgaataaacattctgatttcccaggaaatatcagtcaaagtgtttttgacaagatcaagaaaacaaagaagttaaaacagttacgaattaaattattgcttattggtatcagcatcgacttcattctttggggtagcattctttactttcttttttatcaaggaaatttgatatggttattattaggaattcttattacagttgctttaacttggtatattgctataaattattaccatcatacttgctatatttgtcctcattgttttcataagtttagggtgtcgcttagtaaatggctttttgcccgtcatactcctaatacaagatatcttatctgtgacaagtgttcacaaaaaaattattgtattgaagaatattattaacaaaaatgaccaaggcgcacaattgctaaaccttggtcatttttttgcattttatagtattggtgaaagcaagcgagaaaagtattgcttgaatttccgccactttgactgattagcaaaatactcaggagtaagtaacgtactctttttcatgtcactttcaaagtcttgctttaactgcgctgttagtttttcattatacgcaaatgcattgacttcaaaattaagtctaaaactacggtaatccatatttgccgaaccaacagaagcaatgttgctcccactaaccatcgtctttgaatgaataaagccattatcgtacttgtaaacttttaccccgttgttcactaagtatttagcataatattccgttgcccgataaacaaatggatgatcaggcatgcatgggatcataattcggacgtcaattccacttcttgcggcaattactaatgcttccagcactgaatcttctggaataaggtatggcgattgaatatagacgtattttcgggccgaactaataattgattcatatccccgtcgaattgaataattttcattatccggtccagaagatacgatttgcattggaacctcatctggatcgccatctggtgcaaccagttcaaaattcttaaattctttttcaaggtcaattttctttttatgagtttttcgacaggttgtattccagtccatcgcaaaccgcactgtcatcatcatcgttgcttgtccgacgacacgaaggtgggtatcacgccaatagccaaacttaggatcttcgccaaggtattgatcaccgatattgaatccaccaatgtaaccaatcttgccatcgataatagctagtttacggtgaagatgataatttaaccgtggcgtttgaaaataagctttggcagcagcaataaacgcttgcgcttctccacctaattcttctaaatgcttaaaaaatttgaaagtagttccatgagacccacttaaatcatagagaacacggacttttactcctcgtgcagctgcatcttctaaggctgccaacacccgcttccctagattatcagcataaaaggaatagtattcaatatatacatgatcagttgcatgatttatatcgtcaattaacttatcaaacttctttttcccatcaataaatacgtgaactttattattaaaggttactactgaatcattcaaactcaaaaaaaggttaaccaactgacgatcacgcgacaaccggcttccttttggcattaattcatgttcttcacttaattttcgttgtttttcaagatatttagtccgtaattgtttttgctcatcttgaatactaaatatctcatcatgggataattgtcgtcccacaaaaagatataggataaatccaactactggcaaaatagttaagactaatagccatgcccaagttgatgcaatatcccgacgactacgaaaaacagtccatactgcaaaagcaatgttaatcaaccataggacttcaataatgcggcgaataacatcccatgtccaaacaatatccataatttaataatctccctagttgtattactgattcattatagccattatttgcttacttttcagcaggttcagagattattttcggtaaaaacgacgaagggcaaaagataacccgatcgctaaaagtccgtacactgcacctacatagccaagcatcgttaaattagcaaagttaacagtagtagaagccgtaaaggatccaagtgaaatcccaacattagcaaaaattgaaattaatgatgttgctaaagctaatgactgcggatattctttttctgccacactaataaataccagttggatagttgttccatatataattacaacgacacaaagagttgctagaacaagcattcctgtaatcttatttcccaatgcaatcccaagaataagacttaatattgtcatgagaataaagacaaatggtaatttttgaaccccattgtgactcgcaacgattccagcaatttcgttaccaataatactcattacccctaaaagaagcagcagccaatttaaactagttaagctaaagtccatcacagtagtaattagcggccggacataagtatagaaagtatactggagacttaagaccgccaccgtgattccaatccctaataaaacacggtgatcttttaatagcgctaattgttctaaaatgctccctttaatttgatgtgtatcacgaggagtaagccagactaacaacgcaaacacaattaatgttaatcctgaaatgatccaaaaactatcgtgccaggaaagtaatgttgcgatggttgtaccaagcggaaccccaatgaccgacgcaatactaaaacctgcaccgacccacgctagaaccattggccgcttgtccattggtgtaattatactaactagcaagttaattaatgaaataatggttccagcaacagcggcagtaataattcgcgcaaataggagccagccaagtgttggtgccatcgcagttaaagtattaccaataaaaaagacggtcattaatagcataagaagattatagcgattccaattgctagttaaggtagtaataattggcgtactaatcgcatagactcctgcaaaagctgtcaccaaaaaaccaactgtggaaagtggaacatgataactccgtgcaatatctgataaaacgcccacaaccataaactcattacatcccagcataaatgcaacaagaataaaagtgaacgatcgcaatttagcgtgcttcacaataaacctccttttaaaacaaaaaattttctggaaaaagtcaatccagaaaattataaacgtttaacaattaatttccaatagttttgaactatttagtttaataaggttgtgagtgataagcagtaaaggttttatcatcaaagcaaaccatcgttacttgatcaacataattggcattagggagaaaatctttaatcgtcctaatcgcaatttttactgccttttcaagcgggaaagcatatacccctgtactgattgaaggaaaggcaaccgtccgacataaatgtttatcagccaacagtaaactattgtgataagaattggctaacaattgatcttcaccattatcaccaccatgccaaatcggtccaggcgtgtgaataataaacttggctggcaagttaaagccgccagttatccgcgcttctcccgttggacatccatgaaatttttcacaggcgccatataacgctgggccagctgctcaatgaatcgcaccatcgacaccaccgccacccattaaagttgtattagcggcattaacaattgcatcaacttttattttggtaatatctcctttgatcacgttgatttgcggcattatttagcccttctttctttaaattgcggaaataaccagattaatcctgtaaaagcaaaagatttcattgctaccataaacccagtaatgaaatcttgtaaatcgtttttaccaatatggaacactaaactatctaatttcataactaaaatagtaaaaattaataaagttattaagattttaatttttcttttccaactcatcaattcccatttactttgactaattaagtaaagtatatttatggaaaataatcccaataaaatgtaattaataatccgccatttctcactatcaacaccaatataaattattccgcttgattgaagtaagaaataaatacatccagctatattgataaaatacaaaacagttaaaagttgttgtttatgtatacttgttctgtgctcttctttatagttatttatcatctcatgatcctcccgtaataaatcatccaaactaacatggtagaggtcacttatttgaaccaacataaaaatatcaggataacttcaaccattttcccaactagaaattgttttacgtgagatcaacaatcgttctgctacatcctgctgagtccatcctttttgataacgatataatttcattttatcggcaaatttcaataagttctcctaccttcaattaaatttatttcccgggaaattaactatgcttaagctttaccgaagaaggcgatatttgtcacgctaagaatcatagcaaacaaaaaggctggagaaacttccaaccttctgtaaatcttaaattaccaaatatgaacccgatcttctggcgcccggtacatttcatcgctaggcttaatgtcaaatgctgtgtagaagtcatcgagattttctgcttgaatattagcacgtaatttttgcggtgcatggacatcaattgaaagcagtaattgcatgtattgttccgttgctttcattcgccaaatagttgcccagttaataaagaattcttgggcattgaagtcagcttcagtttttgctgcttcaagtgcacaactaaggcctcctgcatcggcaatattttcagaaaccgtgagcttcccgtttaccttttgcccagcaaatgggatcccatcaaattcttcaatcatcttttgggctaattgcttaaagtgtgcagaatcttcatctgtccaccaattattaagatttccaaactcatcaaataatgacccgttattgtcaaaggcgtgggaaatttcatgagcgattactgcgccaatcccaccataattttggctgctgctttgtttcaacgagtagaacggtgcctgtaggattgcagctgggaatacaatgatattcttaaatgggtgatagtaagcattaactgtggccgcactcatttcccatcgcatccgatcaacaggtttattccaacgactgaatagttctttattagccgtcactgttaattgatttaggtttgcaatcaatgattcctcttcatcaaccttaaattgatcatagagagcaggaatcttatctggatacccaacttgaatgcccagtttatcaagcttgaggatagccttatcacgggtatccttactaagccattggttattggtcaagcgtcctttatagactttaatcatttgctcaaccatgtggtgaacgtctgctttggcttgtggtccaaagtacttcttcccataataatccccagctacttgactaaacatgtcgcgggcaagataaaacgcaaatttacgttggctaactggtttcttgcttccagaaagtgcccgaccataacgtccattgatttcacgcatttcatcatcaaggtaactggcattttcgcggatgacacgaattaatgcccagtttttaaagagttcaaaattatcttgtaagatcttattcagggacttaaagtattccggttctgtcacaattattttttccggttcttccccaactaactgcttaattattgccgcaatatcaagttgatcagtggcactagctagttctgcaaccgtttgtggattatacatcttactataatcagccgcttcttctgcactttttacatttggcgcaagaagggcatcgaatttgattgcatcatcaataatcttttttgcttcttctttgctataccccaacttatccatcaaggcttccaccattgaagaccataattggagtaattgatcgtgctgagccttcttttctgcttcatagtagctcttatcaggcaaaataagcgatggtgatgaggcaaataaagcataaacagtcgcattcttcatatcagcgtcaatatcaaaactaatcggtgaaggcatccctgctaaaatccagttcttccattgagattggtaatcttcatatgaattaagattttctacacttgccaacatccgtttaagcggttgtgggccaactttcttacgccaatcaaactttttagcgaggcgatatagtttaatcatttcgttaaaacgcgaatcctcagacttttccttcccttctgcataggcatcaaagtcatccatcagttgcttgtcaatgtcatcaacaaggtcattgaagcccccggtagctggtttatcatcaggaatcttcgccgtctttagccattccccgtttactgcttcgtataagtcgtctttaattagttcgttattcactgccatgtgcagggcctccttaaaaggttacattacttactattatactatgcctactagaaattcacgtaaatttgcttcaatctaaaaaaggacttaataaagttttccgtgcactttctgaaaaccatgagtcatgttgcatcagtaattgatttacttcctggtaattacttaagtcaacctttcctttaattaatccagcaatttggagctgccgagcaaattgaacatctgcggactggagaaagttgcgaaaaatcggctgttcatctggatcccaccgcttattaagaagaccaattgcccgctcatattctttgctatgggtaagtaccttttgcatggcctgtggatttaaaattgttgtcatcaattatcccctcatttctaatactcttcccggtggctcttttactgataattgattagcctttgtcatcattagccaataaacattttgataatgataattattgattctttcctctccccacccatcagtaataataataattatgcgatttcgtttagttagatggtgttgatggagatagtcaaaaatacactgaaaacttgtacccccgccacctgttcgtctaaaatcaagttttttaccatcatgtagtttttgtttggtggtcacccgggcatcaaacgaataaacattagctgtcagttttgttttcttaagcatcttttcaagtgtcgttagtgtttgaacgatttcttgatcggtgaccgatccggaattatcaacaaaaatgtcaatggctggatccaatctcgtaactttgccaggcaaatccattcgtaatggttgccggcgattaaagcgagcatgcgaattaacttgtcctcgtgcaatcaacccaaactgatgcctaaaaacctgccgccaatcaactattttagttttttggactttctgtagctgtgatcttacatttcctggtaacaaaccgcgatctcgttgcggggtttgcctccaggaacgattcaaaatctgcttaatattcgctaagcgcacgacctgattgctgatctgctgacttgtcttagattgctgccagccgttatgagtatcagctattttaacctcatctgccgttgcattttcctcttgtttaccaccattcaatttaagacctggctgatgtaatttttcttgctgttcagcaggcagctgttctaatatattgagataatcctgcgaatctaattttggcattagtttttgacgaagagctttctccaattggctaagggttactgttccctgaggtggctcagttaaatactgatttaccgctacatcagttgcaatctggactaaatcttgatgaggataagaagcataacgtaatggatgcatccagataagatgaagggcttcatgttctaataagctttgaagttcatcattacgaacgttcgctaacttttctggattaataaccagtacaaggcgattgtcttcccacctcaatcccatcattgcgggtaactgtaaatcattctctcgtggaagttgtaataacacttctccgaaaaggcgctgtttttgaaggatgataataattgcctccctaatccgttgcgcagatgtcacatgattattgcttccatcattttgatgtaaccgtgatagaaagtccactaaactcatcgattatcaccactcgtcgcaacttccgcaaaatattgataaagttgcgctacagagccttggggatgtttaatggcttgctcatacattacttgcaagaggtcgacgaaatcctcaccaactgtttgaacaatcgcatactgcccatcttcactgactaattggagatacttaataaatagagctgcctcttcttcagatgctagcttaggacttagccatgaacgtaatacttgaattttggttgcttcatcagcattttcaaactgctccttgccatctttagcgtctttcaaggttgccactgtaagctcttgcccctgtgcaaggacaaactgagcaaaggccacccctacttcatcacctaagtcaccactaaatatatcagcagcaagttctttttgcattttctggtctaacgcctgtaattgatcaagattgcgagaaactctttcccaagcacgtggcgtgggagccaaatcttcattgttcggatcaacaactaataattgttcaggatattgcgtaagataggcggaaacaaggtcattaattccggttgcttgggcccattttaaccattccgccgttgaactcgtcattactaaacgaactgtccgatctttaattgcagcatccccagtcgcaacaccatattcacgatcagtaaatcctgtcatcgtagaatcaggattttccgcaataatgatccgtactgcggaaggcaaacgcaaagcattaatctttcgttgaaggacaaggttcattagttcactttgaacagcttgcgttccacgattaaattcatctaaaaaccaaataattgattgattaggatgggcttcggcatacttaataatgctaattaaagtttcagagtaaccgaattgtacatttgcaagacgaccataattcttcgtttcaacaaaagattcactggtcaaggggggaaccggaattgcaaggtctcctttttcgcttaagctgacaaccgtagtaaataatgccgcattcagattagcagcaatttcacgaactaaagcagatttaccgatccccgcatccccgacaatattcggaacactacccgcatcgagaacaacgggaactgccgttaatagttgttgataagttagcgccattatttaccccttccaaccatgacattccagatccatgtcttgttttttcacgtttgatacatagggattgccttttacataaaagcggcgtggacttaacccatctttccccttcaaattaactccaatccgcgcagaaatagctatttctccaggaattttataattatgtaaatcaaccgttagtggacttgtttccataggctgcccatctaaatcccgtgaatgaattccgagagcttgtactaatttaccgggaccgttagtaatatttacccctgacatgtgccgattttcgatcattttatcgatgtttagcgccggttctattccgcgaagtaaaattccttgaggttcctctgcatcctgaaccacaatatcaaaacaataatgtccacggatttggtataggtaaatattcccgggcatcccatacaaagattccgagtagccagtgcgtcgtccgttaaaagcatgtgatgcagaatctttttctcctaaatatgcttctgtttcaacaatataaccaccaatgattccacttttagtttggtattttactagtttccctaaaagatccttcgcaatttcgactgtgggccgtccagtaaaaaattgttgatattttgttagcatatttattttcctcctaaaaagaactatcctaaacataacactaattaaaggagatcggcatgatggaactaaaaattgaacgaatttatactaaacctgttgatttagatggttatcgtatccttgttgaccgcatttggccacgcgggatttcaaaagaaaatgcacatcttgataagtggctcaaagaggtcggcccaagtaccgagctgcggaaatggtttggtcatgacgttgctcgttatccagaattcaaagaacgttatctcgcagaattaaccaacaatcctgtttactataattcattaaaggcaattgtccaaagtaagttgccgagtcagaacgttattctcctttacggggcaaaagatgaagaacataatcaagcaattattcttgctgacaagctccaaaaagatttacaactcgctataaaataatataattttgtattttttaggaataatttgttttataataatagtatgaggattttattcataattctctagtgcccattgtttcactgacttagttatataaattccttttgaaggtatcaataccacaaaggatttttacaaactttttagtgactttttctaatcgtgtaattagaatcacgggtaccaataaccccctagtttcattttgaaacaattatctgataaggtggaagtctattattgaagtggtaggtagacttctgctttatatttttaaatcaattatttgtcagcccaactacgaccatcgagctcaccggcggcattgactaggcgttgtgcttgttcaagcattaactgctctaatgcccggtaaaaagcttgatcttcatatgttgggctatttttcattaatttttttaattcttcgtgtgcccattgttgattctcatccattttagtcatcctctttttctcgaagccatccgatagaagtatgtaaatcatccagctcctcttgttgatcttgtaaaagtgccaataattgttctaatttagcttgttgaagaggatctaactcttgagcaattttaacgttaaggtggtcaataaaccattgcgtctgattgctaaaatgcaagaatttatctaaggtcaaatattgctgatagtggataaataaagactgccgctcttcttcactctgttgggcaaattgatagatcggcaatggtggcaaataattcatccccatcgcgtgcgctaaagcctgatatggtcgtaaaagttcagcaattgtatatccttgactggcacccggttgaaatgcagacgcagaatgagcaaccgtcgtaacaatccccaattcacgaccctttagcaaatgactgcttgtaagttgtgaattccatacctcatcaagccattgctttaagatcgccggcgcactataccaatacagcggaaattgaaaaataattcgggttgccgatttaagtaattcctgctcttgagaaatatcaaaaggtgtttttaattcatgccacataacgttattttcatcatcagcggctgcctttaaaaatgattcagtcgatgaattcgcaagttgagggtgagccactattaccagtgttttcatcaatttcactcctttaattctgcaaggccttgtttcaagacatcttctgtaacatcgacagttagaaatcgttgcagaggcgtttcactatgacgatccttaaaagccattggttctgcttttagaattacaacagtcaaattattttccgtcagcattaactgacccggatatttaaatttccccttagtatgttttccagtccgccaagtatgtaatttagcctcaccattctggtcaaatttcaactgatactttccactagcatctgtttcgacgggaatcccggtaaacttttgaacatcatacttatcttttttacccataatatatccttcttagtaattaatctaattttacggttccacttttaattggtccgcataggcattaacctcatcctgttggtcttcacttgtgtagtaattatttatcaaattcgtaacagtggtatgcgtagtagtcattggtgcccctgtcacattttgattttcagttgatccaatcattttaattgtgacatcattgcctttacgtttaaaccaaatatagctagtcaaatcaccctgtgttgttacatattgataatccgcaacttcaccataaccataatgcgttccataatacatttcaccattttgaactcctgccttaaaccaatcagggttctttaacaatgcaactaatgttcctagctgctgggtagttaatccatccttatccgtaattgtaactttaccacgcatatcaataattttggtgttttttgctactttcaaaacacgattaacttccccatgagttttggcatacgtcaccatttcagcgagtgttacgcctgttttgcgaataccattactactgttcgcatagtaaaccttatttccgacaattgtataataggttgaatttaaacgatcgccatcttcatcacttttggaagttaatttaatcatgtataaaactttggcgcctttaggataagtcttagcagaggatccctctccccatggcactgcacctttatcataaatcttaactgttgctccctgattattgttttccatatcagcagaataatcataatcatttgctcctggcatatgtgcatcacgatagtacaacacaagtgcagcagtttgcttaagtgttaatcgttcagcgtttagtgctgcatcatcccttatttgttgtgtacttgataaagaactagtcatactactagttgatctattagtacttgaggatgttctcccacaagccaccataaccatcatcgtcaatgaaagcatcaaaattagcgctatttttctcataaagatactccccacagatcttatatttaaagttttattataccttaatctttaggagtcatctaaaaagcctctataatcgatttggagacttccttttcattttattcagcaaaataatccttaatttctttgtctgacaagtcaaacttttcttttatctctttcttgaattagctgttctttttctttgagtcgatcctggccttctttaatttcatgtttacttttctgaagttctcgttttccttctaaaagctctcgttttccttctaggagttcacgttttccttctagtatctcccgtttgccatcccgtatcctacgttcaccctcacgaatctttttctcgcgcatttcttgatccatttcatatactgaacgtcgcatgtattccggcctccatttccggttccgctttacaactgctattctctcctttaattttacgacaagcggatcggtcgcttcaacttttcgttgggcaatatcgtggaggtcagctacttgcatctcaacatcataatcaagcatcactttgttgaagatatagtcatcggctaagcccgccatctcctactttttgcgtaagaattcattcatcgttatatccccccgttaaatagttctataaagatatatacgtaaaaggcaaagattttcacttttctactcaatatttttccaatgtatcattaatgcatattaataatgctttatcttttggctatggataagattcaactataatagatagtgaaaagtaaatcttctttattaggtattatctatggtatgtgtagataggatgttgaaaggaagcaatactatgttcgacgttatcttttggattcttgcaatctggtttgtagtaaacgttgtatggatgtggtttgcccttgataaccaagttctacaaaaaacattcgcatggattaatgtatgtgcaatcgtaattggtttttgggtatattacggcatgactcacgacggcaacgcccttaacggctggttccttacaatgaactgggtaaacattgcaattgctgctatccaattctactttggttatcgtgaaaacagcgttatccacaacggtcacacaaccgcatgattgatttacttttcaactagaactatggcttggggtcatggttctttttttgtaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacaaagaagagagtatggaaaaactaaaattttcccacactctcttttcaatttttcatattgatgacttgaactatttaaattctaaaacatataaaagcaatttattactatgcactgaaaatacacttacttcttcccaaacaaagctgccatctttgctgctacttcgggatcaagattatcggcaagcgtactttcatttgatttttgttcattttgctgattagtgatcgtttgcttaaggtcatcaatgactgcttgctcaccaacttcaatcggattaaccgttaaccggccacctgcagcatcagcatgaccgccaccattaaagtatttttcagcaaatttagccacatctaactttccgttgcttcgaagcgacacgctaaccggactgactaccaaggccgcatcgacttctggatgttgcactaataattcgtgggcaatttcagatttatagtcacttgcatatacgacactaaatttatgatcatcgatatctgtaattaaaatatctttcaaatggctcttaaggtactttgcccgccgttcgtttagtgtccgaatcaacagccgattttcttcctgatattgttgccagctggtattaaaaacattttggacaaactcttctgaatcttggaggggataaaaccaaaagagctgatcaagattatcggcatcaattctttcctgctcattcatttctggatcattttgccaatcccaagtatcatatgcccgaatcaattccacaagataagcaaggcctttttgccgttgctcatcaatctttgtaaaagacgattgttgttttaaccaatcccataccaagcttgtggcacttgggttaactgttggatcagcaggtacgatactattggccgcatacttttgtcgtagttctgcttcactttcatgatggtcaaagacaagccaatgattagcgaaacgttcattcaataacttaaatgaataatcgctatctggcgtcatatccatgatgtaaacatctgtaaatcgccctacttccgctgtttgcatccatcgacttaactcttcatcgattcgtccagcgccacagtttgtcatatcaaactctgtgtcttcaaacattactggttgtagtgtttttaataataatggagccccgaatccatctaaatcattgtgggaaaataattttattaaccgttgtgccatttttgatcctcgcaattctgattttgtttcttattataccgtagaaaatcggctaaaccacacttaattactgacatcacgctaacgaactgctatcattgaaattagtaactcattttaagaaaggaaaataatatggaagtttatgattatcgtcaagaattgattgacctcttaaataataccgctgatgatccacaaagcttactgcagacacagcgaagtcttaccaccattcttaatattttaaatcattaccaggaaagcaaacccgttaaacaaaatgcaccacggtttgttcaacgcaaaattcaatcgtcaaacgagttgcctccgcaagcacgcaaaacattgaagtcactgcttaccggtcctgctaatgatgaagagaagccaacctcaacggcaagcccagttgcatctccttcagttgaagcaccaaaagaaatcaccgaagaagaacgcctagcagccgacaatcgctacttagtacaccggaaattaagtggagccgagattaatcaccgttactacccggaagcaattctgcatgcattaccatttcctattgaggatggggacattgcccaactagactatgaacaaaaagtccgcggccttccagttattcggcagattaccggtgaccaccttagcgattacactcccgaaaaagtcaatgtgattgaatatggtgaattaaaacgcgtgcccggttctgatgtgcttcaactgagtaaaacaattaagggtaattcaatcgttgacgaagcgccagaaaacaccatcgtaattgatccctttaagtaccctggccgcgatattaagccaggaatggttattgattttgcctactatgatcgaggaaatggcctaactgataccaaagatggcgcgattcgctggattcatgaaaagcaagattatgatacaactaagcaaccagctaaaccaaaagttgttaaaaagcctgctaattctcgtcatgattatgagaaaaagctggactatgaccttcatcaacgaaaggtacttgttattaccggaatccgcagcaaggttaagggtcttaaaccagtcattgacaaacaccacggtctgttccgcggattagatgcgtctgcagaagaaaaagtttctagcagtaaattaaaacgcgaaattcgtgatgcagactttgtgattgtctgcatcgatgcaattcaccatcgaattagtcaactcgccaaccatcacgctaaacgttatgaaaagccacttgccattgcaaatgttacttctaatactgctgttgagcgagccattgcccgggcattaaatggtgatcctgcatacgccgaaagtagcgaagatttgaaaaattataaataaattttaatttactgttgacttttatgagaaataggttaatattaatgacaacaatttaattattcgatcgcaatgagaaagaagagtatgttagacgatagcttcagcgagtctcgtttggtgtgaggagacagttttaactctaattgaaaatcactttcgagtctacagcttaaataccagtaagctgtagtggttacacccattatcgtgtcagcgtatcgccatgatggccgtacgtgtgaggtattgttagcaatagcagtacaatgatagggtggtaccacgctcagcgtcccttagccagtttggctaagggacttttttgttgggatcagattaggaggagaaaacatgcaagatttaacatcgcgcaagttaacattcaaaaactatttagttgttgcatcattgcttttcggtttattctttggggccggaaacttgattttcccgttacaccttggtcaattagctggtagtcattggggaccagctgcagttggctttctgattactggagttcttttaccacttctatcagttctcgccgttgctgttacgcgtgcagaaggggtctttgatatcggtcgtccgcttggcgtcggtttcgccttagtattcatggttcttatccacgctacgatcggtccattattcggtacaccacggactgctactgtctcattcacagttgggcttgccccattcgttgataaacaatatcaatcccttgccttgctattattctcagctttattcttcggggcagccttcctcttctcataccgggaaaatgatatcttagctaacatcggaaaagtattaaatcccgtcttcttagcccttttattccttgtctttgttgttggtttcgctcgtccgcttggtaaccccgctaccgcacctacaactagtgcttatgttcacggtgcgctcactaacgggttccttgaaggatacaacactatggatgctcttgccggtcttgcatttggtgtaacagtggtaaccgccgttcgttctatgggacaacggtcagcaaaagatgtatccaaagtcgttgcaaaagctggtgtcctctcaatgggtgccgttgcttttatctacttattactaatccttcttggcgcaatgtctcttggtcgtttcaaagtttccccagatggtggagttgcctttaaccaattagttaatgcttatgccggtgcattcggacaagttgtactagcattcttgttaactgttacttgtttaacgacggctgttggtttagttgctgcttttgctcaagacttccataagcactttccaaaagttagctaccatgcatggcttgccctcagttgtctcgcctctttccttactgctaattttggcttagaccaaatcatcgcttggtcaacaccaatgttaatgttcctttacccattatcaatggtgcttatccttttatctgtgacatcaccactctttaaccgtgatggcgttgtctacttcttcgtggtccttttcaccgttgtaccagctctcggtgatatggttgttgccttcccagcggttgttagccaaagttcatttggcttatctgttgccgctttgcgaaataacttaccacttgcaagtatgggattatcctggcttgttccagcacttgtcggcttagtccttggtctcttagttcactggtaccgtcatcaacgggttgcttccaccagtatgcaaagcgaagtacattaataagtgtcttataggttaaaaagcgtgagaaatggctcattacaagagtcgtttcccacgcttttaaattattatttaacattatcgtattgggcaagattaaacttcttaatcgcatagatcagcttgctggcataatctggatcggttgcgtaaccattccgctgtaattcgtaagctgcctgttgataagtttttgctgtttgtactccatggaaacgtgcatgattatcagcaattccatttacaatgagcaatgtgtgcgcattaattgaatcagcccagctgttgtaaactgtaaagtattgttttacttgaacatttttaccccgaatattttcggtagtatacatttgaaccttttcgtcgtcactattagctttaattccaaataagttattgtatttattcgctaaccggctccgaccccagttcgattcaagtcctgcttgtgcaatcgtaatgctagctggaatatgatacttcttctgttcacgttgagcagctggcgcaatctgacgaacaaattcattgacggttatatctgtcgggtgggtctcacgttgaatttggggagattgatggataataatcgccacaatcccaaataaaataatcaaaaatgcaagtacacttccacaaatgatttttgtttcttttttcatgacgtgtctttcctttttatgaatttgacgctattataaccacttcaccatgagaaagcgagaatttacaatgatcttatttacttttaagctcgtttttatagttacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgttattaaagtatttactatcagtcatcttcaatttaggaaagctcttgattagccggcgatgattccaactcaattgcttaccagctccctctttgtttagatgttgagcaaagtaccgttgccaatcttgaaggtgatctttaattgctaatttatccttaggagctgctttttcaagttgatccagcagtttctttcgataagcggctgctcgttcatcccattgctgagttgtaatatggaatttttccacactaataacgctgagaatagtgtcagttcccatcacgaggacaataattagggcaagcatcccgtgggtccatgattcttcccagttaataatccgctgaataaatggctgaacaaacttaaccagcaagacaacgccaatcccccagaaaaatgaaatttggagagcaactcttccttgaatgtttccttttagatgcgaatagtcccataacttcatatgaaaaagtttttcgagcagccaacttgctacatactcaaagatcgaagccacaataacccctactacgaatagcagaaaaatattatcttgaaacggataggtagtaatcaaaatcgtcgtaacggcaaatccatatattggacaataagggccaaataagaatccccggtaggtgaaatgatggtccttaattgaacagtaacaggtttcccataaccagccaataaatgaataggtaaaaaataagacaatgatttcagaaagtgaatagggcactcgtttcccctcctttttgaattcattgtctcatatatttctatttcaagctaagcttttcaacgttcaggatcttatcaagccatccttcaaagaatccttgttcgtgactaactaaaattaaatttcccgggaaatcttgcagggctttctttaacccttccttagtttcgtcgtccaggtggtttgtcggttcgtccatgataagaaaattacatggggttaactcgagaatggcaagtttaactttcgtctgctcgcctcctgataaaagattcatttccttcattgtattagcagcgttaatcccagcccgcgccaactttgtccgaatcgttcgtggctgcatcgttgggaacatattttgaattgtttgcagtggcgtaagcgttgggtcatcccactccaaatcttggtcaaagtaatttatccgggccgatggggagaaggttgctgttccgcccaacgctggaattttctttaaaattgatttaatcaaagtcgacttaccaaccccgttaaatccggtgaacaataatttttcacccattgtcatcgagaaagttactggcgctagtaatggtcggttataaccaactgataatttttctacccgcaacgcatttgctgatccggtattttcatacggaaaatggaaagttgcttttagattatcttcgggtggatcaatctttttcattcgtgcaagcatcttttcacgcgatttagccatagtcgattttgaaccggccttgtttttccgaataaaccgttgcgccttttcaatgaccacttgctgcttctcatattcccgctcttgggcttccttccgctcttccttttgccgcattgcttgttggaaacttccgcggtatttggtaattttaccaaatgacacatcacaaatggtattcgtaacttgttcaaggaagtcatagtcatgcgagataatcattgcggcaccatcaaaatcattaagatagtcgattaaccattcaatgtgagctgtatcaaggtagtttgtcggttcgtctagtaagatgacatctgggttctccaatagcatcttcgcaaggataatctttgaccgttgtcccccactcatctcagagacaacatgatccttaccgatatcagttaatcccaaaccattcattacccgctctacttccgtttcaatttcatagaagttattagcatcaagtttttcttggattcggcctgctttggtgaggagctcatcatccatcttttctgcataatccgcataaagcttattcatctggtcattaagctgataaagttccgtgaaagcagtatggaggaagtcaatcaatgtcatccccgccggaatatctacatactggtctaagtatccaattttgactcctttttgccatttgatagtgccatcgaccgggagggttttcccgatcaagattttaatcaaggtactcttcccggcaccattttgcccgacaatccccatgtgttcgtgcttttctagttgaaagctggcatcttcatagagctttttatcggcatagctcattgtcaagccttcaacatctaatactgccattctattctctcctctttttcttacttattacgagctaaaactgctatccatactatcatattttaggcacgagcttcaatttattggcaatagtcctactttaatgaaacaaggagccaccatatcattcctaaaataactacaataatccactatttgtctcgatgatgatcttaaagaaattagcaaaatacttagaaccaatgggattgagcatcaatagttattttaatatggctgtccggcaactggttattcaaaaaaaattccctttgaaatcctggctgaacaagaagactctaatttgacaactcggcgtgctttaattgaagctaaagcgaaggacttggggattattcctgatggttcgcctcatttcaaaaatgttgatgaagactaatggatgaattaatctacaaaccctaattcaaacgagactatcaaaaattatagtccgatttccaatattagagggttaaaaattaatagttaatttccattctctataatgctttatttctgtcatatcaacgatgcaaataatatttgctagcaatacgtattcagatataataaccttatccccatagaaaagaggaattaaagtgaaatttggagatcgcattaaagagcaacgtattaaattagaaatgacacaagcaaatgtggcacaggaactttttactaccagacagacaatttcaaactgggaaaagggaaaaagttaccctgatttagatacgcttattaagattagcgatttataccatgttccaattgattccttattgcgggaggataaagatttgaaaaataatttagatagaaaaattacgaataaaaaattcacaccacttttcatttttataaatttcggcattagcttttggtttattcttcagccttacataataactaatcatttatgggcaagattaggaaatcttggattagcaatttcgatgctgggaataataataacggctggtcactttagcgcatatattgaagactcacctcttataagaaaaattaactcctttgttaaggaaaaatttcttaggaagtctattgttatatctgtgattattttggtactaattatttttacgctatatcctacatcagtctccctatcaaataaaacagatctttactttggattttttgtccttattctagcaataattaatgttattcttgaattcgcaaattggatactagatagactactagaaaaaaggtaggtgataaaagatgacaaagtaccaaaagacggtaagaggacgaaatccgcaactaggtaatagtttaatttcactaggtcctcatggtggaattaactatgaatttaaaggaactaaagattcttatggattacataaaaaaagaacatataaagtatatagttcgaataatcgagacgaatggcaaaaatataatcaaactattgaagagcgtaaaagaaaaaaagaaatagaagctaaattaagatcatacaaacattatgtaaaaaaagctggtactaagagaaagtataatctatggccagagatcataattgatgtattttactatcataaaaagaatactatttcaaaatatgatttatttttgcttaaagaagctcattattgtaattcaaaaaaatgtattgttacaaaaatcaacaatggtaaagtatccattagatgtaaggctcgaaatagaattccatacactaagtttatttctctttacaataatgcaaataaactttcatatgaggtttagggtctatttttaataaataacccttaaagaatattgatatatcaagcccctatattctattatcagaatataggggttattattttataattaggataaatagcccctaaaataatgatgcaattgtgacgaacaaaatgtaacattgcaattgacaatatatttgagactattgctttacttactatccctatgtatcgcaataatgataatgaattttaggacaggagtaaattgacaatggagtttgcaaagcaattaaaaaagttacgaacagataaaggtttatcacaagaagatatcgcacaaaagattcatgtgacaagacaagctgtttcacgatgggaggctggttcctctgttcctgacttagaagcagccgttcagttggcagctttctttgacgtaagtcttgactggctagtattagacaagcaaccagccgataatgttacaaatcaagatatattaaatgcagtcaacgagctaagagacgacatcgatgatctaagtgatgatattgatgatttagatgatggcggtgttggttttagtgataatagaaaatcatttggtagttttctcgaggataattggtttctaattatagttatgtgtgtccttgtatacatgggattccatggaggtatcagctcctggaacggtaaatttttctaataaaaggagagtagcatgaaacaacacgttctacccatcaaagacaccaacattctacgcgaagtccaggacaccttacttaataatttccgctatggtcgccgaaactataccatcttccaagtcggcaaggcaacattgcttcgagtgagtgatgtattagcgctgagacgcaacgaaatcttcgctgatgatgaactatcaagaaaaatgcgtatattcgcgataaaaagactaaaaagcccaatattttgtatctaaaaccggttaaacaggatttactagattattatgcctggcttcaagaaaatgatattcaatccgaatggctttttccatcaaccacgcaccaagaccggtacttatcggatttacgtaatcccttgtcacagtaaaaatacagctattataaaatggtataataaaaaagtgcactggcgaccaccaatgcacaagtatacgttgtttggagctgattccttttggagacgttctttcacgcgcttagctggtggtgtatggcagtacaccagaataagagcgattttgctaaacttatcagcccaactattgaatataatatttcattagacagctatattatagcatgagttagcaactttatcgaccgtctggcttaatgtcaggcggtttttaattttctatataccttactaatggattaatcatatttattggacatggaagcaacaatgtacttctatgtctatttatttttatcatatataattgacactaaatttaagtaatgataaaatctctaatatatatgtcatatatatgtgtcataaggaggggaccaaatatttgaaccgtgttaaacaatttcgaaaagatcaaggattatcccagttaaagctagctcaaaaaattggagtagctcgtcaaactatcaacttaattgaaaataataagtataacccctcgttagaactttgtattaatttagctaaagcattaaatactgatcttaattcactattttgggaggaacatacggatgaaagaaacaattagcaccaaaatcattaagtggttttacggtattcatggaccattagatgaatatcgccgcaatgaactcaatcgaatcggtaataatattgccatatttttattatcaataaatctattattaagttttattgctagccttttaatgcttagtactaataattctgaacttactcttgatatcgtagtaagcgtcctactattaactgttttcgcttctttaggctatattctatatgaaactaaacgacatcatttaacagaaattgatgttgaagccaaacaggagagcaagactaaacaaaaatttattaaaagagcaattggcttaggaatttattttgcaattgtaatgtacggattaacaatccttatcgattggttacctaacaaaggagccttaattccattacttacagaaccttctacaattagtagtgttattgtcagtggccttatctacggactattaatgggtacttgggaaatacatcaaattaaaagcgatcctaatgacaaaaaagtaactcaaaatcacttacatcaaaaatattggttagttttatttattattatcgttattactagccttctattaatacataagtaattatatttccaaaaaatagaggcagtagttcgtgcatatgctgaagaaaaagaaattattttagacactgcaaaaacctttgataatactgatgacgcaatgagggagcttttcaaggacaaataataattgaaaaattagttttggccatcaatttcaacttgatattgattttgactaacacatttctcgatttcattttagttgttttctcaattttaaatacttatcaattgagcgccctaattcaaacacagagcctataaacaaaaaattagcaattgcgtttaaccagctccacggaatcatatttcttaaacaaaatccagcaattgttagtattatcaaagatgaataaatgcaaaaatcgcttctaagctcttttatttccttttgaagcttatcattagatttcgtcataatagttcctttctcggaaagaataattgtatctagtcataataccatatgccaatgtagatactttaacaatatctccttaatttattaggaaggaaaaacttgattggattgattttagttacagaaaaacaacctaagattagtttctagccttttctgctatacgccgtagccacagcgatttctcaagtatagaaaatttttattccaataattttctattcaaattattacagcaatttaacaattatgtaacaaccgccacccttaagatatttttcatatcttcttcacaatatcatcatatagtaaaagagtgcacaattagttgcatacataaaagaaaaacaaacaataattcaggagtgaataattatcgctaagaaaaaaacaatgtcaaaagtccttgctgctgccttaggtgctgctggtgcattagctgttgctaacactgtaagtgctgacacacaagttcaagtacaatcaggagatacagtatggggatttgctcaacaatacgctactactgttgattcaatttctactgctaaccaattagctgaccctaacgtaatttacgttggtcaacaattagttatcccatcttctgctatcagtgctgcttctgctgccgcaacagttgctgcacctactgcaactgataacgctactgctagtcaagcagccgttgaaactactgaaacaaccgctgcatcaactacaccagctgtttctgccacaaacgcaagcaacgtagccgaccaggcacaaccaacaacagtcgtatctactgcttctgataacaacactactgctcaagttagtgccgtatcccaagttccagcccaagtaagtgctgcttctgctactattagcgttgctcaaattagtgctgcaaatactaacaacaacgttactactttaacaacaactactaacactgcagctccaacacaaactacatacgctgccactgaagcagttgctactccacaaagcaacactactgttcaaagtactgctgctgtaaccgctactccagcaacttcaactgctgctggccaaggtaatggttctactgctaatgcggttgccgttgctcaagcacaaattggtactccatatgtttggggtggtaaccaaccaggcggatttgactgctcaggattagttcaatatgcatatggtcttggttcgaactaccggactacttaccaacaaactaacctcggtgcccaccacagtgatatccaaaacgctcaaagtggtgacctttacttctggggcccagatagtgctccttaccacgttgcaatcgctactggtaatggtggttacatccaagctcctacaccaggtcaaaacgttcaaactggtaacatcaactactacactcctagtttctacatcagcatgaactaagatacgagtagtataatcattgagtaagatagaagattttcttctaccttactcttttttcttagcaaattttaataattatattgacagctttattatcattggttatacttaacaacaattaattaagtagggagtaagtataatgaacgtatatcaaactatcaacgttaatactcgttggcaaagccggtaattcaggttgtttcgtcatggatgcgacctgaagaacagattgcatctgtgccggctgagtttgatgttcatttcagtccgcatggatccacatgcggacttttattttgcctttcaaaaagcgagggtccgtcatgtgggctctcgttttttattattttgtgaggtgagattttagatgaaaagaatgtatagtttaattgcaattattatcgctttcctttgtttcgcattctttagagaaaacaatggattcgtaactaagcaacgaattccaaaagttggtgtgttaaccttgatgcatcacccagcgttagatgaaatttataaaggatatgttgatgaattagcaaaggaaggttaccacaacggtaagaatatcaagattgagtatcaaaatgcgaacggtgaccaaagtaatcttaaaacaatggcttcaaaactcgttgatgataactcaactgttctttttggaattacgactcctgctgctcaagcattagctaattctactaccaaaacaccaattgtacttggtgctgttaccgatccaaaaacagctggactagttaaaaataatcagcatccgggtggcaatattactggagtatctgaccaagcaccaattcgcgagcagctcaatttgatcaagcaattcatgccgcgaatgaaaacactgggggtcatctacacttcaagtgatgcttcagcagtagccggttatcaccaaatcaagcgtgaatgtcgtaagatgaatattaacttgaaggcctattcaattgccaacagtaatgacttaaaccaagtttccgaacaaatgcttagcaaggttgatgcagtaattgtaccaacagataataccatcgctggagcaatgcaaactttagttaagaatgccgatgctgctagcaaaccagtcttcccggcaactgacacaatggttaagcaaggtggcgttgcaacttacagtgttaaccaacgtgctttaggtgtccaaggtgcaaagatgacggttgcaatcctcaaaggcaagtcaaaaccagctgatactccgattgagtacatgaagcatgggactcctgttctcaacattaagcaggcccgaaaacttaacttacaaattcccgctcaatttgaaaaggatgcagaaacgaaaggagaggtttacaaatgaatctaatcgtatcgtcaatcggtcaaggactattatgggctttacttggtcttggcctttacctgacttttagaattcttgattttgctgatatgactgttgaaggaactttccctcttggggccgccagtgctgttgctgcaatcacacatggcattaatccctttctggcaactttaattgcaattggtgctggaatgctcgccggtttgatcactggattgctctacactaaaggaaaaattcccagtttattagccggaattctaactatgaccgccgcctactccgttaacctccgcattatgggtaaatcaaacgtttcgttgcttggtcaaaagactctctttagcggtgaattcatgcgaagtctgccccaatactttgatagtgtcttcttgggaatagttacgattgcgattattaccgtaatcctggtcttcttcctttcaactgactatgggcaagcttttattgcaactggtgataatcctgtgatggcaaaatcattcgggattcatactgacacaatggtcatcatcggtctaatggtatcaaatgggatcgttggactttgtggtgcgttgattgctcaaaataatggatacgctgatattaatatggggattggaacgattgttatcgcccttgcttcaatcattattggtgaagtagcctttggtgaattaacacttaaccagcgacttgtcgccgttactcttggtagtatcatttaccgaatcatcttacttgctgtgctacaacttggtttctccgccaacgacctcaaccttatctcctcagttgtccttgcaatctgcatgatgttgccacaacttgaagaacgcattcaccttaaaaagccaattttgaaaggagtccggcctcatgaataaacctattttggaattacaaggtgtcaaaaccattgttaataagggcacatcgagtgaaacaactattcttaaaggcttaaaccttaaaattaatgagggagacttcattacgatcgttggaacgaatggtgctggtaaatcgaccctttttaatgtcatcggcggaaacctgcacgctgacgaaggaaaaattttgcataatggacaagatattaccaatacaacagaagaacagcgaacagctttcttatcccgtgtttttcaggatccaaaactggggacggctgcacgaatgaccgttgctgaaaacatgctattagcaactaaacgtggtgaacgtcgccatcttattccccggaagctcaaaagtaatatggaccgtttcaccaagctagctgcaacaatgaataatggtcttgagaatcgcatgaatacagctactggcgccctttcggggggacaacggcaagcattaagctttttaatggcaacaatcaaacgacctgacattattttgttggatgaacacactgctgctcttgatcctcatacaagcttaaatctattacacgctactaatgaacggatcactaaagatcatttaactgccttaatgattacccataaccttgaagatgccttagagtatggaaatcgtctaatcgtgcttaaagatggtgaaatcaaagcagattttaatgcagagcaacgaaaatctcttacccctgagaaactttatacttattttgaaggatagtttgactatatatcaaattcgatatattaagtatatcgaatttgatatataggagacttaattatgaattggtggattatttttatcacatttcttgccgtaaacctcgatttctttttcatcttaatctttttactcgaaaggtataaccttcgtgatgtaatcattggctatcttggtgcccttcttgttctggttaccatcagctttttactaggaaaaactctcgccattttcctccctgaatggattttaggaatactagggatcctccctatttacatggctctgcatgacaacgatgaagacccaactcatgcagaaaagcacggcccaattattaccaccttaataacctatctggcagtttgcgctggttgtaacctctcaattttcttaccaattttaacgaatcttaccttccagcaatttactcaggcacttctttttatcgcagtcctttcaattgcgatcgtgattctcattaagggaattggtaatattccactaattaagcaagcaatgcaacgttatagtgaaaccttaatgaaagttatttatatcggtgttggttgttatgttttttgggatagtggattaattacccaccttattcaccttctttagtttggtataataattactaaaccgattaaaaggaggagcagcaaccattgtcttcaacccaagcctttattgatgaagctgctaaaatctataaagttttaagtaatagtacgcgcttaaatatcttatattatctccggcactataacggtgaaacggatgttaaaacaatcgttaatgaccttcaccttgcgcaaccgatcgtctcaaagcaactcggtattttgtatcgttaccagttagtcagtcgccataaagaagggacccgcgtttactatgctttagatgatcctcatgttattgaaatgattgatgacatgctaaaacacgttaaacatgaaattaagggtgaacctcatccccgaaatttatataaataaagagtgaacaggaaacaatcatcaaaagggtattctctattcactctttttttgttgttgattatttttcgctcttgtggataaaagaattgaattaataaaataatcagtctttcactttgtattctgagtagcgtaaaatgattagcagattgtcaaaaggagactcaaaatggacgaattatttgaacattcttcaatcaaacgcgcatactttacacttgcactgccggtcgtattgagcatggcagtaactttgatttataacatggttgacacctttttcgtcgccaaaactggtaaccctgatttagttgcaggagtttctcagggagccccgattttcactttaatgattgccctaggtgacatttttgggcttggcggtagctcagttatttcccgcttatttggtgaacaccgtgataaattagcacgctttgtcagcggttattgcttctatgcaccaattatttgtgggatcatcgttacttcaataatgattatctttcaaacaccaattttacatttattaggtgcctcgccagctacttggcaatatgcacgagaatattacttagtgattgcttggggcgcggttttcattatctttggactttcaccaactaatattttgcgaacagaaggtctagccattcagtcgatgatcgctagtatggtggggaccggaattaatatcgttttaaatccaatttttatttttacatgtggactcggcgcagctggttcagcgttggctactgtaacaagtactgttattggcgatattttaatgatttattatttgcgaacaaagagtaaaaagttgacgacttcaattcatgaaacgaaaatcggctggaagcttcaatttgaaatctacgctatcggaatcccggcctcggtcactaacatcatggcaacgtttgcggttgcgttaactaatcgttacttgattgtttatggtgcggatagtgtagctgccatgggaattgcgatgaaagcaaatatgatcatcaatatggtaatagttggttttgcatttggcgcgcaacccttgatcggatacgtatacggcgctaaagatgagcaacggtttaataaagttgttaaatttgacattcaagttgttgctagtcttacctttatgctcactattattcttttcattttcgctccccaggttattcgcattttcatgagtgatccccaaatagtaaaagaaggtgccttgatgcttcgctggctgtcagtttcgactactcttgctggtatcattctcgtttttacaaccatgttccaatcaatgggaaaagcaacgcctgcattttggctctcattctgtcgtcaggggttgattttcggggtagtgattagtatttccgcaaaattatttggttatactggaatcattgctgctcaggctatttccgattgtttaacctttatcctggcacttattttcttttattgctatcgtccgcgttttaaataaaatagatttagacatacaaaaaaaggcctctcccgtttaaatttttcaaacgttagaagcctcttattagtttattcggttatttttcgttcaaagtaatgagccagtttagcctctggataatatccagttaccttttctttcgcctgtccatccttaaaaaggaccagacttgggacgctcattactttataccgttgtgcaatttcttgatttccatcaacattcatccgcacaaacttgattttatcaccgtattgcttttctagattttgcatagctggttccatcattttacatggaccacaccatggtgcccaaaaatcaacaaccgtcattgagccttgaacatccttatcaaaggtctcagctgttgcatcaattgccattttattctaccttctttttctgtgatctacgtataaagtgaataataatcgttaccgcaaaaacaagcaagataaaactaccgaaaatccctgatggaatctcgatgtcaattgcaggaatcgttaagaaaagtttaatagcaatcacaaagattaagatatatgccatcggttctaactcaggaactttgcgcatcagtttcataataacttcagcaattcctcgcatacatgcaatcccaatcagaccaccgattaaaacaataaccggattattagagacagctaatgacgccaaaacagaatcaatggagaaaataatatccataaattcgatctgtaaaacaactgtccaaaaaagctttcgtccagttaaatgcgttttaccttcacgggtctttcgcattgctcgcttaccaaagaacttattatgaaagtaacgatagacaaggtaaattaagtaagcagctccaataactttgatttcccaaaagttaatgagatatactccgattccaataattaagaatcggaaaatgtaagaaccccaaataccatagaaaagtgattcttcttgttcttttaacgttggtaatacacgtgtctgagccgctaacacaacagcattatcaactgacagtaaacattcaatcataaccaacgaaaagatgattaaccaatcctgccctgatgtaacgactgttgcccagttatgtggatcaaaaaatggtccatacaacttctctaaaagtgacaattaatgtcctcccttaatttaaatttgctttttagctaagttatattttaccaaataattttcaaaatacgacggtaatggcgcactaatatttaaagatttcattacgaagggtaatatgagtttttgcgctacaccatgaagcagcatcccctctgttgataaaggattataaagcggatcgccaacaatcggatgaccgctatgtgccaaatgaaccctgagttggtgtgtacggccagtcactaaatgaagtctcaccaaggaacgttcgtgattacttgccagtgtttcataataggtcaaggccggctgcgcgttttgtccgtttacttgatgaagatggggattcactggattacgcccaattgcccaatcgaactttccactctgagccatcttaccctccactaacgccaaatattgtcggtgaatttgcccatcactaattaatcggttaaggattgggacaacaattggattcttagcaacaattactgctccactcgtttgtaaatctatccgatgaaccatataagcattattttgactatgcgctaaatagcctgcaacatcgttcattaacgttcctgtttcaccatggtaattagggtgagttttttgtccccgcggtttatttactactaacaaatcgcgattctcatagaggacctctaagtgtgattgtgaagacggaatataatcatttgcggcaggggtccgaatttcatcaccacaaaatagcaactgaatattatcatttcttcccaccagttcattcattgaccgatattcaccattaacaagcactgtccgcctaattcgtaaatagtggattagacgattaggaagcagccattgatcatgcagtaatttgcgtaatggttttgtcacctggtcatcagctaacttttcactaatttgccaccgatatttcatcttactcacctctctttcgcctaaattctgataagattattttactgtatttcccagtaaatatttataatatttttaagccggtttacttttatccgataatagcgttgaatagagtatgagtaattttaaggggatgggtactgatgttaacaacagaacaaattaatgatcatagtaaatggataagtatattcgaacctctcccccatgagcgattagatttaattgaaaaatatgaggttactcaagaattacttgattatgcaattgacccttacgaaaaagcccgggttgaaattgatccagatgcaggagttacattattaattttcgatgtctatgtaccaactcatgctgtgactgctccacagactgcaccaattggcatcatgctcaccgctaataatatcattacttttacaaatgcaaaaactaactttgtaaatggaatcatcgctaatcagctacaattattaaagaaacacggggaaaatgacgacaaattaaacttagtgttcccagttctttatcgcctttcgactgattattttggtccccttcgtcgtgcagatcaacagcgacaagaaattcaacgaaatcttcaacgacgaacgggccgccaagccattactcaatttatggaaattgaaactggcctagtttatattcttacctcgctcaaagggaatgtttccctacttgaagaatttaaacgccgctttggtaaccacattactactaagcaatataatgatcttgacgatgtaattgtcgaagcacagcaagggctagaaatggcacagatgacttcagatgtttctgcccgtgtctctaatgcttatagcaaggttcttgatagtgatctaaaccaaacgatgaaatacctaaccatttattcaattgttctctcaatcccaacaattgtatctggcttttacggtgaaaacgtcaaactaccccttgcgaacgggacctattcatgggtttttacaattttcattactattgtcttaatgttggcatgtgtcatctttcttattaatcgtcattggtggaaataaaaatcggaagctgagaacttttttctcaagcttccgattttttataagttatcgccacgttcaaattgaaatttagaattcaacaacgcttcatgtaaaagctggttaatcaatttatgtgtttcattcagaacatgattagcggttttcatattttgttcagttaggtagttaattaaattagctgaattttgaatctgggctgtttttgtaattgtgtctactcgtcctacgccatagctttgacaccgatcacggaaatcatttacctcattgataaattcatgatagtgtggttctacaatcacttctaacaatttatttaaccaataagcactcttatccggctgcgcatcatctgtcgcatacttatattttgccggagtatcactaatatttgtaaagaacggaacataagggctatagcaataaaagccaaaattaatccattgaatagcagcatattgtgccggtacgtcattccgaatttgcaaaatacatgaactttgattacgatcaagtgcaattgaacggaattttcgctgttcctccggtgttccagacgcataggttcccattggatcataaggagtgccattataatgcgatgagaggaaatactctacatcctcaacagcaattttcttttctgcatgttgaataaacggaattttttggctagtaggctcctgttttaaagatggggtaaagagtttttgaccataccaagaacgaggtgtgttgtagtaagcatccgcctcatcttgtgtgccaaaaatattccggaaattaaacgttcgtgaattagggtttaaatgatatttttctacaaaatctttaatttgcggcgcatacataaagctatcgtgatcattaaagtcgacttcttcaatgcacataatatttggtgcaattgcataagcatcatcaggaatccgctgggcaacccattgatggccaccaccggtctcaaaataccaaacttcatccttatcgctaaaggcaattccattactctcaccggtaccgtatttttcaattagggaaccaagacgttgaactccttcgcgggcggacttaataaatggtaggacgagataaaccattgaatcttcattaatcccgttttctactaacggatcatgaccaagcaccctggcatttgtcatctcggtttctgtcgcgctcatcgcaacattatattcattaatgccttgttcatcccagcgtccttcatcaggcatgccattgggagttgccgtataacggcatccctgtcccttcatctcaacagttaacccattatattttgaaacataatgttcaccggtgtaatccttggcaggaaatactttgaatatcttaggattgactccatcttctgcatcctcatcacgtgcaataattgttgaaccatcaatcgtcgcattctttccaacaagcattgccgtacaactactcattagcttttgcatagtatacgcttccttccacagtagttactgtaccttctaataataccactatctggaattaactggattataaagaaaaagctgaacgttaatcacacaagccaatctaaaatatcattaataccgaacaaaccattgaaaatgttcggtattagtgctaggataactacatcaaataaatagcctatataataccgaaatatggtcggttagtctctacctaaagccgtaaactttagactataagcacttcttaaaaactgacactgtctgtttttaactttaagcttttaaaaatcggtagagaggctgaattttcagtctcttatttttatttaggcgtgttaatttttggggaggtatattttgaaagaacctgtttcatctattcaagcacctagtcgtcacactaaaatcgatttcactcgtcaatggcaaaattttgtccttggtttccagcacttacttgcaatgtattctggggacgttcttgttccgctattaattggacattacttacatttctccacgcttcaaatgacttatctagtctcaatcgatattttcatgtgtggtgtcgcaaccctcttacaattaaagcgaacaccattaactggaatcggcttgcctgttgtcctcggttgcgcagttcaagctgttactcccctcgaaacaattggtggaaagctaggaatcacttatatgtatggggccattattgcagccgggatctttgttttcctaattgctggcttttttgcccgcttaaaaaagttttttccaccggtcgttactggatctttaataactattattggatttacccttgttccagtaggtttccaagacctaggaggaggtacgccaactgctgcttcatttggtgatcccgctaacctccttatcggctttctaacaattgccatcattctgttattcaatgcctttgctcgtggctttatgaaatcaatcgccattttactaggaattttaatttcttctttcattgcaggcgcattaggctttgtctctcttaaaccggttagtgaagctgcttggttccacgctccgcaattattcttctttggcgttccacgttttgatatgagtgccatgatcacaatgattcttgtttcgctcacgacaatgattgagtcaaccggtgttttctttgcccttagcgacattactggccgtcaattaacaaccaacgacttagaacgtggataccgcgctgaagggattgctgcaattttaggcggactttttaataccttcccttattctactttctctgaaaatgtgggtgttcttaaaatgtctggagtgaaaagtcgtcaacccgtttactatgccgcctttttactcttattgcttggtcttttacctaaagtcggcgctctcgcaacggttattccagaacctgtccttggtggtgcaatgattgtgatgtttgggatggtcggtgttcaaggagttcaaattctccataaagttgatttctctaacaatgccaaccttcttactgcatctgtttcaattggactaggattagggattaccatgtatccgcaactgttccagcatatgccaactgaatttcaaatcatcctgggtaacgggattgtcgtcaccagtctttcagccgttcttcttaatctgttatttaatcaccggtgggctaatcataattaattctcattcttttttaatttagttgttgacattcaaatctcagcacgatattataatttcaacaattatcgtttcagtagaaccttcgttgggcgtaagagagccggtggtgaggtgcgaaccggtcaggcgaagtgtttcgaattatcacgtgatctgaattgtccggccatattcagtgccgttaccacctgatatgagtgcgcataaaatcaagatgcgtaggtgggtggtaccgcgattaaaataatcgtcccgttgatacttttatcaacgggacttttttatttcttttctaaggaggaacaacgatgaagagtattcgtttcaaagaggccgcaaccctcttacttatcatgctaataattttagggactgccgtgattaggtttggcttgtcaccacagatccccgtcctatttgtcattgctttacttattttttgggttaagcttcgtggtgctagttgggacgagattcataagggtatccaagaaggaatcggtaccgcaatcatccccatctttatctttatccttattggcgcattaatcgctgtttggattcaagctggagtcatccctacaattatgattgtcggcttcaaactgattagcagtcaattttttgttccatcaacatttattgtctgctctttagtcggtctatccattggtagtggttttacaactatttcgacaatcggaattgccttatttggaatgggagttgcgcttaatgctaatcctgcgctggtagcgggtgcgatcatttcgggagccgtttttggtgataaaatgtcgccgctctctgattcaactaatcttgcctctgcaattgcaggtagtgaccttttcgcccatattaagaatatgatgtggtcaacgattccttcttttatcgtttcgctaattctattctggttctttggtaattccagttctcatatcagcaccggtaagatcgcccacacaatggctatccttaatcaacaatttatgatttcatggtgggccctactaccaatcgccttaatgtttatctgtgcatggcgtcatattccagctattccaaccttatttatcaatatcatcgttacagtagtcatgatctccttccaaaatccaggaatctctcttcaatccctcgctaaattaattagtgatggttttgttgctcataccagcgatgcaactgttaatacattgcttactcgtggtgggattagcaacatgatgggaacagtttccctgatcattgttaccctttcactgggaggaattttgatgaagtttaacattgttcagtcagcaatgaagccactcgttgatcatcttcacaagcctggcagtcttattactgttaccattctctcaggtattggcattaatctttttgttggggagcaatacctttccgttattcttccaggtaaggcatttaagggtgcatttgataaaatgggtctttcacctttagctcttagtcgtgtccttgaagatggcggaagtgttattaactacttaatcccatggggagttgccggctcattcgtcgcctcaacccttggtgtaccagtccttcacttcctaccattcgctttctttagtctgttttcaccagtcttctcaattttaagtggagttacggggattggtttgaagtggcaaaaaggaaagcaacacaatactacaaatgaaaatcaaataaaggaagcttaaaaaaaatctgggtttgagagtttctcttacccagacttttttattatcctgcaattaatacttctgttaccaataatccaccaccaaagattaaaacaaagacaactaccggccacacgaaccgcagccaatgagaatatcgcatatcaagcatttgcaaagttgccattactaatccagtcggtactaagaataacattgcatattgcccaaattgatatgcagtaacaaccgtatatcgtggaatatgaaccgtatcagctagtggagctaaaattggcattgctagcactgctaaaccagatgatgatggaacgataaagcctaagacaaagaataccaacatcatcacaataatgaaaaatgatccgttcatatgcgcaaccatttttgaagaagcatagagaattgtatcagaaatatagccatcattaagcactttattaattccccgtgccaaaccaataattaatgacacaccgactaagctagctgctccatcagaaaaagctgttgtggtcttatattcgcctaaaccttcttggtgcccgaaacatgttaaaaacataataataatatcaattgttaagaaagctgatgccatattaggaaaggcccatcctttggccattactccccaaatcataattgggaaagcacaagcaaataaaattaaaataattttcttttttaaagtaaaccgctgatctttttcttcgctagtagtcattccccacatttgatcaaatttgtcccggtcatcataggaataggagaactgtggattctgttgtactttgcgtgcataccaatgaaagtaaaataataaacaagtaactgcaataaccaagccaaaaattcgtcctgccattccttgcgtaaaagttgtcccagcagcatttgacgcaattacaactgaaaacggattaattactgaaaatgttgttccaagcgaacttgctaagaaaatagccccaacacaaacaattgaatcataacccatcgcaataaaaactggggctaagattggataaaaggcacccgcttcttcttcaatcccacatagggttccgccaagtgctagtaaaactgtcacgaggaacactaaaataaattctttccccttagttttggtagatagcgcggctagcccagattcaaaggctccacttgctttaacaacaccaatcaaaccacctaagactaagataaaaatcataatatcaactgattctatcgtaccatcgaccatactagagaaaatatcgctgaccgaagcaggatgctgttcaagccgcttataagttcccgatactgaaattggcttattgattgcaccagatttaaactggtcgacatcaatctgaatgtgcaatttatctaatgttgcctgtgttgccggataactaattttttctccagttggttgtgttacttggagatgatcattgacatatgctaacttagaataacttcccgctggaacaatccaagtaagcattactgcgatcactgtcagaaagaataaaattgtaaacgcgcctggcattttcagtttgaaccgatgtcttttctctgctgttgcttctcccatcttcctcactcctcaagtcttctttctcccttctgttaattttagcaagcgttttcttgtttcttgatataatcttttatttgttgtgctttaaccaaagtggttgaaaaattatcattcataatctgtctcctaatctactcggtttattacgattagccaaaagtcatccataagtttcactatttgaaattttttattatttatactaaaaatactccatgcattcaagcacagagtattcatctttacttattatattcaacaatttccatatcattatcggtcaacgttgcgcgcgtcaggcttccatttgctgggcgctctgtcacatcatactttccatgaccaaaccgttctactaaacttaaaacggtatttccatgacttacccataaaacatttgcattatcaggtaaatcagcattccgaattaattcaatacctttgttcattcgttgccagtactcttcattattttcggcatcatgaaatggatcagcatcctttaaccagtctttggcttgaccaatggaatatgcggttacaatttcacggaagttcttaaagccatgaggggcacccgcattgtaccaagcaagatccatatttgttccttcatatgatccataaaactcttcccgaaaataaggagcagtgactggatgagctacagaattagcattattaagatttaagattacttgtgctgtttccattgctcgggaaaggtcactacaaaacgcaccatcgaagtgaatgttttgtaacttctccccagctacctttgcatcttctttgcccttcatagttaatggcgaattactccaaccctgtaatttgttgtaaatgttgaagaaagtctgtccatgacgaacaagataaatattcaatttagtcataacgatccctccataatcttattgtaccgcttacaaatccttaagactatttaagtattaactttgagctttaaacataatttcttcatattctccacgtagactaaaaaatatagaaggaaggaattattatgaaacttagagacactagtcaaccaaatattgttgccgctaagattattaaagttactccgaaaaatgttaccgtaattactgaagaaggccacttactcaagattccattaactaaacaatatcgggaagataaaactttacgggcatcattggttgatatcttgaaagcaggaatatggattccagtaaataaaaagctaaaaaaattatttagttatgactggctttttgttcctgccttggtcccagcaaagaattaagtttcttcaatgatttccataaaaagaatgttttgtagtaatctatgataaaataattcttgatttgtcgaaattgcacttcgataatatagaacaaaccatattgattgcgaggaacattcctaatgaaaaaattaagcaaatttgtggatactaggattggttttttcaccctcctagttatccttttttggttaaagaccctgtttgcttactttactgactttaagcttggcgttacgggaatttttcaataccttattttaatttttaacccattagcgaccaccttttttatttacagtttagcattctactttaagcgttcgcggttcttctacccagttattatgggtctagatatcgcaaacaccctattactctatttaaacgtcatctattatcgtgaatttaccgattttatgacaattgctacgatgaccggttattcaaaagttaatcaaggtttaagtggtagttcacttgccctcactaactttcatgatgtcttttactggttagatatcgtcgtaattcttattttaatgctctgtaaagttatcaaatttgatccacgagcaattggaacgcggttagcatttgcttttagctccgttggccttgtcttatttgggattaatttatcttttgcagaaatgagtcgcccacaattactctgccggacatttgatcgttcctacattgtgaaatatcttgggattgatacttttactggttatgatttagtgaagtcgcaacatatcaataatatgcgacaaagtgctactaaacctgagctcctaaaagttaagaagttcactgataagcactacgctccggccaatccacaaatgtatggaattgcaaagggtcgtaacgtgattattattcaccttgaaagtttccaacaatttttaattaacaagaagatcaatgggcaagaagttaccccattccttaactcgctttataacggtaaggatgcctactcgtttgataatttcttccatcaagtcggtcaaggtaagaccagtgacgcggaaaaccttttagagactagtacatttggattgccacaaggatctttatttgccacactagggagtgacaatactttccaaggtgctcctgcgattcttaatcaacgcgccggttacacgagcgcagtcttccacggaaacgttgctagtttctggaaccgcaataatgtatacaagaatttaggctatcagtacttctttgatgctagttattacgatacttctggagacaaggctaccggatatggacttaaagataagttattattcaaaaactcgatcaagtatcttcaaagtttacagcaaccattctacgctaaatatattactgttactaaccacttcccttacacgcttgatgatgaggataaagatccaaacttccaaacaactaataccggggacagtaacgtcgataattacttcgtaacagctcattatcttgatcaatcaatccaagaattctttaactatctccaaaagactggtcttgataagaaatcaatcattatgatttatggtgatcattatgggatttcaaacagtgaaaatacttccttagcaagtgttcttgggaagagtgcagatgattggactgactttgataatgctcagctgcaacgtgtaccactaatgtttgtcattcctggtacgggtcacggaaaagtttatcatacctatggtggagaagttgatgttcttccaactctccttcacttattaggaattagcagtaaacgctatattcaatttggaaccgatctcttctccagcaagcataatcaagtggttgccttccgtaatcgggattttgttacgccaacttatacgagtgtgggcggaacaatttacaataataagactgggaaagaagctaaacttaccaagaagcagcaagagaaattaaagaaggatcaagattttgtaaatgaggaattaactctttctgattcattaaatgaaaagaatctcttgcggttctaccatccaaaagggtttaaaaacgttaacccagctgattataattattcaaatggtctaaaacgagcgcagcgaatcgagaagaagaaaggaattaaatcaacaagtatttactcagaaaacggtgaccgttcaactgtagatgactacagcactgacgcccctgagcaaagccactcttccactgattccaaccgtattaagatcactaacccagatgctaataataagtagtaagggtacaaaatagtatagtagggtctaggagagcactgtgttctgcctaggctctattttttaagtttaagctaatttcaatcagctaaattttctctccattaataaaagtgatattattaacttgtacacaaagaataatggagggatttttatggttgaagaatttggctcaccgtcgtcttacatccaaggcaaaggtgtcctttttgaaagtgataagtatcttaaaaactttggcacaaaaccgttattactggctggcgaaaccgtctataaaattgtaggtaagcgttttgaacaatatcttcaagaaagtggttatgatgttacccgtgttcaatttaatggggaatcatccactaacgaagtaaaccgggtcacagaaattggtaaagaaaataatgtaaccgtcgtttatggtcttggtgggggtaaaacagttgataccgccaaagcaattgccgacaatctccatctacccgttgtaattatgccaacgttggcttcaaatgatgcaccttgttcacgtctctcagtaatttatactgatgacggtggatttgaccattatcgtttctacaaccaaaatcctgacttggtcttagttgatacacaagttatcgctaatggtcctgttcggatgttaatttctggaattgctgatgctttagctactaatattgaagcacaagcagttgccaaagctaatagcgatacaatgcttggtgaaaaacaaacccttgttggaaatgcaatcgctcagaagtgtgaagaaacattatttaattactcacacctagctgtagctgatgcagaagcgcatgtcgttacaccagcattttctaatatcgttgaagcaaatacactaatgagcggtctcggttttgaaagtggtggtctatctggtgcccacgctattcatgatggcttaacaattttagaagagactcatgatttaacacacggtgaaaaggtcgcatacggtaccttaacacaattaatgttggaaggcgctgaccaggaacgttataacaagtacttccaatttattctttctttaggtctaccaactactcttgctgatctacatttagaaaatgtcactgatgaagaattactcaatgctggaaaagccgcctgttcagaacaagataccatggatcgtttaccatttaaggtaacaccagatgacgtggctcaagcattacgagcagttgatgcatatactaagcaatatttaaatagtcaccattgtcatcatagccagatgtaataaaagggagcgagacagaagtcacttgtgacttcgtttttcgacgcgaagctagcctctgggagccccccgcaagcaacaataggcctctgacgttcggtttccggacgttagaggccattgttgtactgcgtatttgctttttatgaaagtaacttaacttatgtcacagtccctttttttgttatttaccctataagaaattaattaatgctttatcaacttgagtattattatgaagttttgaatgttgagtatcttttcctgttatttttagaacacggtatgactttgcccgagcagccactagatacttaagtgacaatgaagatacattatcaacagtaccgtctgaatgattaccaacatcaccaataatattaagaacagctacttgacctttcggataagtttgccgtacttctgtcatttgacgatatgtggcgttcatttcatttggttttccgtctttatttaatttcattccaactggttgctggatagcagcaggtacctgtttaaaattcaatccagcaaaatgacctgcgatatcaacctgtttttgtaattgaggcatattctgatttttaccgttttgcaacatatagtaaataatcgaaatatttcccaggaaatgaccaaccatattaatcttagttatgcgatatcgtttctgtaatgcttttacaacatttgtcgcatattcgccatgcttattaaaatccaactgcctattattatcataattcacctcaacaattggattaatgacccctttatgcattgaaccatgaagagtaacttttccgttattagtaacatcagctcgcaggactatgctcgttaccccggcttttttagcagcatttaccatgtgttcttctgcatgataactactacctccaccacggaaaaatagtgttggcgttgttgattgcatatatttactatgtttttgctgacgccaaactgcaccaccaattattgccaagataacaattactatcactacaccaatcccaatatggctttttttcataattttcacccgcttttttatttacctagattataagcctaagaacaataatgcagtcaaaaattactttaatgtagaagacgttgccaaaagtttccccgtcgaacatcattagcactatatagagagtaagttaatggttcaccatcaagcgtttctaattgatcactcgttatccttaagttgccaacacgttcacctttccagataggtgcttctagttttttctttttatattgtgttccaattgtataattcgtttttgtatcgtaaggactccaaatagttacatgttgtggcgtgagtttcattgttttttcaacaccattagctactttacgtgttgttactgatgatggaacttttattttttgtaaatggtcctctgtcttaaggatcttatataaatcctgcgtagccttaaatcggttgtctttattgctcccttttgaatgtaaaataacagtaataatgcgatgtccttgatacttacctgtacttgtaaaacaagctcccgcactgtcagaagtccccgtcttcaagccatcaatcgttaccccttttacagcgtactgttctcccggtaacatcttattaagattttttgcagtcttaacttgatcttttgctatttgaaattttacttctttttgtgctgtaatttgcaaaagttcaggataatgttttacaaagtattgcgataaaatggcaacatcacgtgcactcatcgtattagcagcattattagggagatccgctaacttaaaacttttcatatctccattatctaatccaaccgaattcacaatgtttgtcttagtcattccaatttttttggctttttgcatcattttaagattaaattcatcggttccatccccggtagctgttgcaagtgcgacagtcgccccatccgctgactttacaagggctgcattgattaatgtccgaactgaataagattgaccagattttagtccgattgaagaataagcagcatcattagaaatagccgcaatttcaggagttatttttacttgagtatcccatgaaagttgcttttgttggatttcatcttctattaccaaaatagttaataattttgtaattgatgccacgggaagagccttatctacattttgcttatagataatttgccctgttgaagcatcagccatgatcgctgcagaagcatcaattcgattatttgctaacactgattgacttcctaccattagcatcatgaatagagataaaataaaaactgtcaactttttcataaaatctattctcctattttcttcaagtacggtaagataaacttaataataaataataaaggaattcattatgaataaagaacttaaatcgctgcttttcatctcaactggtctattccttatttttgttctaatttttaatctttatacatataatgctgctagttttattccccaagctagcaaaacaagtcaaattcttagtcaaaatcggcttcgtgctcctaatattcaccgttcctctgaaaattgggcataccctaagatcggtaacgctcctattgaattgatcgccatcaaacaagcaaaaaggattctagttatcaactcaaataagcgccaagttatttacattattcacgcacagattaatctaccagcacaaaaaaattctttccgcttacttcacgctcgggggcagcaaatttatcatattaatggttcccagcaagccatcgctaagaattggttaggaattactaatgggaactacattgaaacccccgttacagatatgaataatcatcaggtctcacgaaatctacgaaaagcacccaaaattgaaaatactatccaggtgtcaatccccgatgctaaatggctgcaaactttacctgaaaacacacccttaatagttaaggaggactattaatatgatttcacgcctaaaacatggacggttttttaatcacttacttggaagtaatcttattttgctaattataattagcttttataatcttcttacatacttcatcccattaatcaaaatttcaatcattcaaataattttattctttctaataattgacctactcttgattatctttaagattttagcgctatacaattagccgacaatctcaatcttagtaccaactggcaaattcttttccatccattgagcgtctggcactgaaagccgaatacacccgtgagaaccctgtgtttttccaagcttagcagcttcttgttcattatattttccatctgctttagtcggaacactatggaacaagtattctccatgattcttccaagaaacgtagtaattagctccctctttcaacgattgattaaagaagctatctcctcgctcttgctgagcataaaatgttcctgtcggggtcacacttttcagtttaccagttttaggatcctttttataaattccacctgtgctatacattgtataaatgacttttgaaccatcatacaaatatgtccgattattttttaaatcaactttaatccaaaagtccttcactttattcaaatctggatacggaactgtttccgaggacttatgccaatcaattggggttcgcatatgactttcactattatcgattttcttttcttgtgttggtttttcttttacttgcgattcaactactgctttttggggatgggcattcgaagtagcacgtaattctggaccaattgcaattattgctactaataagcaaaatattccataaatccaatgcttcacttgtaagttcaaattaatttctcctttacagataattcaaaacatcactattataattatagggaattttttattcaatatactttaaaaaaggtgtacaaaatgcgggataatcttaaagtttcatacttaactgctatctttttctttattgttgctatcatttatgcaaatcttgcgtaataatcgtgaggattctactatgacatcatttttttcattcatatcaaatatttggtcgtataccatcaaccataaatggtcaaaggatattttacgagccaacatcctttttattcttttagttattgtttacgatctttttcacttttcattaaaaataattaattggcggatcttttttaaagtatttctgctattaaatatttgtttgttttttaagttccttttagatggtattgatcgctatttaagaacacggtaactttataaattctttattgagttatcaattttccgtgctaagataggaacgtaattatttattttcgatttgaggaaggtacaatgcattcatatattaaatactggatagcaggaataggagcattattaattataatgattgcggggatgactgttcaccagaaaaatcatttcaataaaaacgtaaccatcaataacattgccgtgggagggctaacagccaagcaagcttttgataaggtaaaggggacctcaggagcaaccaaggtatatgttgacaataagctagtttaccaaactaaatccatgaaggctaattttagcaataatgatgaacaaaaatttaatcaagcactgaaaaagcagtttacatttttcccatcacataaagcaacgaacttatcaataaagccagataactttgatcaagattcgtttaatattgcgaaaaacaaattaactaacgaggtacatcaactcaacacaagtcgtaaagctcccgttgatgcttacgcggtctaccaaaataagaaagtttctgtagttcctgcagttaagggtaataaatatgatttaccaaacgctgttaatcaactaaataatcaagccggaagtactaaaattaatattactttacataaggaacagccgattgctgcaaatagcaaaaccgttaagaacgaggaaaaacagttaaataagttaaaagggaagaaagttacttacctcgttcaaaatgaaaagtataacctcactaccaatcaaattattacccgggcaacctatcaaaacggcaagtatcatttcgacactacggccttaaataaacaagtaaagaaaatcaatgagaaacatgcaactcttgataagccatttaaatttagaactcattctggagcagaaattaccactacagctaatggttcctatggttggaaaattagcgagaaaaaagctggcaattcattaactaaagcaattatcgatggccgccaagaagttgatggcgagcacgatattgaaggaaaaggctataacactgctggactcggctacaatgttacatccaataatggtattggcgacacttatgctgaggtttcattagctgaccaacgagcttatttctacaaagatggtaaatgtgtccttgaaacagatatcgttagtgggactaataacgaaggcaacaaaacgccaaagggagtctggtatatcatgtaccaacaaagtccttccgttctccgtggacaaaacgatgacggatcaagttatgcaagtaaagttaattattggtcgccgtttactttaacgggatgtggcttccacgatgcaagttggcgtcacaattggtccaagactgcttacctaagcgatggttcgcacggctgtattaatatgcaaccaagcgtggctggccaagccttccatgatttaaaacaaaatgaacccgttattatttattaatactctagggagcgagacagaggtcacttgtgacttcgtttttcgacgcgaagctagcctctgggagcccccgccaagcaataataggcctctagcgttcggtttccggacgttagaggccattattgtactgcgtatttgctttttataaaagtaacttaacttatgtcacagtccctattattttaaaagaacgcctaaccggactgtggtgaaaaacttgcaagctaacttatttttttattctcttaattaatatatacgtaaaaatttccctttgcacctcataattctaaaatagtggtacagtaaaaataaaccttaggaggcttagattatgactgataaaattgttacttcagaagaaatgcgacattacgattcttacaccattaatacaatcggtatcccttcccttgtgttaatggaacgagctgcattagccgttcgtgatgaaatcttgcatgcttttccaatcgcgctaaaagatgtggtagtagttgccggtagtggaaataatggcggggatggaatagccattgctcggttgctgcatcttgctggtgtccatgtaacaatcctcaatataggtaatcctaaacatgcgtctgctgaacaccaaacacaagaaaaaatcgcgcaatattatcaaattcccgaaacctctgatctcgctgtccttaataaggcaacattaattgtcgatgcaatgtttggaatcggaatcgatcgtgcagtaaaaggagcttataccgacgcaattaacgccattaataacactgatgcagttgtcgttgcagtagatatgccatcaggaattaatactgatactggagaggtaatggggactgccgtcagagctactacaaccgtaactttcgcctataataaagttggcttaaccaagaatgccggaaaagattacgcaggaaatattgtcgtcgcaaatgatatgggaacctatgcagtagactgattggaatattatttaccgagccgttttactattaatcgctgaatattaatattattataataagtaacgaacgtttcagtgaactaatttggaggtaaataatatgtcagaattaacaaccaaattatttatagacctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccaattatttatagatgttaaaaattttgaaaaataccaatcaatgttaaagtgccaagtacacattgaagaagaacgtcatggtgattattgcttaccgggttttcctgatcgtcacaatttccaccgccttctccggattttacgtaaacatgatgacggtttaactagcaaacaactaatttatgacttcgattaccggccaagtgacctcgaagatgctactaaagcattagtaacaaacaatttgtcaactactaccccaattaacgaggaagactacaaaattcaacttaacactgaaggtatcgaagttgctgataatctgctaaagcgccgtgacaaaattgctgaagctgcttaccacacattaagtgaaaatgaacaacgagaattagaccgtcttgtaaacaagctaatagaggattatgcaaaccgcgacgtaaattacaacgcccttggaaatatttgccgttaaaatataatatcctattcaaaaaaggcagaggctaagagaatttttttctatgatcccttagtttctgcctttttagtagcgacaagtcttattaagaaagtactttcccgctcactttcaatttagttattttaaatattctgctggatttgctacaaaatcgctaattttaatagttgttgcatccttagtagcagcattctttaattggaaagttccttcttcaacttcacgagcgccaaacactgcaaagtacttcgcattacgacggaaagcttctttgatctgcttaccaacttttaccccactgtaatctttgtcagccacaatcccttgctgacgaattttactgaggacttcaaatgccatttcatccccttgctgatctgcactagcaaagaagacatctagttggtcttgaggagcaaatgcaggattttcttcttggagtaagagcattaatcgttcaacacccattccgaagccaattccaccttcttcagggccaccaagttggctaatcaacccattataacggcctcctgcacaaacagtcgtgtacccaccaccaaatactggtgagtctgacataatttcaaaaatagtatggttatagtaatctagaccccgcaccatattggtatcaatttcaaaatcaattcctaatttatttaataaggcctgcacttcgtcaaagtaagcttgtgactcttcatcaagataatcaaggattgatggagcttctgcaacaatcttcttatcgccttcatctttactatcaagtacacgcaatggattcttatataaacgttcctgagagtctttactcaattcatcatagtgaggcttcaagtaattaattaatgcttcacggtaatcttcacgaacttttttatccccaagagtattaataaccaatttaacatttggcactccaaactttttaaagagcgccattgccattgaaataacttccacatcaatctgtggtgactcattgtttaatgcctcaaccccaatttggtggaattcacgttgccgccctgattgtggacgttcataccgaaacattggccccatgtaataaactttataaggtttaggatattctggaccatagagcttattttctacataagcccgtactactccagctgttccctcaggacgcaatgcaatatgacgatcacctttatcatgaaaatcgtacatttctttttcaacaatatctgaagtatcgcccacattccgtgaaaaaacatggtaatcttcaaacatcggtgttcgaattccgcgatatccaaactggttaaaaacttcgcgcgcattttgttctactttttcccaaatacttgtagttcctggtaagatatctgcagttccctttggcttttgataatccattaactgtgtttcccctttcgttacgtataaaaacaaaagccctctaagaccttaacagccttagagggcgatattcatcactgttccacctctatttcacagtaacctcacagtcactgcctcatggagttgcgttaactcctgatgataacggaatcaccggaacagactactaaaattcatcctttcagctagtagaggtggatcatgtctgctcccagctctcaactcaactggatctctgtcaattacacaggcactttgtttctacgtcaatgcttttataatacattagtgattttaccatagcttacagattttgggtatcatttatctaaattaagccgccgttgaactcggtgtaaataccataaataaagacagataataatcagagtaccggtcattagacaaaagactgaaataaataaaaattgataacttcctttttcaatgacaaatccaccgtacaatggaccaatcgcacgtccaaccgacatcataatattaagcaatccttggtaatgcccagcttcgtcgacattagtcagttgagcaatccaagcaggtaggccagcaaaactagtcatttcaccaattgttaagattacaaaatcaataacaaatgctgtcaaagtccgagcaaaaattaacaggaggaaagatagggcaaaaataaagattcccacaataatttgcgttgataaacgaacatagggacttaacttattaacaagtggttgtccgataataattagcaccccattcaatgtccataacatactataggcatagaatggaatccccatgtttgtcatatggactgccattacactttcccataaggaataacttaaatgaaccgtaatatagtttatgagaataaaccaaaccaagacgatccatcgcgaatgcaattggcgggaaacatgatagtgttcttggatctctgaattatttttaattgcatctacagccacattaaatgttaaaacaactactagcattaacaaggcataaaagattgttgctacagcaaaaactaccactacactaatcggtaaaagaacacccaccagcaacgttccaatcacaactccgatattaaaggccatataaatataattaaagacataacgggaagaatgatcactgaccaacgtcccataagaattaacaatcgtggcattgattccatccccaaagctgttaattgtaattaggacagcataccatggccaatcatgaataaagatcaataagaatattgctagtgttgagaggctaactcctaaaatagctgtttgatattgtttccaatggtcaaataaccaccctcccaaataatttcccatcatcatggcaatggacattattaacatcacaaagccagcagtcgtcagagtttggccaaggtaattatgaagatacatagttgtaagcggccataaaaaagctgcccctgtgttgtttaacagacttgcaagggcaacccattttaattttaccgtttgctgttccattttaacgttcagataccatatcagaggaaggtacacgtaaaagcgtataggttacagcactatgatttgcttttaaccctaaaccattaatagcagtatttttatactttacatccattaccgctgcaaaagcatggcctgttttggcatcctctttttccaattgctttttatcccatggcaaagcactcgcatctaaggtaactatccgcgatccatcagcaaccgatccataccgtgaatttgttgtatatttatcatttccagcccagtacgtatacgacacaattgggtgcttgccgcttttactacgcgtcgctaaaacataatagaaatcatctgacttatttcccatttgaagtggacgataagtgattgaagtctgtgtttgttgatgattattaatgtcaactggacggaaaaatgtgagatatgacatccccccgagccaacataacgagacaactaataagatcacataacgaatcactaaatttaatttaaatactttttttgtcttcgcaatcagcattaattgtttaacacggatatagtggattacataacaaaaaaaggcaattgcacatatccacgatagccatcctagccaattccaactcataattttcaatactccattctctaaattatttactatgattatcacacaaattgattcacttgtcgttaaatcttaataacaaacaaataaatttaataaaataactacaaggataagttcaaactgtgctaaactaatttttggtaacaaactgtgtcttgatttagaataagagataaggttagtattatttaataatatacctactaaggaggaatgttttcatggacaatttgagtgagcttgctcaaggattgattaactttgagcgcgaaaatgacttaaatgataatgaagttgctttcggcagtcatttatctgttgaacgaattcacgaaattaaatcatccaatactccagtaacttcagaagaagtcgaattgcttcaacggttcatgcaaagtaagtaacattaccattcataccattgtagcaaaatcaaagctaaatattttctaaagcagaactaataatatttctctgctctaatctaaaaaggacctagaagaaaacattactttcttctaggtcctttttctgcttattttggttgataaaattcaaccggaacaagtttagtttctatcttttcatgaggtgtttctattcgcttcattaaggtttcaattaattcttgtgccaacaatggaattggttggattactgttggaagataaggcgctacttttcgaattaattgcgagccatcataacctgtaataaaaaagtctttatttatttgctttcctgcttggtagtaaagattgctaatcgttaatgcttgaacatcattagaagccagcaccccatcataattaccaggaaacgtagcctcaagatccaaatgttgaatagctaaaggttcaaaatctcgtttctgtttattcaaaaaatcaagtgccccttgaatccgattgatggtaggtgaaacagatgtatcttcatccacaattaccgccaagtgttttacatcatgttctaccaaatacttcgctgctaattcacccccgtggtaactatcagctgcaacaattgggatattatcggcaagatatctgtcaaaagaaacaatgggagcagtaagttggtgatattcctctatccccagattatgagaacccgaaataatcccatctacttgatttgccatcaacatatttaagtattcatgctctatttccggattttgtgccgatgatgcaataattgttttataaccctttttaaataactcatgttcaagctcatttgctaattctgcaaaaaatggattaattaaattaggaaaaattaagccaacaaacttagatggtttcccttgcatcgcccgtgccaaggcatttggttggtaattcaactctcgcatcgccgcatggaccttatcaatcgtcttttgacttaaagaaccataattatttattactcttgaaacagtagttactgagacccccgctaattgagcaacatcttttaacttagcaaccattctaaaactccttgattaatttcgtttaagttattccattattatagctcaccacatttgaacaatcgacggttactttaaatataattttaatcgctattttcacaaaaatgtgttctattacatatgtttaatttatcatttatctaaaaatatttttcatttgataaaacatgttttgtgaagatgataattattgattttatgatattttctccccagttttaaaggatttcacttgttttttaccttcaaattaaattgacgctaaagagaattaatgctagtttataggtagttgaatctttagaacttcttaaactttttgacctttttgatattattttaatttatgaaataattaataagccacttttaggagtaatgtttaggaatttcaaatataacttaaggagtccctgccaatgaatcgtcaatctaataatgatccatcaacccattttaaaatgtacaaaagcggaaaaaaatgggtcttcgctggattaactgctgttaccttattaactgctagcggcgctgttgctcatgctgatgatgcttcagtttcttctgcagagcctgccgccgctactactgccaatacacaaaataatacaaatagtaccgctgattcttctgctgccactcaaagtacatcaaacagcgcctcaacaggaaatagtgctacttctaatgccagtcaaactgttgccagccaaaccgcagctgattcagctttagcacaatctgctgaagctaaacaagctgctcctgctgctccaaaggctgctagtgccgttgctacatcacaagagaactcaataacagatttaagcgccctccatttcagtaataacgcttcacaacaagcattcatccaaagtgttgctcctggtgcaatccaaggatggaatgaatacaaagttctcccttcaattacagttgctcaggctatcgttgaaagtggttggggccattcggccttatcaacccaggcccataacttatttggaattaagggttcctataatggaaattcagttgtaatgcgtacacgggaagtttatggtggccggagcgtttacgttaacgccaatttccggtcctacgctaacaactccgaatcagttactgatcatggtcgctttctcaacgtaaatagtcgttaccgtaacttacttggcgatactaactatgcatctgttgcaaataagcttcggcaagacggctatgctaccgatccaagctatgctagtaccttaattcgttttgttcagacatataacttaaatcagttagatgccgttgccctttctgggaaagttgttacgaataagcaaactgaaagtgctcaaactcccgaaactaatgtaactgtttcaaacactggatactacacggttagaggcggagacaccttatcacgcattgccggacagtttaatacaactgtaaataaactcgccaccttaaatgatatccacaatgttaaccgtatttatgttggtcaacggctcttggttcgtcaacctgctgaacaacaacagcaacaaacaacccctaagcgaactgaaaccaatactaccactaatagtaatacatacaccgttaaaagtggcgataccctttcaggaattgctggtaaatttaacaccacttatactcaattagctcagcttaatcatattagtaaccctaatgtgattcatgtagggcaagtattaacgcttcatcaaactacagctcaaaatactactaaccatcaagaaagccagcaaaataaacaagttactactagtgctaatggcacctacaccgttaaaagtggcgataccctttcacaaattgctgctcgttttaataccacaacatctgcattagcttcaactaaccatattagtaaccctaatttaattgaagttggtcaacaattacggattaacaatagtgctagtgctcaaaaaaccacttcacgccactccaatactaacaatggaaattacgtagtccaaagtggtgattcattatcaaagattgccgcttatcatggcttaaactggcgatcaattgcagctaaaaataacattcaaagtccatacacaatctttgttggacaacatttatcactttagtcaaataaccattaaattattatatgatataaagcaagaagtataagaaaatctatgcttcttgcttttttgttttaaaaaaattcttttctgttctagaataaaggtaggcagtttattattaatattcactaaattactattagggagtttatagaaagtatgtgatatttattgtggtagaccgttggacaacagatattccaaatgttaataaaatcagtcaattatttaaattactagggaatcctaaaagattacaattattatatttgctgattcaacattcaatgagcgtttcagaaattagtatgaagttgaactgggaacaatcgggggtttctcaccagctgcaactattgagaaaatataatttagttcaataacggcgagaggggaaaaccgttatctatcatttagaggatccgcaggtaatgaccttgatcgctgatgtattaagtcatgcagaaaaaatcatccaataatttagtgaatattctttgggatccccccattgaaataaaagaaaggcgtttagaactcatcctaagtcaaacttagacgatgacttctaaacgtcttttcgttagttaataaacttaatttctaatcgttcatcttccaaaactccttttacaatcaatgacttaccatcataaaactgatgcttatctaaccaaaatccaagatgggcgtgactataaaacttaaaactataccgcattgcattattcagtttactaacctgcaacacaccttgtgagccatcggaacaagtaatattttgtgattgattattattatgaacataaattgttgtcattcttctcacctccgtttttattatatctcaattttggactaccaaaaatatttttaagcaaaacaaaaaagcaacaacttcagctataggaaagttgttgcttttaaactaatctgcagctaatgcatcgattggattaaggtttgccgcccgacgtgcaggaagcaatgcggcaataaacgaaattacaatcgcaattacgattgcaaagattacatttccaacagtaatttgtacaatattatatttaatcaagccatataaagcgtggttaataataaccgttacaactgcaacaattagcagtgcgagaattgcggaaaacagtccaataaagacggattcagacgtaaataatcggcgaatatctttttttcgctcacctagggctctcaaaataccgatttcctttgtccgttccgaaactgacatgtacattgtcacaataatcattaatgcagacacaagtaatgaaattccagcaattgaagcaagaaccgtggaagcaagactaacataagtattaatggttttaaggattgacccgactgtaatcgctcctaatatccgtttgttattactaccacgaagattatcgatcttattcgccactccttgaacactgtcaagatttgttacattaacggttgcaaagttagcagcagtagaggcattcgctttttgaagcagcgcacgcatagtggaataagtaattgaagttccagcactcgcgccttctgtaatccctgccaccttgaagtttccagaaacgggaactggattattattggcatctatccatgtaaaggagagacggatagttttaccaaccatttgcttataatttttagcacttgataattggattgcttgttgctttgtaagaacgatttcaccattcttgggtttatgcccctgtttaattgaatcactagtaattgccttactcgaggtacttagtgaagtcccactttgcttttttccattataatcaagctgaaaggcgctcaccataattcccggctggacagacgacacattatcaagctttcgtaaccggtcaatattatggtcactaatcgtcattgattgaggattagccgccatcgtttgtcctaacgatgattgaatttgttcctgggtcatctttttaccagttgtgtttttaaatacggtaattgcctgcggattagcaagagaattaatctgattttgaatgtacccatttatcccattacctaaaccactaaacaagagtacggcaaagataccgattgcagttccaagcataattaacgaattacgccaaaagttataggtcaaatgtttaaaagccgttcggtagctcgccatcgccggtaaaactcgtggagtaatctctgttgggtcttctggaatcggataagcaggacgcaatctttcatcgccgtcaatttttccatcagctaaatgaacaattcgtgtcccattatccgctacttcctgggagtgagtaacagcgatcactagtttcccatcacgagcaatttcgtctaataatgctaatacttctttggtattctgtgcatctaaggctcctgtaggttcatcagcaataataatttgcgggtcacttgctaatgctcgggcaattgctacccgttgcttttgacctcctgacaaatggttcggatgcttttttacttgttcacttaaaccaaccttatctaagagttccaacgcgcgctttcgccggtcttccttagtcaacgttgtcatatccaacgcaaccaaaacattatccagcaccgtcaagtgagaaattaagttataggactgatagatataacccaccgtcgcgcgccgatagctatctagttgcttttcttttttatgatcgaggattttaccatttacgaggacttcaccttcaaagttacgatcaaggcccccaatgatattcattaaagtggactttccaccacctgattcaccaaggatggatacaaattctccccgatcaaactgtaagtcaattcccttaagaactgggaattcctctttgtcaagataatatgatttatatatgttttttaattctaaaaaagccattgcatcctcccctttactatttatttagtctgtttattatagcaaggttcgttatgaaaaaggtttttcgctcataattctttaacattatttatattattggtctggagaatttttacttaatgtaagtttcccatcagctaactcgtaaacattatctgcatattcacgcaaacgtaaatcatgggttacagcaatcactgcttttccttcctttttagccagatcttgaaataattgccccactgtctttactaaattactatctaaggccgctgttggttcatctgcaagaattatctcgggattggtataaagggcacgtgcaatcgctacccgctggttttgacctcctgacaattcagaaggatattgcttgagcagcttctttattgcaagcttttccaataattcatcaaaagcttctgatgagacgttcccattcttctttatgcgatcaacaagcttaaattgatccgccacatttagatagggtaataggttatacgactgaagaataaaaccaatcttctgtaagcgtagttcatcacgttttttagaagataatttctcaatatcaattccatcaattaatacttttcctgaagtaggtgtttgcaaaccgcccgcaatcgttagaaaggtactctttcctgatccagaaggtcctaaaattaaatttagttctcccgctttagcagaaaaactaacatccttaagaacatggacacggctaattccttcgccataatatttgttaacgtctactaacttcaattttgacataacatttgcctcctcaccttaatttaaggcctgtactggatcaatcttaataatcattcggactggtaataacgaaccaatcattccaagaactattaatcccactgccattaaactaattagtggccaattcataataactggtaccgacattggaatcgctacacttgtaataagggttaaaagaatcccgccaattactccacaaaccattaggaagattgattgagtaactgtcgcaataattagatgacgagcaggaattccttgagcgcgcataactgcataatgacttattttttgcatggtaagaatatataagaagaccgcaattacaattaacgaaattaccattaagaagccaatcataaaagtaaacgtattattttgcgctgaatatcccggtagcttattaatatattcgttaacagtgtagtgttggagatcagggtaggtatttttactaagcttattgtcagaaaagagtccgctagcaacggctgaactatttaatcctctcagttcccgccaaactggcaaactaccatatataacgggggcaacgctaaatttagcatcattaacaaagccaacaattttatatttctcattttgagaattgattgttactcgatcccctaaatgatacccctttttgcttaaactcttgtcaacaacaatttcgttatttcccttagcttgacggccacttgtaatcttaatcttttcccgggaaataaattggtcaggatctaaaccgataaattgagcactttctttacttgctcctttttctttaagaactactggtgcctgaccaacaagagcaacattcttttgatctttaccagatagttggtcacgagtaataattgattgtccaagattatcattactatttttatttagaaaaacagtttccgtaccccactctttaatggcggcatcattttcattttggagtcccaacatcatccccattaggaaaaacattaggtaactaattaaaacaatcatggcaacaattaatccataatgcagcttttcatgtttcatttcttttagtgctaaaaacatattataacctcctactgcaacaatgcagtcagtgccttggagagccgttcaattgcttcattttgtttatcaggttgaagaaggcaatccttaatcgtttcatgactcaaaaccattacactccattcttgagcactatgaatcttaatttgcggctgcgtattatcacgtaacaatccttcatttgtttgaaagtgcaaacgcataaaatcacggtacttacttccgttgatctcatcaacaaaagctttaatctgattaacataatcactcgcagctaaaatatggtttgcacgggtaattggtgtatgaatttctaaaattgccacttgataaagatactgatatgcctccgttaaatctgtaaaatatttataaaatgctcctctggcgattcctgcttgttttacaatccgtgcaacttgtgcacttgctaagctatgttgactaaattctgttagtaatgcattagtaataagttcttttttctgtagatttaaattttcaaatgttgtacttggcatcttaattcctccaccgcatcgtgacaccgtgtcactatgaatttattttatattatcgccaaagtgacaccatgtcaattactagataaaaaaagcgaggcgaaaaattttttgcctcgtttttaatatatttaaatttttatcttaatctagaattaagcttcttcgccgccaaccttaacaacagcttttgaaaccttacctaatttaccactaacaaagtcttcaacaccatcaaggtctaattcgtgtgagaagagtggtagtgggtcaacaacaccagaagaaagaagtgcaattgagtcttcaaaagtgtaagggttaatgaaggccccttgaattgtaagttgtttttggaatacatcgtaagtgtttactgagaacttgtcatcagggttaccaacaccaaacattaatacttgagcaccacgagctgcagctgcaagtgcttgttcttgagtagctggcaaaccaaccgcttcaacaacgatgtcatatgcatcagcaggaatttcttccttagtagtgttgatagtcttaacgccgaagtgcttccggttgttttccaacttttcatctgaacgaccagctaaagtaacttcgtgaataccacgagccttcaagatttgtgcaaataattgaccttcaaaaccatcacctaatactaaagccttttggtatgggtgagtttcaagtaagtcaacaccgtgcattgcacatgaaattggttcaacaacggcagctgcctttaatgaaacatcatcaggaattgggtaaacaacttttgcaggagcagtaaagtattcttcaaaaccaccgttacgggtaacaccaacagcatcaaggtgttcacataattctgggcgttgagtccgacaatacttacattgaccacagtagatgttagggtcaacggttacacgatcacctggcttaacgttagtaacttctgaaccaacttttgtaactacccctgagttttcatgacctaaaacgataggaggaacagctgatgcagatcccggaagaccggcatagagcgctttatcagtaccacaaataccagcgtaggcagtatgaattaagacttcatcaggcttaatttcaggttctttaatatcttcaatttcgagttgttttttacctgttaaaacaagtgccttcataattaaaatacctctcttgtgaattttatcatttgtcaagtgatagtatagtgtgaaaacgccttaattgtcaaacgtccaacaattatctcacattcttttcgccatcataaaacgttaaactcagcaaatccgaacctaaataaatcccggtatagaagcattttctaaaaaagtgcaatttttaaatatttttttcttcactaagtttatgctatttttttgttatcacataaatggttttactttcattttttaaattacataatttcacaaggctttttatcctatttagcgttttacatcaagaaataaaatgtttctacatataaagtaataaattctaaatttatatagaaaatttctccaactttcagaaagcgcttaactaccattaggcacgccaaaacttatctccaaccgctcctcaaaatcgcccaaatggccgttataacggctattttccattgcaggatatatttttttatgttaccctaacaaagtattcgaacttagttaattatgatttccaatctaattaacaaaactcaaacgaaaggtggatttggcgtggacgacacaaagaatcaacaccggaagcataaacttattgaatatgctaacggtaaatcactagaggaaatcaacggaacagttgaagttcctcgtggaaaaggcttctggcgaacattattcgcttactctggtcccggtgcattagttgctgtgggttacatggatccaggtaactggtcaacttcaattactggtggacagagtttccaatataccttaatgactactatcttgatttcaagtttgattgcgatgttgcttcaatacatggcggctaaactcggaatcgtgagccaaatggaccttgctcaggcaacacgggcacgtaccggtaaagcattaggtattatcttatggattatgactgagttggcgattatggctactgatatcgctgaagttatcggggctgctattgctttaaacttactgttccacattccgttgatcccatctgtatttattactgttcttgatgttttagtactgctattattaaccaagatcggattccggaagattgaagcaattgttgcatgtttgatcttggtaatcttgtttgtttttgcttaccaagttgccttatctaaccctaactggggtggcgtatttatgggtctccttccatcagctaaggcaattgcccaacatccagaaattagtggtattactccattaactggatcattaggtattatcggtgcgactgttatgcctcacaacctatatctccactcagcaatttctcaaactcggaagattgaccacaatgatcttgatagcattcgtcaaactgttcgttttactacttgggattcaaatatccaattatccttagcatttattgttaacgcccttcttttaatcatgggggttgctgttttcaagactggtgctgttcaagatagttctttcttcggtttatatgatgccctgaataacacttctatgcttagtaatccaatcttaattgcggttgctaaatctggtgtattgtcaactttatttgcagttgctttacttgcctctggtcaaaattcaactattactggaacattaaccggtcaagttatcatggaaggtttcattcatatgcggatgcctttatgggcacgacggttagttacccggattatttccgttattccagttattgcttgtgttgctatgacgagtggtgagaataccatccaacaacacaccgccttgaaccttttaatggaaaattcacaggtattcttagcttttgcccttccattctcaatgttgccattattaatgatgactaacagtgaggttgaaatgggtgaatttaagaatagtggctgggttaaggcttgcggttggatctctgtaattgcccttaccttcttaaatctctacaaccttcctgcaacttatgaaggttttggtatttgggcaaaagggacatccgatgttctcgcatatatcacgattattgtcattcttgctcttcttatctggacttgtgttgaactctacaaaggggataagcgctttgctgctgaaggtaaaggattcggacaacgtgaagctcaaatgaaagattcagctgtagaagattaaaataaaaacctggaagcaatgctcatgtacggtaaagaagcaagcaaccgaaaacaatagatagaccgccagcactacactattccgaaccaaagaccaaaagataagcattttgagaaaatctaaacttttggattttcctacaatgccgactacggcggaatccctcccactccttatatatttctttctgtatacattaaatttgtatttagtaaaatgcagacaacaccacggatcggcttttggctggacaattccaaccaaacaccgcagcagacagtagaaaccattctgaacgttaggaagccggtatgattgttacatataaggggaagaaaaatttcttttagatacttgttttcctaaaactgatgtgatataataattcaattccagaaaaggagtaaaaaatatgcggcaagttattcttaaataaaactataatcaaatagtgggaacaaaggattatgatagtcccttttgtaggggcttagttttttgtacccaatttaagaatacttttgccttatcaattttgacatatccccaaaaacagcactcacaaacaggtgtatgctgtatatgtgtatgtccgcaaattatcatccccagtggtaaaagtattttactgctggggatttttatgcccttcggggcagtaaagggaggacaatcacatgaaaataatcaatattggaattcttgcccatgtagacgctggaaagacgaccttgacggagagcctgctatatgccagcggagccatttcagaaccggggagcgtcaaaaaagggacaacgaggacggacaccatgtttttggagcggcagcgtgggattaccattcaagcggcagtcacttccttccagtggcacagatgtaaagtcaacattgtggatacgcccggccacatggattttttggcggaggtgtaccgctctttggctgttttagatggggccatcttggtgatctccgctaaagatggcgtgcaggcccagacccgtattctgttccatgccctgcggaaaatgaacattcccaccgttatctttatcaacaagatcgaccaggctggcgttgatttgcagagcgtggttcagtctgttcgggataagctctccgccgatattatcatcaagcagacggtgtcgctgtccccggaaatagtcctggaggaaaataccgacatagaagcatgggatgcggtcatcgaaaataacgataaattattggaaaagtatatcgcaggagaaccaatcagccgggaaaaacttgtgcgggaggaacagcggcgggttcaagacgcctccctgttcccggtctattatggcagcgccaaaaagggccttggcattcaaccgttgatggatgcggtgacagggctgttccaaccgattggggaacaggggagcgccgccctatgcggcagcgttttcaaggtggagtatacagattgcggccagcggcgtgtctatctacggctatacagcggaacgctgcgcctgcgggatacggtggccctggccgggagagaaaagctgaaaatcacagagatgcgtattccatccaaaggggaaattgttcggacagacaccgcttatccgggtgaaattgttatccttcccagcgacagcgtgaggttaaacgatgtattaggggacccaacccggctccctcgtaaaaggtggcgtgaggaccccctccccatgctgcggacgtcgattgcgccgaaaacggcagcgcaaagagaacggctgctggacgctcttacgcaacttgcggatactgacccgcttttgcgctgcgaggtggattccatcacccatgagatcattctttcttttttgggccgggtgcagttggaggttgtttccgctttgctgtcggaaaaatacaagcttgaaacagtggtaaaggaacccaccgtcatttataaggagcggccgctcaaagcagccagccacaccatccatatcgaggtgccgcccaacccgttttgggcatccatcggactgtctgttacaccactcccgcttggctccggtgtacaatacgagagccgggtttcgctgggatacttgaaccagagttttcaaaacgctgtcagggatggtatccgttacgggctggagcagggcttgttcggctggaacgtaacggactgtaagatttgctttgaatacgggctttattacagtccggtcagcacgccggcggacttccgctcattggccccgattgtattggaacaggcattgaaggaatcagggacgcaactgctggaaccttatctctccttcaccctctatgcgccccgggaatatctttccagggcttatcatgatgcaccgaaatactgtgccaccatcgaaacggtccaggtaaaaaaggatgaagttgtctttactggcgagattcccgcccgctgtatacaggcataccgtactgatctggccttttacaccaacgggcagagcgtatgccttacagaactgaaagggtatcaggccgctgacggcaagccagtcatccagccccgccgtccaaacagccgcctggacaaggtgcgctatatgtttcagaagataatgtaactgcttccagttttttatttttgtaacgattctttcacaaaatgttcatacttgaacggtatagtatagacaatccctaatataaataaacccctatttttcttctatactatccccctcaaaatagctatgaagaaatacgaaaagtggtcggcccataatgagtcggccattttttaatacatctaggctcaccatggtataataaggaactagatatattactcattaagtatgaggtgaaatcattgaataataaagataataatcaaaataataataagcggcgacctactcgggttgagctttatgacactcctaagccaggaaaagaaaagaaaaaacgttctttctttaatcgtcagcctaaacagactacccctaaccataaacataagacagcatcccctaacaagaaaaagaatccatatggaatttcacgtcggatgttcaaggtcattttaggctgcctattagttatcttaattgcaaccattgttattttcttagttaaacaacaggaccctgtcaatgttgatagcaatgacactactgtctccacaagcacttcatcacgcaagaagcataaaaagagcagcagtagcagtcataagcatcgttcaagttccaatgacagtgatgacaatgatactcaagatacttatagtatttcaactcctagtcgttcggataacacgcctcaatcaagtcatccaactaaccaacaaccaactactaactcttcttcaactccacaacaaaaccaaccatcgcaggaagaacaccatgatcaaggcaacagccaacaacaatctacttcacaaccagcaagcagcaattctgggtcacagcctaatcaaagttcgcaaagtactagttcccagtcaaacccgcaaccagttcaacctcattctcaaaataatcagcattaatttggaataaaggggttgtcaattaaagtgggcgtgctataatcaagacaatcgattgaaggatatgcaccttcaaagtcctctacagagagtaagtgccttgagtggaagcacttgtgagtgacaatgatggttgtaccaccttcccttattattagccgagataaggctagtcggatcgtgtccgttaccgcaccttagagaggacattactagtgtgtcctaaagatgggtggaaccacgctaatttttgttaattgacgtccctgatactttcaacattgaaagtatcagggacgtttttatttatattaaaggagagatttctatggctcaggttgctgttatgtccccagatggatcagttaagaagatcgatcgggattcacaagaaagtttagaagcattacgtaagctttctgcattaatgttaaaggctgcattaaaacaagaatttaagggtattcgacttggtgaagctgtcgctgacgaagatggtttccacgttgattctgataaagataatcaacaagtttctgccgacgaattaccagctcttgaagacgtaatcaagggaatggcaaagaacgatgttaaggtagaatttgttgaagtacctgtagaggaagcacttgccgaagtaaaagatgatcgtttctcaactgaattgatcaatgaaaatgctaaagacggcaaagtagcaatgtaccaacttggtgatgtcaaagctgttgcagatgatgacattcttttatatggtaacgttgttaaaaacttacgccttctttctgttgctggtgcttactggaaaggtatgtcttcaaatccaatgcttcaacggatttacggaactgtcttctacaagaaggacgcattagaagaagacttaaagaaacgtcaagaagctaaggaacgtgaccaccgtgttatcggtaaccaactcgacctcttctttgttgatcctaaggttggtgccggtttaccatactggttaccaaaaggtgctactattcgccggacaatcgaacgttacatcattgaccgggaagttgccgatggttaccaacacgtttatactccagtcctaatgaatcttgatgcctacaagacttctggtcactgggaacactaccgcgacgatatgttcccaccaatggacatgggtgatggcgaaatgcttgaattacggccaatgaactgcccaagccatattcaagtttacaagcaccatattcgttcataccgtgatctcccattacgaattgctgaacttggtatgatgcaccgttatgaaaaatcaggtgctctttctggtcttcaacgtgttcgtgaaatgactttgaacgatggccacactttcgttacccttgaccaaattcgttctgaattcgcaaagattttgaagttgatcatgagcgtttacgaagactttgatattactgactacagcttccgtctttctcttcgtgaccctaagaacgttaagaagtactatgctaatgacgaaatgtgggaaaaatcccaatcaatgttgaaatcagcaatggacgatcttaaccttgattattatgaagctgaaggtgaagctgccttctatggtccaaaacttgatattcaaactaagactgctcttgggaatgacgaaacaatgtcaactattcaacttgactttatgcttccagaacgattcggactttcctacgttggtcaagacggtaaagaacatcaaccagttatgattcaccgtggtgttgttggaacaatggaacggttcatggcttacttaacagaaatttacaagggtgcattcccaacttggttagccccagaacaagtccacattatccctgttaacgaagaagcccatggtgaatacgcagataacctcgctaagaagatgaaggctgctaacattcgggttaatgttgaccaccgaaatgaaaagatgggctacaagattcgtgaagctcaaacacaaaaggttccatacactcttgttgttggagacgatgaaaagaataacaatggtgtatctgttcgtaagtacggtgaaaaggaacaaaatgaaatgagtcaagaagcatttatgaatgaaattcttgaagatattgcttcttactcccgtgaaaagtaattaagactaaaaatggctctatcacaactttgtgaaagccatttttttgttttaaattttttgaaagtgaaatttttagcataactttaatcaccaaaaataaaccgttttcgaagtgttcgtgaagttttggacaacctaaaattagtaattgacactattactcaaaggctttatagtaataaacgctcgcttctgagccactaaatatattaattaattattctaaaaacaaaaactatttattttggaggtataagatatgtctactatgaacgatttatttaaagcaatgggtaaagctactgaagaacatcatgctagcggtctttcatttgaagctaaaactgatgcacctgctggtattggtcaaggtatccttaacgttcgcaagtaattttaaaaggtcatgattaggaatttcccgatcatgaccttttttatttatccttaatagccaaagcaaatataaacataactaaccccagagcaaatagaacacttaatgaagctgcaccgaccgtcgatttaccagtccattgagtaacgacttcaacaataaaggggccaagcttcccaaggatattatagaaaccaaaaaattcgctactggcatttttaggaacaaggcggccgaagtatgatctactaagtgcttgaagtccaccttggcttgtcccaactaaaatagctaaaatccaaaaatcagtcaaagtttctaaccataaagcataaagacaaataaagaaataaacgataatgcccagcataataattcgtctcgtagaaaatctattagcaagccaaccatataaaattgaaaatggaacagcaattaactgaactactaacagaacgaccatcagcatcgtggtttgaattcctaagtctttaccaataaccgttaccattgtaaagattgtatcgacaccgtcaatatagaagaagtaagcaactaaaaaccatgtcaactgcttatattgattaatatgatgcatagttcttctcagacgacgcaaactatcgacaaaaggatttgcaacactgctgacgctataacgttgatgaccattttttaataacggccacgcaaaaataatccaccaaactgtagccaaaactaaatcgggctactccataactgcttaagagaccgctaaagcccttacttagttctgctactaaaaagataataaagacgactactcctcctaaatatcccattccatagccagtcgatgaaacacgatccatttgcctattatcggccacatctgttaaaaaactgtcataaaatagatttcctcctgagtaaccaataattgacccaatataaacgattaaaagtagttgccagtatttagttggaacaagggcaagcccgattgtcagtataattcccaaccaggtaaaaagatttagccagcgcttctttgcatacgggtaatcagctaatgcccctaataaaggcgctaataatgaaataacaagcgtaccaaaactattagcatacccccacagtgctgtcgagtttgctgcactaacaccggcatgatcagttactgctttgaaatagactggtaaaacagcggtcacaactaaaattccataaccagaatttgcccaatcataaaaaatccgttgccattgttgtctcgtaaacttcacaacgtcacctcagtctttaaagattgcatcaattgcttgtccggcagttgaagtcggataatgtaatcctaataatttagcaaatgtcggtccttcgtcaaccaagcgagcatgttcaacagtcgcaccacttttgatttggagaccagcaaaaatagcggtagtgaagtaatttgcttgtgttggcccgtaaccatgaacgccatgatagcgatcgtgagttccaattgattctggatcaactttttcgacaatcgctggtctgtttacctcatcggtgaaatattatcctggtttggcttcgacgaggaatgtgcacttaggatctgccccccgtttgatcgccgctgcgttatcatagattcgctcaaccccttcaacaccagcaatcatttgcttaatttttcctcgatccacggcaccacgagtgtaaatataagtttctccatcgcaagttttagcagtgacttgccagttatttcgataagtgcttttctttccaagagggtgaagaagtccttgttgcgcaaataacatatttaaatgaatcatcttatcaacattaatttgatagtgatctcctaaaatcacaaagtctgtttgcgcgtaagtaccggtatcttttgccgcttgaattatcttagctacacgtttatctagacggtgtaatgcttatttggcttgtggtgatcgaactccataacggtgacgcatactatccatatcaactaagtgaatcaatgttaagtccggctttttattttttattgtatcaaccgcataggctgttacaaaatcgtcaagccacggctgcttaatcccgtgacgtaatttaccgtattttttattcatttcatatagaaataacggactacttgcctttaacgaaaccagtacttgatttgtccaaattcgattaggaaagatttctgcaaggttataatcaatcttactgctagcagtcacaggccacaaaaatgcagcagttgttaagcccttttcttttgcaacatcatagaggggcatcaattgaatatcttttcgataccagaaccagtcaggcgattgccggcgcggctgcaatttagtattgttaataattccatgtacgaccggatactgaccagtaataatcgaagtatggtatgggatggataagttaacgttggaaagattccctcaacttttttcacccatgttcctttttctattaaatctgctaatgttggtgttaattgacgtaattcgtttaggtcacgaaaacctaatgaatctagcgaaataacaatcagcttatgctgtttcatcagttcatctgctttcttttcaaactcattagctattttaaaataaatcattgttaataactagttttgaaagaaattatcaaaaatcattctcatcgtaagcattaaaatttgtatgataaaaaagttaacccacattagtaagccagcgattttcaataagttttaaagtgaaatttgattcacagtaatttttaatgtaaaattaagtttcagttttcagtattttatgaaaggaatcataatcatgcaaaatcagttacccaagggaaaagagcatgagaaaactctcggcctctttgacctttctattctaggtattggcgcaatcatcggaactggaattttagttttaactggaattgtcgccgcggaagattcaggtccagcaattgttttctcttttctgattgctgctcttgctagtggtttaattggtctctgttattcagaattaaccactagtttacccaattcaggaagtgccttttattacgcgtgggtttcaattggtaaatttatggcgttccttgctggatggacgctgattggggtctacgttactacaaccgctacggtagccaatggttggactgggtacgtacaatcgttcctagaagtcctcggagttaatttaccacataaattactggttacgcctgcagctggtggttatgtaaacctccctgctgtcttgatgatcctttctatgacgattattttgacacgtggaactagtgaaagtaaacttgttaacaacttcttggttggtgtcaaaatctttattattgttctatttatcgttgttagtgctcaacatatcaatctcgctaactggcacccatttttaccatatggatacaagggaattttcacaggagcatctgctgtcttcttctctttcttaggatttgatgcattagctacttctgctgaagatgctaaagatgttgataaaaatattccccgggcaataattttatgtttagttatttcaactgctctttatattttagttagtcttgttatgacgggagttctaagttataaagatttgaatgtctctgaagctatgtcgtatgttcttttagctaagggtcataaatacgtggctgaaattgtttcacttggcgctgttttaggaattatggctgtcgtctttgcattcatctatgctggctcaaatatcatgaagtcaatgagccgaagtgcctttcttcctcaaggcctcgctaaagtcaacggcaaaactcaaagtcctaatcgtgctatttggctagtcggacttctttcagctgtcctagctggagaattcgatctccattatcttgcattaattgccaatattggatcattggttgtctttgctttaatttcgctcatcgtaattatcttacggtaccgttatccagaattaaagcgaccatttaaggtaccttttggcaacgttattcctgtgctatcagtattaatctgtattgttttattagtaagcatctcacttaatgcttggttaacatacttattgtggctagtagtcggattaggagtttacttcttctattcccttcgtcatgccaacgaatttaatttccaagatgaaagtgatatcccaggtaattaaaatttagttctaaattatgatagacctctacattgatccagaatgttagaggtctattttaatattatttagcacttcgattctgacgagttgtttccgctaagtggactaaattagtaacaaaattatgagttttggcttcataattatattggcgacccagcttaacaaagtaaccattgatataatcaacttccactggacgattatgactcatatcttggtacattgaaggataatgatgcggacagccaactttagagacataatttacactttctagctcttctgctcgcgtattaactaattgtacccctgcacgttcacagacatcatatgcttcatcgattaattgccgagatagttcatcagccttatcaaacgccgcatattcacccattgtaatttcaaacatagtacaaagggtattaacgactgaattaaagaccacttttgccatcaacgttcccataaaatcatctttaagggatggattaaagtttgcttttttaagttctgccattaacgcttgtgtcttctcatcaggcttttcagtataattagcccaattagtcgttcccatccctcgttctccaacaaattccacttcgccaggtttggttaaaatagttgctactaaggcagttccagcaactactttttcttttgggaaatacttcaataatttttcaacatgtcccattccattcatcgctgtcatcgcatattgatccttcaagaaatgttcacaacgttttaacatatcatctaactgcatttgttttaattcaaagaaaacaaaatcagcatctgtagcattgtattcttcaggtgtataaacattaacgggaacaaggtgtctatttttatgctcgcgagttacataaacgcctccttgttctttcatcttattgtaatgtggtaaccatccttcaacaaaatcaacttcattacctgcttcttgtaataaaacaccaaaccgtaatcccattgcacctgcaccaacgactgtaaatttcataattatctctcctttttatgactataaaaaagcgtccttagattaaacaacttaacctaaggacgctttttgcgtggtaccaccttaatttgccaacaattcacattattagcctcaaatgttcaatgcttccattaaacacgtcagctataatgggctgatcccaccattaattactaatttcatcatggcactcaaagtgattttcattataagcaggttatcctttttcatcaaccaaggactctctgctaatccactcataattactcttcttttcaacgtgttttcataatcacattttaatttttatctaatttaatactttgggttgtaaatgtcaagatttatttttgttataaattatcttgacatccctatttcatccgcgtattataatgacaactaaatgagagaaagcttagaaaagatgagtaatcttagaatcttattacagagaatcacggttgatgagaggtgacataagagactgagacgaagatggtcttggagcttcacgaattacgagtattttatataagtagttcacgattgacgaccgataaaacgtctgggtatagcttccattagtgtacctattgaggatagtattgtgagatactatcaaattagggtggtaacacgttaattaactattgattaatcaacgtccctaggaaaagtagaaatatttttcctaggggcttttttattgcttcaattcttgaacccatcacgaatagaaaggatcgatttactatgactgaattcactacacgtactacatcaccatttcgttatgacatcgttggaagcttccttcgtcctcaagagctaaaagaagctcgtgcaaaatttgcaaacggcgaaataacacaagcagacttaacagttgttgaagataaagcaattattaatttgattaaacaagaagaagctgccggcctgaaagcagttactgacggtgaattccggcgtagttggtggcaccttgactttttctggggattaaatggcgttaaaaaagctactctaaaggaaggctataaatttgcagatgaagagactcgtcctgaaactgcgcaaatcactggaaaaatctccggcgaaaaccacccctttgtcgaacacttcaaatttacccaagctcatacctctgatggcgttcaagttaaacaaactatccctgcgccagcacaatttttagaagaatttcttcgtcccgaaaatcaagctaatgctaaagaattttatcccaaccaagaagatttagatcatgacgttgccactgcttatcatcaagtgattgaagatctttatgctgctggttgtcgtactcttcaactagatgactgtacatggggaatttctgttaacgcctttgctaacctaaggaaaaaagaccccaatgctgatgtatctcagcttaaagccctgcaaaagcgatttttaaaagtaaacaatgaggcaattgctaatttacccgccgatttaacaattaatacccacgtttgtcgcggaaactatcactcaacatgggctgctgccggtggttatggaccagttgccgacacactatttgctaaagaaaacgtcaatgccttctatctcgaatacgatagtgaacgtgctggcggatttgaaccacttagcaaagtttctgatgataaatatgttgtccttggtttaattacttcaaaatcaggtgaacttgaagataaggcagcaattatcaaacgaatccatgaagctgcgcaattccatccattagataagctctgtcttagtcctcaatgcggcttcgcatcaactgaagaaggaaacattttaacagaagaacaacaatggaaaaaggttgcacttgttaaagaaattgctacagaagtttgggaataatttaaaatgaataatgggagcgaggcagaagtcacttgtgacttcgtttttcgacgcgaagctagcctctgggagcccccgcaagcaacaataggcctctagcgttcggttttgccggacgttagaggccattgttgtactgcgtatttgctttttatgaaagtaacttaacttatgtcacagtcccatttattcttctcccactaaattgccaatacacggtctttatgcggagagtaattaaacagaacatctgtcaaatccaatcctgccttatttccatgatgggtgccatcttgccatgcaggaatatgagttacatcatagacacgattattaattgctacataagctggattcccgttttgcccatcatatttttcaattcttctcttgtaaatgtttttgccataatattccgcctccttatttgatagtgtcaattcaatatcctcactatatcatggaagcgcacacaaaaaaattaataattacctcactttaacgcaaaattatactctattagtattttcttcacaattaatctaatatcatatctaagtgcggaatattgtcttcaaggtaaacatctgaaatcggcttaaatccaaacgatgcgtaaaactctttaagatatgcttgagcttgaatttgaattgtcttatttgggaaaagacgcttagtttcatcgaccgttgcctgaactagctgacgtccgtattcatgtccacgaaattgttttaaaactaatacgcggccaaaagtcgcatgagagctgtccttagccataattcgcgtataacctactaagtctccctggtcatccttcagcattaaatggtgagcttgataatcctgttcatcaatttcttgataaggacattcttgctcaacaacaaatacttttatccgttcttctgctaatctacaccattcttgagcggtcatttcacttagcgtttttacttcaacattcatattaaaacctcctaaaaaataaaagagtactaaccaacttcttcatgtcattgtgacaggccctagtagaagatggctagtactcttaatgtctttaatccggggactaaagacgagtcgttagtaaattattcggtatcagtatacaatggattaatctatcttgcaattagcgatttaataccaagcaggtttatctccgtctgtatttggtttattcacaccaaagttttttcgtgcatatggtgccggatcatcaataatttttgctacaaaattaccaattgactttcgcgagacctcggtacctttaaatggttctccttttgcagtcgtttcgtaatccacttcatccttatctgttaaccatgctggtcgaatgattgtgtaatcaagggttgaattttcaattacatcggcagcactgcgataagttcctaaataactatctttctggccgccacctaacatttcattattccactcaccaaatttacctggaacttcatcatagattccaatcgaggaaatccagactaacggctttacagcatatttttccattaagctgacaatatttttagcttgttgcgtaatttcaggatttcgtagattagcataaactacatctgctcgttcaatcgctggctctaaatcgccaatatttaggacatcccctttaataactgtttcacgattttcatcgacaacattcatattttgtgggtgccgagtaaatagtaataattcatcattgccatttgctaacaatgcatcaattgcgtgtccagcaatttttcccgttgcacctagaatcaaaacttctcttgccattatttctacctcctcataaattctacttttagtatacaattctctataccaattaaaagtaagcacacacaagtaaggtagttacactcaggtaagatatgattgatggacaagtaatcggcaaaattttattttttagtatattttttgccccactggttaattgacctaattattggtaccaaactttttcctacttccgtcaatgaatactcagtcttaggcggcactgtcgaataaacacgcttttgtataatatttgctccctctaagtcctttagttgaagagccaacattctctttgaacaatctggaattaatttttgcaactccgaaaaacgacaaggctcatattcactaatttgatatataattacgcttttccactttccgtttattaacttaagcgtattctcaatcggacaatctttttcgaccattttttctcctttctctagtgaaataaaattcacttcttgtatatttttatttttaagttactattagtaagtaaagaaatgtacgggagtgattattatgaattcacaatttaacagtttagctgcaaatcgtcgttcaatctatgcgcttggtgataatctttcacaaacaccagaagaaatttttgacttagtgaagcaaacaatcaaaaactcaccaactgcttttaatagtcaaacagtacgggcagtcgtattatttggcaagtcatcagataaagtatgggaaatcgttgaggatgctttacgcaaaatcgctaagagtccagatgcttttgaacaaacaaagtcaaaaattgatagtttcaaggcaggctatggaacgatcctctactttactgacactacaattgtgcatcaattagagaatgattatccatcatatgcagctaattttgcaaactgggctgaacaaggcctcggtggtgctcaacaagcagtttggacagcactcgcagaacaaggaatcggtgccagtcttcaacattataacccattgattgatgatgcaattcatcaagtatttaatcttccagctgattggcaattgcgtgctgaaatgccatttggttcaattgaggcaccagctggagaaaaggctcagcttgatgacgaagagatgttcaaattaatcaagtaaacttattattctccatcctcttgaacggtatataattattgtaaacacgttaaaggaggaattttaatggaacggcaacctaaaatgtataatactggagcagattatgctttagcaatcattggtggtaaatggaagtccgttatcctttatctcttagctggtcatccccgacgaacaagtgaactagttaagcagctaggcacctcatataaagtcttgagtgaccagcttagtgaaatgatagatgccggcctcgttatccgaaaaagtttcaatacgattcctccacatgttgaatatcgcttaactcctgagggtgaaaatctttatgctgcccttcgttatttaaattactggggtgaaaatagagcaaaacaaactggtgacattaaaatcatgtgtactgacgaaatgaagcaggtcggcgatgatggtctatgtgtcatcactaaaaaacatcttaatcattggcgccaagaaattgtaaaaagcaaggacaaagatatttctatctaagttcttgcttttttgtgttctttaatctaaaagccaacgccattataaatataatcatgtagctcgcaagaataagatgggtattcatgataattggaaagctttgaatacttgtttttcccaccgaaaacgcaccaaaaattctattaattcctgttgttccagcaaaaataaataaacttccccacattactaattgggaaattatccccgcaattgatgcatagtaataattgacgatcgaagaaatactataattatgggttgctttctcgtagtcatcaattgctgttttacgttctgcaccggcaaagctacggatgataaatacgccaataaaatatgttggcaaccaaaatgttaagagaattccaattgttagcatcactaaattaatttgacaatccttaaaatggaataaatggtgggtttgttttaccaataatcctccaaagacgaaagcaaataagtaagcaacaattgtccaagaatacatttttgtgccatacaaaatgccaataaaaacggtactatacagggtccaatactgaccacaagcaccataaagcattattcgttgccgtaaatgattgggatagtgaagtaatcgccgatggtttacaagcaaggtaaggatcatcgtgatgaggaagattaataaaagagcggttccccattcaagtggtttcccaaagcctaaacttctccctaatcgcaacagtaacattgcgccaagcaaaattaatgctagtaagtaattagcccaatgtagacgaactggcagcggacgaattgcatggggtgttttccaaattgatcccattgcaccaaaagtaatgattaacattaaaacaaaactaattactggcttctttatccacacaattatcccaaacacaatcaaaactataataacttgaaaaagcggcttaagatgatcctgctggggtaagagtcctcgttttattaatcgccgccgctgacttattgcggttggaaatagtcgagaggcaatccctgcccctgcacctgacaaatcccagaagattggttgaaatccaccaaacatccctaaaaagtaaccaataattccgctataaagaccaatccaggccagccgttgataatcgtattctaaatcacggcaaaataataaaattgtatgccggaaagcatagaaaatagcgaagggcaaggcaccaacaaagatatcagactgttctttagtaagggaaatatacagcaaaaaaggcattaaatttaataataaactacagacaccagtcaacttttctaattttttcatttttatttcctctaatgctggtcaattgcactattcagtttctttcgatttactagaaaaataataataactaacgggacaataaatagcattacgggataaaaatatttcacaggtaacgtactatcaacaatccccccgatgattggcccaagcgtcattccaatatcaaggccgagaaagaatgtcgaacttgctaaccctcgttcattatctggagctagcatcattgcagttgattgacaaacggaataaataataccatagccaaatgccattccagcagctgccagtgccatttcaatgttatttttcataatacttaacataataagataaaagattgttgcaaccgtgcttaaaatcaaccatggttcaaaacggacagtatcaaattgggtccgtaagaataatcggctaagtaaaagaactacagcataaattaagaaataagcaccaacagcaatagataagtgacgttgttcagcgtactcaacaatatctgcctgcgttgcaaaatatgggatagcaaataaagctgttaaaagggcaaccgggatagcgtctcgctgaatgattttaatatgaaagccactttgttttacagagtgtgctgccggttgagcgcggttactgacaaactgaattgtgacaacaaccagtaaagccgataatgctgaaatcaccattgcagctcgataaccaataattcgatataagttaattgatacagcgggggcacatgccattgccaaagcgttcatcagtccataaaagctcattgcttcgccaacatgattaaatggaactaaatatgatagccaggttgtcatacaaactgtacataatacaaatcctaatccattaaccaaacggcatattaacaagaaagtgctattaggcgttaacacataacctgcaaccccaataaagcacaatattccaccccaaaaagctaatgaatattttgaaaaacgatcagtcagattaccagcaattggtcgcaaaaacattgaaacaatactcatcattccaacgattatacctgcaaaagcacttgatgcgcctaaatcttgagcataaccgttaatcaatgggttacagtacatattactaaacataaaaaagaacgaagccgccattacgagcacaacatcttttgtaaaaatcgatttttccttcgccatcaattcccctactttctttgcatgattttaattaaattctaattactatcatacaactatttggggaagttaaatgatttcccaggaaataaataaagagattgggttttgtttcccaacctctccgtgtgtacttcactatttatattttactgcaaagaatcccaagctggtagagtaacgggttcactggcagctactttctttactcgatcgctaaggtacttcttattaataacagcctcataagtatactcttcaaaccaatcttgggtcattacaaagtatccgttatcgccattatctttaccccaactgttttcaatcttccatcgtgtaggttgaccatttaccatgtcaaagcctgttaatgtcattgcatgagaaacgacggcttgcttagtttccaaacggtgcttcttatccattacaaaatcaacatcaagcaattcctctcgatgatataattttgcatccatcaagcctcgcttacggtccatttgttggagaacatcattcccaacccaaactgtttcaccagcttgcaactgtttgatggctccttcttgtaattctgcaaaaggaacattaacaaatttaattggcaaaccatcaaccacactatcttgcgctggcattaaataactccgatccatttcatgatcaggagcgttagtaactacaacatagtcacttaagtttgtatcaaagtattcatgatagaactttaatggcgttaagccaagaacttggtggaactttttatcatcatcccgatattcaagatcaaattttgcaggcggttcaccaaatgagtaggctgcaatcttataaacgtcacccatcattcgttcttgtgcttcctgtaattccgttgcactggcattagtttgcaccattacccgtaattcaattgcatctttgcgcattaagctatcaaatacttcggctacatctgaagtatccttcgtattatgtgtgtcaggcattacatattctggaacaacaccatatttctcaataatagaagcggcattagcccattgtccaccatcatttaatgcaaaactaaggtagaaatcaacggttcgatcatgcaaaggcttatcagcagttgcaataatcttctggaaaaacatatttgcccgttcaattcgatcccagaaaaatagataattttgtgacaattcaaagtccttgaacttatattttgttgcaaacttatgacgtaatgtatttaatgctgcaaaagaccagcaacgtccactatgacgctggttggttggcttccccgtcttaatttcataagaaaatgctcgatgaagacgttcgcttgccgttggatcttcactcgcagctttaatcccatttttttgtattgcccgggcaataatttctgcatctttacgtgaatgaaattctttctttaatttttcaaccatttttgaggttaaatcgtgttcttcagtcacaataaatcccttctttgcctaaaattctaaaatgacttatacattattaatgataccgcattttcttcaaaattattgacttaaaagcttttctattttaaacaagcatcaatcctttactgcttataaaaagtaagctaagattgtatttagtaagtcacttttaattataaattatatgaactgcggtaaaattctatctaggaggtcgattaattatgaagaaagtatttgttgtcggtggttcaggccgtgttgctactgacttaattaaagatttagttgccactggtaatgaagttacagctggtgctcgccatccggaaaaagttattaagttaaaccacgttactgctgttgaattgaacctacatgatagtgttgaaaaaatcgctgaattaatgaaaggcatgaatgcaatttactttgttgccggatcacgtggcaaagatttactgcaaactgatgcgatgggagcagttaaaacaatgcaagctgctgaaaaagacggtattaaacgttacattatgttaagttcgctatatgctttacaacctgaaatgtggtcaaaagttccatcattagcttcaattatggattataacattgccaagttctttgctgataattatcttatctcaaatacaaatcttgactacactatccttcaacctgctaatttaactgaagaacccggtaccggtaaaatccaaattggtgaaggctctgcaacttctaatccgattccagacgttgcccagactttagccgatattctacaacacgataatacaatcggccacgtcatcatgatgcggagtggagatacgccgattgaagaagcactagatcaaatttaattttttacaggttgttgaccagtcgaaatagcgtaagattggcctacaacttttttctattctaaaatcaggtaatagtttagctaatttttctcatcagccgtataataaacattaaaaacaaattaagaagggaatcttttacatggcaaaactcgaacgcttttataatactttccaacctgaccattatgatgtttttatcgatattaatcgagcaaagaaaactattaatggaaaaacaactatcactggtaacgcgactgatcctcaaattgcaattaatcaaaaaaatttgcaggtcactggtgttcaagcagacggtcaagaattagactttaatattgataatgatgccgaggcagttcggattacccttccgcaaactggtaaagtaacttttactgtaacttataatactaagttaactgattcgatgatgggaatttatccatcatactatgaggttgacggggagaaaaagcaaattatcgggactcaatttgaaacaacttttgctcggcaagcttttccctgtgtcgatgaaccagaggctaaggctaccttcagtctagcaattaaatttgatgagcatcctggtgaaaccattatcgctaatatgccagaagatcacgttgaaaatggcatccactactttgaacccactgtgcgaatgtccacttatcttgttgcctttgcatttggagagctccaaagtaaaattactgaaacaaaaggtggcgttaaagtaggtgtattcgcaacgaaagcgcaccaaccaaaagaacttgattttgcattagatattgctaagcgggcaatcgaattttatgaggatttctatcaaactccgtaccctcttccccattcatggcagttagctttacctgatttctctgccggtgcaatggaaaattggggattggtaacctaccgagaagcttacttattactcgatccagacaacacttcccttgaaatgaaacaattagttgcaactgtcatcacacacgaactagctcaccagtggtttggtgatcttgtgacaatgaagtggtgggatgacttatggcttaatgaaagttttgctaatatgatggaatatgttgccgtcgatgctctccagcctgactggcatatttgggaacttttccaaacttcagaagctccaatggcattacaacgagatgcaactgatggtgttcaatccgttcatgttgatgttaacaatccggccgaaattgatgccttattcgatggtgcgattgtttatgccaaaggatcgcgaatgttagtaatggtccgggctcttttaggtgacaaagcgttacgagaaggtcttaagaattattttgctgctcacaaatacagtaatgcaaccggagctgacttatggaaagctcttggcaacgcatcggggcttaacattggaaaaatcatgaattcatggcttgaacaaccaggctatcctgttgtaacagcaaagattaatgatgatggcgatttagtactgtcacaaaagcaatttttcattggtgatggtaaagatgttgatcgtcaatggcaaatcccacttaatagcaactatgatgaagctccacaaattatggcggaacaagaactcaaccttggaaattatcaagcattgcgcgataagaatggtcaaccattccgtctaaacctcggcaataattcacatttcatcgtaaaatatgatgatacgctactaaacgatattttagatcatgctgatgaattagacccgattacccaacgtcaacttcttcaggatctgcggttacttgcccaaggacaacaaatatcttatgcgtcattaattccattattaaagcaatttaaagatagtccttcagcaattgttaacgccgaactataccaaatagctaatggccttaaaatgtttgctaaacctgattctcctgctgaacaagaactacgacaattctctgatctattaagtaaggatcaagtaaagcggcttggttggttacctaaagatgatgaaagcaatgatgaccaattgacgcgcccttatattcttagcacttcactatttgcacgcaataatgattcaattactcaagctcatcaaatctttactgaaaatcaggataaattagagtctctttcggcggatattcgtggtttagttcttaaaaatgaagttcaaaacttcgggagtgctgaattatttgataaattaatcaaagcttaccaacaaacagcggacgcaagctttaaacaagacttgcgaatggcaataccaaatacaactgatccagcattaattgcaaaagttgttagttactttgaagatgctgacgtcattaagccacaagatttacgagcatggtatcgtggccttcttgccaataaagcaggtcaacaagctgcctggaattggcttcgtgatgaatggcaatggttaaatgacacagttggtggcgatatggaatttgctacctttatcactgtcactgccggcgttttccatactcctgaacgattgaacgaatttaaagacttctttgaacctaaacttaatacaccaggtttaacccgggaaattaaaatggacattagtgtaattgaaagcaaagtcaatttaattaacaaagagcaaacagctgttaatgatgcaattgcgcaacaataattaactgtaaagccctataaaaaacgcaactaaggatttttcctcagttgcgtttttattttaaatctgctgctttaataaatctaaccttgtactttggcgttgtaaaatatcgtcgattacatctgctaatgaaatttgcttcatctcattaaaagctgctgcttgaatctgatcataatacttttctaatgacgcctgaatatttccaccaacaatacacttcaaattagtttttggatcaacatgaagtaaatcatgatccatatttattgcctggtagatatcaaacaggttaatctctcgtggctttttagctaatcgcggttcagcagccccctttctagttacgatcaaaccagcagtcctcaaatctgacattaattgacgaacaacactcggattcgactcaatactatcagcaatcgctttactagataagtcaccatcctgataaacgtgcaaatagcttaataagtgaacagcatcacttagtttatatgaatatttcatactcctattttatcttgttgttttataacattcaagcgctatagtattaatttatagttttcacttttaataactacgcttgttaaataattttaattctagcaaaataaagacatgataaaaataaaatcacatgtttgagcttgattaataaatatatttagcatatattactactgttggggtaggaatctcagagttattgtctaacggaacggaatgtgaacgttagaaggaggcttataactaactgctttgttattccgcattcaccatgaacggaaacgtcaatgtgttccctaacaaaattttcaaaagggagtggattgatatgtctacgttatcatttgccggaccgcgttttactacaaagaatttgactttagctgctatgctggtcgcactgcaggtaatcttaaataaactttcaattggagatccagcggttttaaaatttagttttggttttattgccactgcacttattggttactgtcttggaccatggattagtggatgatcaatggtcgtatctgatatcataagtaatactattttaaattcaggaagcttattctttcctggctttaccttatgagcttaagttccagtagtaccggccatactttcatggctctcctcttcattcgtttgccaaaagagttgattatctggccgattgaaaccttgcttgtactagttatcctgcggcaattatcacgattaaatttaattgcaaagaagagcgaaaaataaatttatttggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaaataaatttatttaaaaaagtattgcattttaaatgaattaggttaaaatacaattaacaaaataaaaaagcgatgagaaagaagagtaactagttgtattcgttcagtgaattggtggtagtgagaaaccagtcgaccctacactagtgaataacactttcgcgagtgctgccaacccaaataagtttacttaaagtaggcttggccggatccggaccgttacctcaccggcagagcatgatgtgctcttgaggaggcctagttttatactagacaatttgggtggcaccgcggaaaaaagcctttcgtcccttgattataaggggaacgaagggcttttttaattcattcctaaatctattattttaaggagtgtctattatggacttaactattccaaaggattacgatccacgtctttcaattagagaaactgaaactgctattcgttatattcgtgaaactttccaagacgaatttggtaaagagttaaaccttcaacggatgtccgcaccaatgtttgttgaaaagagtactggattaaacgataacttaaacggtgttgaacaaccagtatcgtttgaaatgaaggatatgccaagcgaaactgttgaagttgtccattctctcgctaagtggaaacgtcttgctcttaagcggtacggttttggtatgcatgaaggtctctacaccaacatgaacgccattcgtaaggaagaagacctcgataacttccactcaatttatgttgaccagtgggactgggaaaagattattagcaaggatgaacgaacagaagaaaccttaaaggatacagttcgtgatattttcaaagtgattaagcatatggaacacgaagtttggtacaagttccctcaagctgtttaccatttaccagatgagattcactttgttacaacgcaagagcttgaagatcggtggccagacctcaccccacttgaacgggaagacaaaattgctaaagaacttggtgctgtttttgtaatgaagatcggtgacaagttgcaacgcagtggtaagcctcacgatggtcgagcacctgactacgatgactggagcttaaacggtgatattattttctggtatgaacctcttcaacgccggatcgaaatttcaagtatgggaattcgggttagtccagaatcaatgaaataccaacttgaacaagccgatgcaactgatcgtgaaaaattaccattccataaaatgttgctcaatggcgaattaccatatacaattggtggaggaattggtcaatctcgcctttgtatgctccttcttggcaaagctcatattggagaagtacaggcaagtatttggccagaagatatgattaagaagtgtgaagagaaccacattcaaattctataatttaagggagagtataaaagtggaaactattacaattagtgaagcaccaaagcatgttggggaaacagttaaaattggtgtttggttaactgataagcgttcaagcggtaagattgcattcttgcaactccgtgacggaactggatttttccaaggaatcatccgtaaaaatgatgtttctgaagaaaaatttgattctgccaagcatgatttacaccaagaaaccagtttttgggtaaccggtgaaatcgctgaagacaagcgttcaaagtttggttatgaaattcacatcaaagactttgacattgttggcgaaagtgaagattacccgatcggtaacaaggaacacggaattgatttcttgcttgataaccgtcatttatggttacgttctcgcaagccgtgggcattaatgcggattcgaagtcgtgttaagcttgcgacaatggaattcttcgaaaagcatggatttactcaatttgatgctccagaactaactggaagtgctcctgaagggacaacagaattatttgaaactgactactttgatcgttctgctttcctttcacaatctggtcaattatatgcagaagctggcgccatggcattaggccgcgtctacacgatgggtcctactttccgtgctgaaaagtcaaagactcgtcgtcacttaatggaattctggatgatcgaaccagaaatggcttggatgcaccaagatgaaagtcttaagattcaagaacaatacattgcttacttggttcaagacttaattgaccactgtgcacgcgaacttgaaatggtagggcgtagtgtagaaagtttaaagccgttcactgaattaccatatccacggatcacttataaggaagccattgaaatgcttcaaaagggtggctttgatgtagaatacggtgcggactttggttcaccagaagaaacctacttagccgaccaattccaaaagccagtctttatcttgaactaccctaaagaaatcaaggctttctacatgcctgaagatcctgaagattctcgccaagttatctgtgcggacttgcttgctccagaaggctacggtgaaatcattggtggttctgaacgttcctacgactacgaatacatcacaaacaagcttgaagaaaacggcttaagtaaagaagattacggttggtacgacgatttacggaagtacggttcaattccacactctggatttggaatgggacttgaacgattccttgcctggattactctccaagaccacattcgtgaaaacattccattcccacggatgcttaaccgtttgaacccttaataacgaaaaagatgagactagatttttagcctcatctttttttatatgcttttttttgaactcaatttactttttctttactattaaaatgagctgttccttttccccagtaaaatccttgttgtaaaataactggattcccagcaaattttttagctaattgccgatttgaaattccttcaataacaaaggtaagatgatgtttttctgcaaaagctaaccacgcattaacaaagcttatcatcagttcataatcttcatccttaaaaagtaatagcgataatttgattcgactaacaacctttagctgtcttttaatgaatgcatagctattactacccgcacacacatcatcaatcgccaattcaaagcccatttccttgagacgttggatttctctatctaaataatcaagactatgaatcgtttcgcggcgttccgtaatctcaatggccacgtgatcgtgatatgcttcgcgaatctctgctaaaaattgccaaatactttcaaatttcatttgacatggttctaaattaatatatattttgcgattttgttgttcgtttaaagcattttttaatgatttacggcttgccttaatccatgcatcgttaccctcttgtgttgtgagactgtgcaagaaattaattcctggaaattcgccattattatttcgaataagcatttcataagtgtcaatttcagcattcatcgcttgatcaacactaaggattggctgaaatatattgtacatttttatccctaacttttaataattgctatttattttacgttctgaactagtctttcgaggacgttggtgatgctgatcagtaacaatccatccccggccattgttctttacaccatataacattttatcagctcgcttcagggtcgtgtcaagtaattcatcattcaaatgatcagttaaactgcatgaaaagctaattgttaatttcattccctccttggtaacaatcaatttattattaaagaatttttcaattgactgtagtaattgataaacctcttctagtgaatggttagaaactacaatagtgaattcttcacccccgaagcgatatacataaccatgcttggaaaatgcggaatgaatttgttcgcgaaaaactgttgaaaaataatttaacacttcattaccagcaaagtgaccgtatgtatcatttatcttcttaaagtgatcaatatctaatgccccgattacgatattatggatttcactattattatctaatcgattaatttcttgactaagcgctcggtagttaagtaaccctgtcaaatagtcacgttcactttctttttcaagaagttttattttttgctcatttttcttctcactataaaaacgttgctcttcaaacatcgcaataacgaataatcctaacgtggctgcggcaacacttacaggtgaaaagctatggttaatccccagcgatactaactcaactattcctagcgatgcaatggcataaaaataactaattcttttagaaatgctgcgccaccgcgttaaaaccaaacaaattgtcgtaaaaacaatcgattcaatgatccaataccaccagtcctttagcggtaaaatccccattaagtattccacgacattcacaaataacggggttagagctaataatacccaccatattttatatactttatcgcgaaaaagcattgtgacagaaacaacttgcatgaaaacaacttgcccgatattaaataaggacaactgaaacaaacaaaattcctgaataaagtaagtaattataataacggctcctagcccccaactagttaaccgtgaattcttatacgaaacccaataccgttcaaaataaatttgactgataatcatacaaataacgatgattggtaaatagagtatcgcgtaaaaaagtttaagcgccaacttattttcaccttttcaaattttatttttattaatagctttaaaattatacttcttatagtcgaattaatctagtagcgcttccaatcttcatttaataaacgtttcctgaaagaaccgtatgatataattatttctgctaacgcgttaaaaatattaagaaaggatgacagatcttatctttataatgaaaaataattaccatgatatgtattttgagcaccaccactggctcttaaaaattcgacaaacactaattatgttccttagctggtgcattttacttatccccattattatcactacttcaacctatgtggcttaccggacaaatggtcatcgcgggtattttttctgggattatgctgaaggatttcgtgaacttaattttttagtaatcattttgctatttgctttaggaatgattggggtattctgcattacaatgggatatatccaagctcaaaggactcgtggactaactacaaaatggcccatgttcgacattaacaaaagtcatttacaacgccaacgagctgaatcattcatgactaagcagtttggtgattttgagatgcgaataaatacgcgcaattttgctgttaagcctgaacaaaatctagccaagaataaactgcgcgatattattaacaagcccataggagatgataaagatggtttctaacattttctatgaagcatttcaaactaactccccatggatgatctctcttataataatcaatttaattttatgtatatatcctattttaggagcgatgttctggttctttggcgcaatatcatatgttctatttcgccaaaaagaagaattaccaccaaaagctgaaattaccaccgaaccttttgtcacgattatgattccagctcataacgaagaaatagtaataaaaagcactttagagtatttattaacccaattgaattaccataattatgaagtgctggtaatggatgacggaagcgatgatcgcacccctgagattcttcgctcaatgcaagcaaaatattctcgtctcagagttattagaatcgaacaaaatcaaggaaaggcccatgcatttaatattgggcttttctttgctaagggtgaatatattttgagcaatgatgctgatactatccctgaaactgatgcactgataaagtatatgcaatattttacaagtactaacgggattaactatgctgctattactgctaatatggacgtttataatcgttcctcattatggggtaaatctcaaacggttgaattttccagtattgttggcataatcaaacgaagtcaaactgccattaataacacgatgtatgcatacagcggtgcaaataccatgtatcgacgcgattttcttattaatgttggtggtttccgccaagatcgggcgactgaggatattagcattgcctgggaccatacctttattaatgctactccgaagtttgctccagatatcgttttccatatgaatgttcctgaaacgtttcacgatttatatcggcaacgtaagcgatgggcccaaggtgggacagaagtttggctttctaattttctgaaggtttttcgccatccgtggcaatatcgatttgtcatccccatgctaacagacacaaccttatcgattatttggtctttctttttttggataacaagtatcattttcattattacaatgttgtattttgcaataattggtaactacgaacggatttggcacggcattgttatgagtatgatctttgtcaactttcaattaatagccggtctttttcaagtactggcggcattgattcttgattttaatggatctaagttacgctatttaatgttttcgccactttatctcttatttacctggatcgttaatcctttaacaatcgttactacatttcataaagcgataaaaactgttaccggccatggaagtggtaaatgggttagtcctgaaagaaaggtagttgataatgatggcaaattttgaaaattttctttggtggatattcattatctttaccctaacttgtggcggcttttgtattgagactcactatcgatataaaaataaagacgggattgataatgagcacaaattttcaaataaatataagtattttggccaacctgtttatgacaaacaaaataaaattcatggttatgaacttttattacgggaatacaatcatcatactaataaatggcaattaccacgaaacgttgtggacttccccctcagtaaaattgtttctacaatccaagaaatcaatccacagttaaaagatatcgcaaacttatcgttaaatatgaccgtcagccaaattaccgattttcgcgctgagtatttctttacttgggtcttaggaacgacaaatattaagcaactagtcattgaattagatgctaatgatattagacgtgccaatatttttaaacgtaaagaaatattatatatactaagaaaaatcaaacgacttcaaattaaagttactattgaaaatgttgattcttctaaaaaaacatacaatttgttacagcagtatttgccagatattgcctatttaaaatttaaaatttaatattcattcttttaataagtcagcaaatcactggatagatgttacactcgcacagtggcaacgaagaagcgccatttttaacattgaaatgattgtcggtaaaattgaagatgctaaccatattgcattagtaaatcaactaaatatccctttccgtcaaggttatgcttacggtcatccagaaaatttaaaaaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacataaataagcgaagttggtttttaaccagcctcgcttatttattttagaaatatattcatattaacaataattttgcactttagctatttgcgataaaatccaataaccgatacataactcgcttattttcagccggaacgccatgctgaataatttcttttccattttggtgaagatcattatggtctaatggatactgatcatcatttacagcaatctcgcgaacattatctgctgtcggctcaaagtggaactgaagtccaataacattaccgttcataacaaagccttgatttttaactaagtcactactaaataataagtctgcttgagctggaacttcaaacatctcttcgtgccaatgcagagcagttaatttttggggaatatcggaaataagatcgctttttagatacaccggcgcccaaccaacttctttatgtggtgccttctttacggcataaccgagtgtcttagcgatctgttgagccccataacacgcgccaaaaattggcttatgagcatccaatagtcgctgaattaaaactcgctcttgcttgatccacgttaagtcgtcattagggctcatgggaccgccaagaataatcaacatatcagtctcatcagcagtcggcaaattaccaaactgatagggatgataaacgtacatctcatgtccgcgatcctgtgaccattcttgaattgttcctggtccttcatttggcgtgtgttgcaaaacattgattctcatcgaatatcctttccgtcgacggcaatgttgtgctaggtatcgcctgcaagtacctaagatattattgttataacatcaaatcatgagcttaacaatagtttttattcccaatattcttcatactttcgtgatgccccggttgcagcatcaacatctgctccaccattatcttcacggcgaaaaataaaaactggctcttctgcctcttgctgataatcaacggtaacaactagtcctgagaagaaccaagcatccgcaaagttaacatggtaattaataccatctttttttatgacgattgttgcctcatcgagcgtcggttctggtttatacccttgcttaggaccatgtttaacattgtgtggttgaattgttttaccataaaattttactccatttccactagcgaggttaaatttttgttggaaccacttgctagcagcatcagtaataattaattgcacttcaatcactccttagtttactatttcttttattttacaaccaagaacctatatttacctatttctgaaattaaactattcgcagtctccctctaactttgtcgtattattatttacacgtatagattaacatctttattaaatagtttcaaaggaatttatttaaactaaaatacatgttgactttataaaaacacgtgttattatagcacctgtaaattaaaaaataacaagtttaaaattaaaggagattgttaattatgaaatatgctgtaactgccgctactggtaacttaggacaagctgctgttaaagaattaaacaagttagctggtgcagaaaatgttattgttattgcccggaacactgataaggctgctaagctctttcctaataatgaagttcgtcaaggagattacgaagataagtcatcaatgatcaatacttttaatggaatcgatcacgttctctttatttcatctcaaccaggtggtaaggttgatcgtgctactgctcatgctaatgtagttgatgcattaaaggaaaacaatattaaatttgttgcctatactagttttaccgacgcacaaaattctactgctgcccttgcaactgaccaccgccttacagaaaatgcaattaaagaagcaggcattgatcactcattccttcgtaacaactggtatcttgaaaacgaaattggtttccttcaaagtggagctgctagttgcgatgcattgtactgggctaacaacaaagctggttgggcacttgaacgtgattacgcagaaggggctgcaaaagttattaccagtgaagatcctcgtgaagtttacgaatttgctggtaaaacccgtacttatgatgaattaggaaaagctctccaagaagctactggcaatgattttactatcaagcagatttcccatgatgattatgtaaaatcattagaaaaagctggcttagatactccaacagctgaacttttcgcatcattccaagacccaatcaactctggaaatcttaataaagaaagtaacgatttagaagaagttcttggacaccccgttactccacttgttgatgctatcaaagaagtccttgcacggtaaaatcatttgttcgtgaaaaccatcgaggctgagagaaaacaaagttttctctcagcctcgatttcttattaattatttttcatcatcttgaaccatctttaagctggagccaaagatctgttcaatcgtaaccgggtcacggtggtcaaagaattgactttcgttcttgttaagactagccattcttttcatatcatcatcggaaagttcaaaatcaaagacatcgatgttttcttccatccggttcttgtggactgactttggaatgacagtaatgccccgttgtaaaagccagcgaagaattacttgaccattgctcttgccatatttagcagcagtctccgcaattgcttcgttagtaaagatatcatgcctaccttccgcaaatggtgcccatgcttcaacacgaatatcttcactttgcgcaaacttaacttcttggtcttgttggtaccaagggttaacttcaatttggttgaccgctggcttaacaggcattgttaattcaagatcctttagttgatcagcgtagaagttcgatacaccgattgcacgaatcttaccttccttttgtgcttcttgtaatgctcgccaagcacccattgtatcgccatatggttgatgaagaaggtaaagatccatgtaatcaaggccaagcttttgcagtgaagcgtcaatccctgatttagcccgcttatagttaaaatcagacacccataacttagaagttacaaagacatcttcacggtttacactactattcttaattgccttgccaactgcttcttcattttggtaagcagcagcagtatcaattaaacgatagccgacttcaagagcatcggtaactgcttgttcagcttgacttaagtctggaacttggaatactccaaatccaagggttggcatttctactccgttatttaattttactgttggtacatttgtcataaaataattcttcctttctgtaattaatcgttgtctatatattaattgctaatttacaaattgaaaattactccctttacatggtagtatacaattggcgcatactattaaggagtggtctaatgattgataattacttgcttgaagaattagtgaccttcgccagtgaaaaaacacttgctaaaaccgctgaaaaacttagcgttacccagccgacagttacccgggggatgcaaaaattagaagacgagcttgggattcaattatttgaccgccagcccaaccggatcgtcctcactgataccggaaaattagctgctgaaaaagctactgaagttctcgccgtcaaccgtaattttgttcaacaacttcaaaattatgctgctcgacaatcagtaattaaaatcgcatcaattgctccgggtccattaattctgcttcgcgtaaaaagtgcatctttttctacacaaattgcgattgacaagaagtttattactcatgaccaaatcaccacttcacttttaaataatgaaaattcaataattatcagcgaccaagagattcagactgatcaaattgaatcgcgttatttagggaccgaaaatctctatgttaatcttgataaatttatgtaccttgctaattcccaacaggtttcttttaaggacttagccggattaagttttgtcgttttgaacgatatcggaccgtggaaagaaattatcaaaaaatatattccaaatgctaaatttttatatcaagaagaatgggccgcgcttactgaaatcacaaaatattctagttttccatactttagtactaatataacaacagttaatccacaacaacgtacgtcaaacgacgatcgagtccgactcccgattaccgatgaagttgcgacaatgacgttttatgctaattaccttaagaaacaaagaaaatccttaatgcccttacttaatgaaattagccaaaactggcctaatttaagttaaattataggcgtttaacttgtttcgctgaaaatccctatttaaaatattaataaaaaatgaatcatggtgactaaaatgacgaaaaaattattactcctttcaaccggtggaactattgcctcggttgtctctgatgaaggactagctccaggcgaatctggtgaagaattaatcaaaatgcttggtcggctggaatatgacattactgttcgtgatattctcgaattagattcatccaatattcaaccagaagaatggaaaattattgccgaaacgatctatgaccatcgtaatgaatatgatgggatagtcgtttcacatgggacagatacgatggcttatactgcttcaatgctgactttcatgcttcaacatataaatattccggttgtgctaactggaagccaagttcctatgaatgtgattcttagtgatgcccctgataacttacgacttgcctttgcagccgctgctaactgcgagccaggagtctatattgcttttaatcgtaaagtaatgcgtggttgtcggagtgttaaagtacggacaaccgccttcgatgccttcgaaagtgtgaatgtcccaccagtaggagaagttacttcagacggcttttccattagggatcaccagcatccccaacctggtaaaagtcaattaaatactaaaatcgatactcatgtttcactggtaaagctcttcccaggatttgatcctgccttgctccatgcaatggctaaaaatggctgtcacggaattgtgattgaagcgtatggtctcggaggaatgacctcgattcggcgaaatatggtcgctgcggttggtgaattaatccgcaatggcattccaattattacttccagtcagtgtctttacgaacgaagcgacttgacaaaatacgaggtcggacgacttgcactactagaaggagcaatcagcgcccgcgatatgacttccgaaagtgccatcactaaattaatgtggggtcttggtcaagggatggatgttaaagaaattgcagacttcttcaatactgatgttgctggtgaagtaactttagattaaacgaataagagacaggatgaaaattttgtttttcacctgcctcttattttttacttaaaaccagctacggatccagttaacaaaccgggtccaccaagactgagcttgttgcttaactgcctgcccgtcttgagaattcaagaattttttcgccttattcatcatatctcctgatgaattctttacattattaatcgtatcagttacgtgcgagctatagtctttacttgaactaattggagcattattaaactgaacaagcgcattgataattggttgttcatgattctttgtttcattgtaaatgtttcgctcttcaagtttctgattaaagattacttgaatttgattttgcgttggggtagttccttgtttcttttgttggttaatttccttagtggtatcaccaaccgcagccatcaacttaccaggatatttactatcatccttattggcttcaattgccccatttgttgcggtcaacatttggttagcagattgagtattttgctcatttaaactaactccatctgccgcaattgctttatagactccggttagagctgactccccagaaacggcccggttagcgctaacggtgatagtaacatccgtaacccccgccatttgcgcaaccatggcgtattgttgagcggttactttagtaatattatcctcaccattaaacttttttacattaactttaatccccgaacctggatcggtggggacaattgctaccgaactaaccatggcggcgttagttgtcgaaccattcggattgatatacttctgataatcactggcagtagcggttaacgttgtaaaattatcatcgactgctagcacattatttaattcattcttctcggcagcccctgctccatatacaacatatgatttatttaacgtatgagtctgggtagttgaactgctactcgtactttcactagttgtttcagccgccaaaactgtggcctggctaactggcactgctaataaagatagtgcaagagtcgaagtaataatgattttggttaacttatttgagcgcacttttttactccttttaaggcaaattaaatttatgttaatgataagaaaaaatccgccaaaatactagcggattttattttctttaccacagtttaattattacgccagtggattgggcgggagcagaaaggcgctcagtcataacttggcttggccgttaattctctccctcgtcttgcagagcttcaccgagttgcttcattcctgccttgatctggtcttcctgagcattggagtagttcaaccggaaggcaccgggctgtgggtcacctgcataaaatgggtcacctggtacaaaggccacgttatgttccagacattgcttaaaaagctcaacagtatcttctactccgggtacttcaacccataggaacattccgccttctggatcagtatatttaacaccttgggggaagtatttctctagcccctctgtcattagtgctttgcgttgcccatacaggtcactaatttgcttgacatgtgcatcaaggtcgttatgcttcagaaattctactacggcatactgggctaagttatctgtatgcaagtctgcagactgttttagtaccgtcagcttattaacaacagcttcatcggctaccacccatcctaaacggaaaccaggagcaagcgtcttggagaaagtccccatatagaaaacgtgtccggttttgtcaaacgacttaactgctggcacatgctgccccttaaaacgaatttcaccataaggattatcctctaacacataaacatcatatttagcggctagttcggccagcttttcccgtcgctttagtgccatggttcggccagttggattttgaaagtttggcacggtgtaaaccaacttagcttccggatgagcctttaatgcttcttctagggcatccatcttcatccccgcttcatccatttctacccccacaaagttggcaccatatgatttaaagacatcaagagcacaaagataagttggctgttcgaccagtacggtatcaccaggattaacaaaggccttcccgactaagtcaagagcttgttctgaacctgtcgtcatcaacacattgtctagctgtccggtcacgttttctttttctttgacacgttggagaaccaattcacggagggccgtcacccctttagcggctccatactgcattacttcttgaccacgttcagcaaacacctggtcaacagcttctttcatcgctttgacagggaaaagctcaggtgccggcaatcctccagcaaaagaaataatctttggatccgccgctgcttttaagattacaccgactgcatctgttccatctgctggcacgcgtttggaaaaattaaacttggtcattgtcgtcactcctcgtaatagatgccacatggcattaacgttatcaatctattctgcctgagctagctggtttgctcgctcttcttcttttttcaatcgttctttgatgtatgttgcggatgttgctagttttgattcttcttccggcgtcaagtccagatgcagctgctccactaccccgtcacggccaacgacagctggatatgaaaggtacgtgccgtattcttcacgataattagaaactggcatttcagttcgcgcatcattcaataatgcgttggttaaccggactgctgccgtggcaacaccataattagtgtatttcttcccttgatatacgaggtagcctccttgacgagcacgttcttctagctcagaaagctttaatccccgttcttttgctagttcagtgaccggtttccccaggacgcggactgtcgaccatgccgtaaattgcgaattgccatgttccccaagattaaaaccaacaacagagcgtgaatcaactttcaaagcttcaccaacccgggcccgcatccgtgcagagtcgagtaaggttcccgtccccatcacgtgttcttttggtaatcccgttaatttttggtacattgaggtaatcacatcacaagggttagtaacatcaactaacttaccgtgaaatccattgtctactaacatctttgctaccaagggcacttgggtccgcgtaaacttaaattcagcaaagcgatcatgatctggcgtatcaaccaactttgatttccctagggctgacacgaccacatcacaatcacgcaattggctttcatcattaacagtcaggttagtatggtaaggcaaattggccattgcatctcgtaagtccaaagcatccgcttgcaccttagcttcattagtatcaaataatgcgaggtcatcgacaaagccaccagcaactaaatagtgcgctaccgttgccccaacgtgacccattccgactactgctacttttctcgtcataataaaactccctttctcttttattgcacaactatgtaaaataattaattctagtcagtcacgtccacactcacagtgccgaagccattatcaaatttggcttcccacttgccggtagttaaatgtggtggtaagaggaaagtacctgatgatactagctgccctgcgcggaatgtcttcccttgttcttcaagctttctgactagccattgcaatgactttaatgggttgccaagcacttcacttgacgccccactatccacttctttgccatcgtggtaaagggtgacatttacatttgctgcatcatcaacggtcttaaacacctcatcggttggtcgttcttgaccatatactacatacccaccaacagcacaatcactcatgacactgaatttatttagatctgggaaccagtcagcaaaacgactatcaggtacttccagcgtgccgcagacagtagtcttatgtaataaatcttccatcgaatcactggcgtgcaagtcagttttagcacggaagccgagttcaacttccactaacggagccatcgtttgttctttgagagagagaacggcaggtgatggtaagaagtgggcatcaacttgttgtccatagagcggactatcagaatcaaacatgtcctgggttttcttactagttaaggaaactttgtacccgccagttgggagtccctttaattcaacgaaacgatcttgaagggcataagctgtattatcatcgctaacgacctctgcccattcatccattaccagtggtttcttgctttgataagcttggaaaagttcttgagcaaaagcttcttgttcttcatttaaggtaacgtttttatttgcagtcataataatatcctccttaggacctgaccgctgttaccaattaattatcggtctaagccggtcaggtcatgttctaatttttcttcaatgttaataatgtctgaaatatcactgtctgccatgaccaccaccacctttaagtatgtctaataaaaaacgccctcctagctctattaagaactaaaaggacgtctatcaacgtggtaccacctttatttacaacacaagggttgcctcaatcaactgcccacaatggcaattaatcggcaagataatggctgctaccagtatgttctactattatttcgacatacaactcgcgagggatttgtcgcaactacctcctaccggtttccaccaaccaccggctctcttaattcagcagaattgacgattctcggtcaacgttttttaatttctcttaattgattattagtagaatatcacgtgaaaatgagaaaagcaagagttaaattaaaaaatcattaaaaacaatattgccatggatcgttattcacaaaatatgcacagtatcaactaatttgactcttcccacaagaatttaatcaattcacggtttacttgactgttattgtggagcttactgtgctgggcattctttccatgaatttcaacttcgcgatatgatttgcacgatcactgactaaatactttaatgatttagcagaatttaccggtacatcttcgtccgagtgactaccatccccaacatccccataaatatttaacacggctgtatttttcggaaaggtctgccgtaaaccaagtaattcgcggtaggcagagtccattttctctagttcgccggtctttggatttatcttagcattttgcgtctcactttgccctaccagtccattatagtgtccagcaatcgctactaagtgggctacttgcggaaagcttttatcatttacattgtcattaatataattgataatttccaagtttcccattgaatggcccacaaggttaatttgcttataatggtgttgtttttctaaagctaataccacattttttacatattcaccaccatgatgatagccctgcgtgtaattatctcgatatgcacttaatttattatcttcaaggttgacttccacaataggattaacggcatttgcgggaattgggcggtttcccttttttgtcaacattcgcccgcacaattgtcttggttacaccggcatcacgggccgcattagccattttttcttcggcatgagaactgctcccccagccatgcacaaaatcgtcggtgttgatgattgaatataatgggttacagcatgtgctcgtgaacttattcctaataggccaactaaaataacagcaaagcctaataataattgagaatactttttcatctaatcttcctttacaaaagcttcatcaaagaattgtttaatcttattaaatggtattttatcaactcgatcataaaggtcaatatgttcacaatcatctacaacatacatctctttaggttcttttgctagcttataagctcgttcagagaaagcacgtgaatgagcatgatcaccaaaaataaaaagaattggccgtggggaaatctcatcaatataagctaatgctggaaattgcatcatggcaaggttagaagtagtagtgaaatttccacgagcatgagcatgaaaaccacgaggaacagcataaaatcgattccattcattagtaatcggatcgatttctggcaatgcatcaacattcgggtaaggtttagttgggaaacttggcttatattcaggaatcccgcttgcataatcttcccagcgctggttagctaactcttctttcattttatttaactcttcatcgcttaggttcatcatcccacgaacatcagtaatatcatacattgatgcggtagcaacggctttaatccgcggatctaccgcagcagctgctagtgcaaagccaccagaaccacaaattccaataaccccaattttgttacgatcaacaaacggaacttcaacgccaagaaaatcaaccgctgcactaaatgattctgcaaataaacctggggaggaaacgcgacgtggctcgccagcagaatctcccatattggcttgatcaaaagttaatacaacaaagccacgctgagcaagttcattaccatacacggctggtccttgttctttcaccccaccatatggcgcaccaataattagagcggggtgcttttctttaatatctaaacctttagcgtaataaaggttaccggctaattctaagccataacgatttttaaaattaatactttgccgttctacgttttctgataatggtgtaatgtatccaaatgacatattattctcctccgatttttttaattactttagcaggaacgcctgcaacaacagtattggcaggaacatctttactaacaactgctcccgctgcaacaacagcattttcaccaactgtaacgcctggtaagattgtagcatttgcgccaagccaggcattttccttaatgaggactgatttcaattcaacgccgcgtcgcttttctggatcaaggggatgatttaccgaaatgattgttacattgggtccgactaaaaccttatcttctaattcaattccgccgagatcagtaaacatcgcaccactgttaataaatacttgtttcccaattttcaggttagctccgtaatcactacggatcggcaaacgaatttcaaccgaggcatctattttttgaccagttacatcattaaggacatggcgaatttctctttgcgatgctgaccgactattcaattgttgaagtaagtcttgattttttaaagccgttgccgtgattgtcgcaagttcttctttttgaatctctttcattttcatccctcttttgcttgaaattattgtttatatcttatcgagtttttataataatgttaaatacttatatttaatgacatactatagttaaaaagcatattggagtgattaaaatggaagtccgtgtactgaggtattttattgaagtagtccaagaaaagaacatttcaaatgccgctaaaagattacatatttctcaaccgacactatcacgacaattaatggatcttgaaaaagaacttgggattactttatttgaacgaggacaccggcaaatcaaacttacccaagaaggctattatttatatgaacgagcgcaagagattactggcctcgttgacaaaactgaaaccgacctgcaatcacaaaatgtcataagcggaacattagatattggtgcaggagaaagtgcagctattcagccagtaatgactgtaattggtgatattatcaaaaagtatccagatgttaagattaacttagtaagtggtgatagcgatcaaatctatcagcgcttaaataacggtaccttggattttggaatcataatgggaccagaaaagctcctagattatcattcaattagattgccgcaaaagaatatctggggaatcttagtccgaaaagatcagccgattgcagaaaaggaaaagattactccggaagatctaaagggtgtccctattattacgtcagctcaatctaaagagcaggatgtgtttcgggtgtgggctggttcattaattgatcagtacaactttattggccagtacaatttaatttttaatgctcgtttattagtcgaaacaggagcgtgccttgcattaacctatgaaaatctgatcaatatcactggaactaatcttatcttccgtcctttaacacctactattacagatcaaaataatctcatttggaataaaaaccgtcaattatctaacgttgcgcaggttttcttgaaccacttaaaggaagtacaagtagtatagaataaagccttttctctcaaacactggcttttatattacttccctatagaactaatatgatctattaccattgtttaaaaagcaaacgaccttatcctaaaacgaataaggccgcccaaacttatatgactaaaactctaaagtacctttcaactactgctgtctataggtcttgaagttcttccatatggtctgctgttttttgatctaattcattatgctcatcagtaaaatcattgtaactaccactaatattagttgcatgattagcaaaatgttttaagtctaagtacgatttatggatagtttccttgtcggatttctttacagaatcatttttctgaattttttgatctaggtcatgcaggtcattaactttactatcaatttcatcaatctcgtcggtatgattactttggatagtatcaacggcagattctacatcaaaatcatcagaattatctattgcatcgctccattcttttccttcttgctttgaaagatcttcaaccttagaaccaagtgtgccgtattgatcaataaaatcttctttatcatccttataatttgatttgttcttttcctgttgttctgtagcttgttgttcttgagcttcatcaatacttccctgcgccattccagcaattagtagtgaaataatcattactataagactaatccaaaaatattttttatttttcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtttcttaagagattcattttctttatcttttcttcctttaaaccacctaataccatagacaattgcgactataaacgtaataaaaaacaccaaatcaaataacgttaccaatatctccatataaatatcctcctcaaatatacaaaaatggtcaaccagcgtagctaattgcgtcgattgaccatttagttttaaaactcttacattttaccaaaaattccttaaactgcatatgtttaatacaggaaccaccactaatttgactaatcagataaaattttagattaatagtcaaattcttctttcatatcatcaaaaaagcgctgaacaactggatttcccagcttcagcgcttctctttatttaaaattaagtgagtcaatccagccgtcaatttggcgtgggtcatttaaaattgccccttggttgactttggtatcataaccattttcattaaccgttcgttcaacatagttttgtgagcgatcatagcttgttccaccagaagtagcaaatagtgctaaattcttcccgtttaaatcaagatgatcaatcaccgtactaatcatccgcggcgggatagcccaccaaatcgggtgcccaatgacaatattgtcatagccactaatatctggtaaatcatccttaatatcaacccggctattatgctcgtgctgttcaattgatgtccggcttcgatcatcatgccagtttaaatctgcatccgtatatggttgtgctggatgaatttcggcaatatctgcatttaatttttgagcaatctgttctgcaatcttcttagtagtattggttgcagaatagtataaaacaagggtctttgccattaatgaaggcctcctttatcttaaaacgcagtataaattttaacgtaaaaacgcaatgatggaaaatgcttataattaatccttatctatgctttaaaagtattaatcgttagcgtgaatatcatatgcatttaataacatctcaccaacaccaggcgcatcaggatcatgcattcccttgcctttatcgagggcccgaatttgatccatttcttcatccgttaattcgaagtcaaaaatatcaagattactcttaattcgtgcttcgtgaacagacttagggaagacaacaattccttcttgattttcaaagcggagaattacttgaccagcattcttaccgtatttttcagcaattgctgtgattactggttcatgcagtaagtcagcattaccttgtccaaggggtgcccaggcttcaagacgaacatcatccttcgcaagaatttcccgtaatttcttttgttggaaataagggttaaattcaacttggtttaccgcaggagttacatcaaagttagggacaaacttgttccaaagtttaggtgtcatgttggaaacaccgattgaacgaagcttaccagccttttgtgcttcttcgactgccttccatgcttcgtcaaccgccccatatggttggtgaagaaggtaaaggtcaatataatcaagccctaatttgttaagagaagtttcaatagccttctttgcgtcttcatacttgtaatcttgaagccacatcttacttgttacccagatttggtcacgaggaatcccgctatccttgattgctttcccaacttcttgttcattcatgtaggcagccgcggtatcaatatgacggtaaccagcagctaaggcatccttaactgcattgtatgttgtaccatcagcagggatttggaaagttccaaaaccgattactggaatttcattgccatcgttcaatttgaaagtaggtacattatatatagacattatttttcgtctcctttgcgttaatcattgtctaaatattagcaccatattttctaaactaacattacttgattatcatatcagtatgcccgaaacgtatactaattgagtgaaggatatgggaaattttaaagtaaggatttaaaaacaacctgagaaaaagcttttattttttcaacagcctcgttattttatacgaatattgttacgatatcatggcactggctgcgcgtcgccaaaagactcgaagctaagtcccctgtgccgtgctaaaccccattctatccttagcccctctttgttgaaaaattaattcacactcacctacttttcaaatttaattcttgctcatatcaataattactttacctttattatgtccctgctgaacttttttcatcgcttggggaacctcatctagtgaaaagattttgccaaccgtgggatgaatttgattttcaaccaagatcttgtttgcagctgctaattgttggccattagctgttacgaataaaaattgatagtctattttctttttagctgcttctttttcaatactacgggatgcaagactaaaaagtccttgtttgaacttgctcattttcattcgtttagcaaattccttattaggtattccacgtaaagatacgagtttcccatgaggacgtaaaattgccatctgcttaattgtttcttttccacctaatgtatctattactaaatcaatccctgaaagaacttttgtgtaatcttcttttgtatagtcaataaatttattaaccccgagttgttcgacacgttgctgattttgtggactaccactagtaatcactttgagtccttttgctactgcaattggaatagccattgcaccgaaacttcctgtcccaccagaaataaataatgtctgacctggcttagcttgtaacaattcaagagcctgaattgctgttaaagcagttaaaggaacgccagccgcttcttgattggtaagatattccggtacatgagcaacagcggattgattaaccactaattcttcagcaaatgcaccaatattatttaagggattgcgtccatatacacggtcgcctaccttaaaattagtaacatctttaccagtttgttgaacaagtcctacaaattcatttcccagtgtttgcggtaatttatatgggacaactaatttcaaatcgccccatgctattaaattatctaatggattgacacctgccgctttaacttgaattagtaggtcgtaaggtccaagcggcggcaaagaagcattgctaattagtatttgtggattctttttattgtatttagtaagttgagctactttcataataatcctcacttttttcttatctttatcaaccataacgaattaagaaaatagcgtcaataaagtagctctaacatgtatttcatgcttgctttctagcattatatctttcaatgtcttactaacaagacattaatcgcactattattcaaaggcttttgtcttgccttattttattagttacaaataaaaactgctagctattcattttttgcattattgcctacttaatattggtattttaaattttatctttctaggcttatagtaaaagtaatcaaaattacgattgagaaaggaagattttcatggctaagaaacaaacagctggtcgcgaccaacttggtaatttcgcccctaaatttgcagaattaaacgatgatgtattattcggacaagtttggtcacgggaaagggaattaagccttcgcgatcggagtcttctcaccgttaccgctttaattacaaaaggtgcttttgaacagctcccttaccacatgcaaactgctaagaacaacggcattacaaaagatgaaattgcggaaattattactcaattagcattctacgttggctggccaaatgcttggtccgcattcaacgttgctaaaaaagtatgggatgattaaaaaatcaatttaaaacgtgcctttaatggcgcgttttttattttcggcctattataaaattaattaggaattgtgaggtaattaggatggaagaatttaaagaagcttattatgatggtgaacgtccactttatggtcttcaagatgctcatttagtaaacactacttttggtaagggtgaatcaccattaaaagaaactgctaacttaactctcgatggcgtactctttacatggaaatatcctctttggtattccgatcatatcaaagtaacaaataccatctttgaagaaatgtctcgttctggtatttggtatactaacgatattgaaattactgacagtacaattcaagcacctaaagaatttcgtcgatgtgatgggatcgttcttaataatgttcactttacaaatgctgctgaaacaatgtggaactgtaaaaatattaagatgaaaaatgtatatgctactggtgattatttaggaatgaatagcgaaaacatttatgttgaccatcttgatcttgtcggaaattatgtttttgatggcgctaaaaatgttgaagttcataactcacgcttagtatcaaaggatgccttttggaactgtgagaacgtgacaatttatgattctaagatcagtggtgagtaccttgcttggaataccaagaacattacttttattaactgcacaatcgaaagcgatcagggattatgctatgttgaccacttaacgataaagaattgccgggcattacgaactgaccttgcctttgaattatgtactaatattgatgccgagctaaaaggtactattatgagtattaagaacccaattagtggtaaaatcaccgttgatcacgctgatgaaatcattatggataatcctaaaattgatccaagcaaaattcaaattatccaaagaaagtagagggtgaaaaaattatggaatatgatttcgatacaattctcgatcgacgtcacaccaattctgaaaaatgggacgttaagccaaatgagttaccgatgacaactgctgatatggacttcaaaactgctcccgaaattatgactgcaatgaaaaagaagattgattcaggcgcttttgggtatgaatatcctagtgaagaatactttaatgcggttgcttcttggtataaaaccgagcataacgcaaaagctgatccctcttggatgcgatttgcgactggtgtcatcccttctattactgcctgtgttaattatttaagtcatgaaggcgataatttcttgttaatggagcctatttacaatactttttacaattctatcctcaacagtggtcgtcatgcttttcctacccaactaaaatacgatcattctacgtatacttattctgtcgattgggatgaccttgaagacaaaatgagtaacccgcttaccacgctgatgattttatgtaatcctcacaatcctactggctacgtttggtcacgcgatgagttaatccgaattattaagctagcccaaaagcacggcatcattgttattagtgatgaaattcatggtgatttagtattaacgggtccagactatacccctactttctccttgccagaagattgtcgccagaatgtagttacattagtgtcaactagtaagacatttaatgtggcggcccttcatgctgctacgggaatcgttcctaatcctcttttgcgagaacactttacgcgcgcaatcaataagtatgaagttgcagaaccaaacctcttagcaattcctggaacaatcgctgcctatacacaaggcgcagactggcttcatcagcttaaaaagtatttattaggaaatcgtgaatatcttgttgaatttattaagaaaaatcttcctaaactccacgttgttcctggaacagcaacttatcttgtgtggatcgatgttagtgaagtaaccgatgatagtgctactttagcgcaaaaaattcgtgaaaaaactgggttaattattaatccaggaacctattatcatggcaatgggagccactttattcgcattaacattgcctatccccgtgcacaagtaaaagatggcttagaacgattagctgctgctattaaaaattaaccattaataattattatcagtaattaaaactattttcctcttggcttactaagaaattaatttattttttcgcgcttttaaatatttggacaggaatgagtgagcaccaatatcgcgaaaatcatcattaaacataaaattgtaataaaatcccccgcatgcaactttcacacatgcgggggattttattaatgatcagtttcaacctctaatactttcttcgatccagcatcaatcttaacttctttaactgttcgtccatcttttacttgaacttcccacacagcctgattttctttttcttgttctaatttccattcgataggactacccttcttagttgctttttctgcaatttggctcgcctcatcacgactaattgtcttacttggatctaatgtatatttcttatcatttttatcaagcttttcagatttattggaaattactttaccatccttggcattaactttgaccttatactcattcgcattgtcaaagccttttattgtatatacatatttaccattgtcactttctaattcaacttcattgatttgcttattttgatacttttgattaaatttatcaattgccgcttgttgatcaatcttgatatcactcttcttagctaacttttcatgtttaacagctgcttcgatttgatcatgatggccatgtattgcaactaccccaactgtgcctcctgctcccaacacaatcccgctacaaatacaggcagtaataagcattttcttagtcatttgaggaaatttccttgattttttcttatctgagtttggttgatgatcttgtcttttttcgattttttccgtcatttttattcttcccttcttaactttagttggtaattttattttacgaaataatctgccaactaaaaccaagaacaggtgaaagtatgatgaagaaatcttcatttttgtttaggaagataaactgtaaaaatcgttccaactggttcattgtcgcgaatcataatttttccgtgatatttttcaataatcattttaacaatcgaaaggccaatccccgaaccagcaaccttattggaatgcgattcatcttcacggtagaatctctcaaaaactttttggcgattttcctttgcaattccctgaccttgatcagtaacttttaaaactatttggctatcgtctgccgttaactgaacattaatcgttgaattagttggtgaatatttggccgcattttctagcaaattatgaacaagactttgaaaatcaccttttgttatgcggtaagatatattcggatttaagtcagtaataaatttttgatgatatgcaccttggagtgactcaacttcagcgaaaacaatttttgacaagttaatttctgttagttttttagtctgatgtccttctagaataagcagttcatttattaattgactcatttgctgtgcttcttgatcaatgtactttaatgacttggcaattaattctggatgcttatccccatgccttcttattaggtttacatgtcctaaaattccagcaagcggtgtcttcaactcatgagaagcattcgcaataaattctttttcgcgttgcattgtacgatactgccgtcctagcaaatgattaaaagactgggcaacctttcgtacctctaatggttgttgcggaaccgttaaagttttcaatcgattgctttggggcgtgattgcatcaatttcattatctaaattagtcaatgtttgtgtccatcggcgagctaaacgatgaatgatggggagagcaatgatacttattgcaaggttaattaacagcgtcactatcaaaagccagcacgttaattcgattaaatcatcaacattaattgctactttgacgattcgattatggtctattttttgctgccgtaaataatagactccatgccgggttaactgtagattcttgattgctaaattccgctgatcaattcgcttaaatattttatgggctttgggggagatatatttttgttctccatcagtgatctcaattgcgtcatcgtcttgacgagcaacataagcatttaaaaaagtttcctgattcttgtttctaggccaatcttcttcaattgtttcaattacttcttctgcctgctcatcagcatagcgatatattaaatcagcagcagtcacaacaaaaagaaagttaataattaccaaaattgttgcaaataacgttaagaaaagacgagttaattgccgtgatgcggttattggacgtgtgttgttcattgctcatcacctaatacataaccaatcccccgcacagttttaattaaatcacggtacttacctaacttgttgcgcaaagcacggatatagacatcaacagtattggtctgaccgtcaaaattgtaaccccatatctcgttaagaaggtcatcacgggtttggacaactcctggttctttaatcaaggcagccatgagggaaaattctttaggtgttaaatgaacttgttttccatcaaccataaattgatgtttcagtaaatttatttcaaatggtccaaaattataatcatgtttttctgctttttcttgccctaatcgtcttagagcaaccctaattcgtgctaaaagttcctcaatttcaaatggtttagtaatataatcatccaatccttgatctagcgccatgctaatatcagaggtttgactacgagcagtaatcataataattggaacattactcgactgacgaattcgtcgtagaactgtgagaccatcataaaccgggagcatccaatccaataagattaaggttatttctttctcgttaaatatttccagtgcttctcgcccatcttttgcccagataacttcatatccttctagttctaattcagttattaagaaacttgcaagactttcttcgtcttcaaccaacataatgacagctttcttcattattttgcctccaattatttgtcctatatactattttagctgttttgattgcaggcaaataaaaaaagtttcatatgaaacttttttactgataattagaatttttgttcaagccgatataaatcattcaagaaattagcaacaatatttaattcatccattgaatattttgcggttagtttatcaaccaacttagtctttattatttcatgcatttgatcatgaacttttgctacttttttcccatcctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccacttttttcccattactcgttaatgaataatatattttctttttatcatcaggatgttttactgaaggaagtgatgcaatgtcgatggggcaaatttttaaccaggtcgtcattattttcttactaatgcttttaggggcagttattagaaagctcggatttccccatccgcaatcaattaatgacctaacaaatattacactctactttttatcgccaatcgtaattattaaggcctttgaacagccgttttcgcgatcacgattttatcaattattactattaattgttggtatctttttgacctattttgtttccattttgattgcaaaactactttttcataaagtaaaggaccaaaatattcgtcaaattgcaacttatggaagcatctattctaacaatggttttatgggcgttccattagcacaaggactttttggaagtgtgggtgtcttctatgctgtcgcttcaatgattggttttaatgtcatgtcatggacccagggaattggaatttttcaaaaacggcagcctcatgattggagaacacagttaaagaaaattattttaaatcctaatattattgctattattactggtcttttcctattcattagttcttttcggttgccaaaattaattgctgattttattgattacaccagtccagcgtttactccactatcaatgattgtcatcggaagtaatcttgccaatctaagtattaaaaatatcaaattaccaactgtactctggggaagtctcttcgtaaggaatattttcttcccaattctagggacaattatcttattattattgggaatcaccggtgttccactcttcaccacagtaattcttagtgcatgtccagtagcaggattagtcgttctttttaccttacaatcaaatggggatggacggccagcaaccgtcttaatgagtatttcaaccattttgagtttagtaactattccattagtctattggtttgctagtttgtggtaatgatatatacaatctttgaataaagtattaaatataataagcatttcaaataacagcctccttaatctatgatggaattagatacgtggaggctttataaatgaataaaccatatattacaattgaaaattaaatgcataggatcgggttaaattactgtgattctatgcgtttgtgctttaaaaacaagaaaacgcaagaactctcgcacacactttgggtatttaaaccaaagtagcgaaggggcttgcgtaatgaaatttataaagttgaagtgcaagataaaaaggtatgattccaatatccaactgggatcataccttttattctctagattactgctttttaagtttctttagatagaaaaacaagataaacaatcctattactatacacgccaatgcacctggccataaatctattcgaatgatcaaaataaatatagcatataagattattgctattccttctaagaaaaaacattgtttctttaaacaactaattagccataatattgcacaaagtaaagaagatgtagaagcaataatattcttattgtatgcacaatatacacaaataatgaaaaatattaatacttcaattatattccacttattcttttttaaaaaggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggcttattcttttttaaaaattaatcaaaatcatcaaaactccccatgatagtcgaaataacttttccctccgactctaactattctagaagccagttcagcctctaaaataaaatataaagaaaactattccaattaagatcaaaattacagaaactatccatgtgcttggatgaactataaaaagtaataatccatatattatgaaaaatagtgcttgcagatataaaaatttcttccctagattactaattaatagtgaaagtccacaaaagattgacatcgatatcatgccaaaattgtaatcaaatattaaataccccgaaatgtcaatttaagttagaaagaaaatagttgctcatcagtgacgtaagacatgaatacttcatatggagttcgatagcctagtgatttacggggcaggttatttcgcttactcatcagttgggttaccaattcatcaggaagattgcggaaatctagctgtttcgttaagccatcccggcgtaaaaaaccgttgttgttttcgttcagccctcgttgattgggagcaccaacttcggcaaagtaagtgtgaaggtcaaattgattggcaatctcgcgccagccggcgaattcttttccgttgtcaaaggtaatcgatttgaagaagtgccgcgggaatttccgaagccactgacttaagtgttggttaatcgcatcagccgtcttttcgtgcacattgagtacaatttcgaccttcgattggccagccttcccacggcgctcgacatagccattcgggtgccgcttacctcgcatcggcaaggaacggacatcgaagccgaactggccacgttcaaacatccggtaaagagttcgcaggttacaactaattgggcgctcagcgctcccaataatggtatcaggcgtccacccctggtcaattttgtcgttgatataagtgagttcagccagtgacaactgagtacgttttcggccacaacgttgcttattgcgcatatagtgatcttgataatcagcaattgaggcaccggtttccaggtaacgataaacgcgataaacggtttcggcacaacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtatcaaaaaaattctctaagtcctttagttaatgaagacttagagaatttttatttaaagatctctcattccatataattatggagaatatcatccgaagctgcctttaattttagataatcgatattattagagaatagcataatcattcgtttcgtcttgtaatcagcgacaaagcaactgttatatccaggaatactcccatttgcgcgaataacgtccccatcaaagtaaaccccaccaaaataggcaacttcttgatgctgcgcctgttggtagtattcattgatcattttgggatctttcagcacctcattatatacaaacttccagtaatcatttggcgatataaaaaggttccctgccccaaagtctgaggaggtcgttacagttacccggtgccaatcaactgttggatccattggttgcggaatttcttttttggaaacctcagaaaaatctttaatttggtgaagatggagcggtttagcaaagttttttcgaatataggtattatagctttgatgcgtttgcttactaataatggctgccaagatttcataatcaacatcttgataatcccatgtatgcgtataatcatacttgagatgtttaagcatataagcaatttgggctttttggcctctaagtggttcaaatggacgatcattattaatcaagccactagtatggttcattaattcccgaatcgtaatatctttactgccatcaatctgcgggtaatacttacttagcgaagtgtcccaatctaattgctttttttgctttaattgataaacagcggttcccgttacaatcttttgaagcgatgccgtgggaaatagtcggtccgcctttacgatctgatccttattcgtggtttcattattttcaatagcaatcgttttccaatctttgccattaactagcatcaccccattaatatgatggtccttcatataatcttgaagttggtgttgcgtttgtttgtcaactatttctgcctttacctttgatggcgtggtcaataagaagatagcaaaggaacaaagcgtcaaaaaaatatacaagttaacttttttcataattataagtattccttccaggcatccgttttcgaaaaaatatctatctgtattatacaaattttatcccccatcttacaaagtagaataaaatctgatttttattactaaaacactttaaattcattcgatttatgttaaaattctaacgtcaataaataaaaaacgcaaaaatagttcgtaaataacgaacattatcaagggagagctagaatgaataacgacgtcgaaaaagttttatatactcaagatcaagtcaatcaacgcttagatgaacttgccaatacacttactgaaaaatatcaagatgaatttccagttttagtttccgtaatgacaggggcaatgattttcactagcgaaatgatgaagcgccttaatttcaagttaaacgttgattatgttgacgtctctagttacgaagaaagttcaaaatccactggaaaagttaaattaattcaagatctttcccacaatattaagggtcgaccagttattattatggaagacattattgatactggtcatacattaaagtatcttgctggtcttttcgctgatcgtggcgcgaagagtattgagatttgttccttacttgataaaccggaccgtcgtgaagttaatattgaagctgattacgttggttttaaagttccaaacgaatttattgtcggatatggcctagactttaatggcctttaccgaaacctgccatttgtcggtgtgttaaagcgttccgtatatgaataatagttaaaggctgagagaaaatgttatttctttcagctttctttttggctttaaacatctaaacgcgatatagtacagttaggctaataaaattgataataattgatttttggtaaaggaggggtaatcattgcttaggcttgactggtgtttacgaatgctcatggctgccttatgtggtggaatcattgggtttgagtgaaaaagtaaggctaaaatggctggaattcggacccatgccctaattgcggtggggggcggcaatggtcatgattatttctaagtatggcttttttgatttactgaaagttacccatagcaattggaacgttgacccatcacggattgccgctcaagttgttagcgggattggttttttaggtgctggaacaatcattaatcgccacgatgaaataattgatggcttaactacggcggctggaatttgggttaccggcgcaatcggtcttgcctatggtagtggtttatacagtattgggattatcggtacctgttgcgttcttttagcagaagttattggaaaatatctagatcagtttgcacttagacaaggtaaaggattctcctgctttattcaattagaaggaaatactgatgatttgcatgcacttattaatcagctaaacaaaaaatattttgaagttccgcttaaatactcgatctatgattatggagacggaaaaatctcctgtcaactttatggtgaattaagatctggcttcaaatcagaaaacatctttactgaccttactgagctgggcaacattaaaaaagttgagttagaataaaaacataggaagtgacaagatggcttataattttagaaaagagtagaaagaattgtatgtccccggaaagaatcccagcctaatcaatgtaccaatgatgaagtatcttgctgtgcggggacatggggatcctaatcaagaaaatagtgagtataaaaaagcaattgaaaagctctatgctgttgcttataccattaaaatgagcaaaaaaggcacctaccaaattccagattattttaattttgttgttcccccactagaaggactatggtggcaagatggtatcactggaattgactacaaagttctatttcattgcaatgattcgccttcccgactttgttactcaagatgtttttgaatgggcaattcagaaggctagcgaaaagaagcagctcgatttacataacgtagaattcctgtcaatgcaagaaggcctctgtgtgcaagtacttcatatcgggtcatacgatgatgaaccggcaacaatcgacaaaatacataaatttattgcggaacaaggtttacaagtagatattaacgatgatcggcatcaccatgaaatttatttgtcagatcctcgccgtaccaagatcgaaaatctaaaaacagtattacgaattccggtaaaaaacaattaaaaacactattaataggtgatcctctattagtagtgctttattttttgccttgaccggtgagtaaatactcactataatgaaataaaaaagtaagcatttactcaccaaacagaaatgagggaactaaatatggtagaccttattcaacttagtcacttgagtaagaaattcggtgaccgtaccattcttcatgatattaatttaaccgtcactcccggtgaaattgttgggttaattggaccctcgggttcgggaaagacgactgcaatcaagacaatgttaggaatggaaaaagctactcaaggaactgcacttgttcttggcaaaacgatgccaaatcgaaaagtacttagtaaaatcggctacatggcgcaatcggatgccttatacgaaagtctttcggctaaagagaaccttgaattctttggcaagatgaagggggtaactggcagaaaactctccgaagaaattatccatgtcagtaaagttgttaatcttcaaaattatctcaatcaacgcgttagtggttattctggagggatgaagcgacgactttcactggcaattgcgttgctcggacagccagaactattaattctcgatgaaccgactgtgggaattgatcctgctcttcgccgccaaatttggcaagaactccttaaactgcgtaatcaaggacagagtattcttatcactactcacgtcatggatgaaacggaacttaccgaccgagttgcgctacttttgcatggggatgtaattgcatttgcttctccaacagaactagaaaagcgatatggtgtaccaacgattgaagatgtctttctaaaagctgaggaggaagaagcatgagaaccctagcaatcactaaacgcgtcttaaaagaactatttcgtgacaaacgaaccttagcattgatgtttttagccccaatcttaattatgtggttaatgaacgtaatgttttctgctagttccaacactaacgttaatatttcaacagtaaatgtcagccagtctattgaacgtaaccttaaaaaagtggatggcgtatctgttacgcctagctcgattgaacacgcaagaaaaaagctaaaagataattctacagatgccatcatcgaatatgatcaagcaaaaaacaaatataatgtgacctatgcgaatactgactcaggaaaaacggtattaacaaaacaggcattgaatgctgcgattacaaaaactaccattagctcattagcaaatggtgttcagcaattacaaacaattgttaaaacgacaaatcctaatataccgattgcaacagctaattctggcaattcaccaacaatcagtaatcattaccaatatggcgatgccgacactggcttcttcgctaaaattgtccctattttgatgggattatttgttttctttttcgtctttttaatctctggaatggccttattaaaagagcggacttctggtactcttgaccgcttgcttgcaacgccggtaaaaagaagcgaaatcgtgtttggctacatgttaggttatgggatcatttcaattattcaatcgactgtaattgtcctagcaactgtttggcttctaaaagtagaagttgtcggaaatgtctttaacgtcattatcattagtgtgctcctagccctcgtcgcccttgctttcggaattttaatgtcaacccttgctaattctgaatttcagatgatgcagtttattccgttagttgttgtgccccaagttttcttctccggtatcattccgctcgactctatggcccactgggttcaatatattggaaagattctccccttaacctatactggagacgctcttacccaaattgtcatgtacggaaagggcttaacgagtcttggcggcgatattttagccttgcttatcttcctcgtcgttctactatggctaaatattattggtcttaaacggtatcgcaaagtataattttattaagaggtgaagcagatgtctcaagttctagcaaattatgaagaacaactcgccaatgctaaaatgcccgcggggaaaaagaaagtccttactactgcattaaagctttttgcaaataatggcttccatgctaccactacggccaaaatcgctaaacaagctggtgttagtgaaggaacaatttataaatatttttcttcaaaggatgatttactagccaagttattgcaacctattttgatggaaattaagaacaacttttttagcaatcttgatgataaaatagacttatcttcattaataagttttattgttactgaccgaattcattttattgaggtaaattttgattttattcgattaatctttcaagaaattctaacaggtcaattaacagataaatcgtatcaagatttctttagtggcaatgatggcgttcttgtcaaactcaaaaaattacaggcaaaatttcctgaaattaatccaaaattaaatccacctcaactcgctcgtatttttattggccctattctcacttatgtcttgcagaataagttattaggcctgccagtaaataacgatgatcttgacattattcaaaaacaaattttagcgaatttaacgcttaaatattaactaaaaaagcatcagaagttgtgacttaacgacttctgatgccttttatgctacaaatcaattatttcattcagtttatacttaaccttcatgttttcccagccatacttaccaaagcgttctttcatctctttaggcgtaaacaacttattgctatcaaatgatgcttcaatcatttaacgatcatgtttaatattttgttgtaattgttgggaattctctttcatctaaaacacctcaatattttttctacttaacatccctgttatattttcacttcaattcttcatatagtggggtaagttgcctaataactgaactgatgtattcctccatattattaacttggtcttttccacgaaatgcaaatttgccaagcaaaaaactggtctttcgtgcatcagaattaaattgctgctgagcatcccgactattgatgtatttagtcagtgacatatgatcagaaaattccatctcatccttatcccaaaggtaccagcgtgtggcatcaatatcattagcccattccggtattttatccagtaattgattgtattcatccggcgtcccttgtcgttgctcactcttataatgttgaaacattaggtagacctgtaactgctttttatcaagcatcaccccaatacaggaattatagtctgctaacgatgctaaacgataagaggcccagtaatgatcacgcaggttccagccgttcgtccaactctcaacgtgaaccttcgcgaattcgcccgttggtagttgactagcgacagtttgatttaccttcttccacacttgccaaacggctttaaacttctcttttaggtctgcaacttcttctggtgaatgattttccttaatcttcttaaaggaaaattctggctggtcaaagattacaaacatactttcagttaatgctgtcattttagctcgcccctttttatccaagaatatcataactaaaaaagctaaactatgactcttaatttacacgaatcataatttagctttatagcttcattaaaacaaattcagcatcaccatataaaagccagttccgaccaagatcgatagtggcatatttcttttccaaaggtgaataaataatgttactaagccggcaacgatttctaataatgccttactaggctcagcaaaagaaatattccgataacaatagattactaatactcccatgattgctgccggaaggaatttccccagttcttccaggtaaggtgataattcttttgactgatcaaaaatcaggaatgggataaagcgggtcgccatcgtgacgactgctgcgattaaaattgaaataatttgttcagttaatgtcattttttctcctcgtgattaagtaatttaatgaaaacagtgcgacaagtgttactaatgtcactaatagaaaaacattcttgttgcaaaatagtaaacaaataattgcaaatgctaaaccaatcagagcatcacgctgagttcgggcatttttcaactgttctgtaaacaacacaataaaaagtgccgtcattacaaaatctaagcctgctaagtttaagttaatcatcccccaaggagtccacctaaacctgccccagctacccaactaaaatagttgaatgcggttatgtaaaaataaacatatgagcgatcaaggctatctggtacttttaacgttgcatttaaggaaaaagactcatcacacattccaaaaataagaatcggctttaactttcctgtattggaatatttttttaacatcgtaatgccataaaaaatatgtcgtgaattaacaagggcagttaaaatgagaacagtcaatggctgaaaactctggactaaaagattaccaattacaaattcgactgatccagcaaaaatggtcgcggccattaataacggatataaaaaattaaagcccagtttatgcatatatatcccatagccggcgcctaaaaatagaaagccaagcattaccggactagttttttgaaaagcgtaacgtacttcctttctcatggacgaattctccctccttaaaataacttgaacttattttaaacaggagtattttatccatacaaggaattaattgtatggattacaatattggagtgataaagtatgcctattaatgatttttcccaccatcagcttacctggtatcctgacaaaaataagctgacgcgaccaatttataaaagtttgctcaatcaactaaaaacagcaattgagcgtggaattcttacacccggaacgaaactgcccccgcaacgcgaactcgccgattatctcgacattaatttcaccaccgttactcgtacttacaaattaagtgcgcaacttggtttaacttatggaattcatggtaaaggaacctttgttaactcaaatggtatcgatccgttaactgccaattctcctttgacccgtaccattgatcttggctttgttgcttcctttgaacagacaaaccacctccttgacaatattcttagcaacaccgtcaagcaaggcgcctcgcaacttctaacctatgactcaccaaccgggcgtccgattgataaggaggctttccagcattatcttgactggcttggcgtgagattaactcctactcagcatatccttattacagcgggaggagaaaactcacttacattactgttaatgaccttattttcaggtggcgataagattgctgtcgacgaatttacctatgccaacctgattgcaaccgcgcaactaaataatctccatttagttgcgataaaaaatgatcaaggcgggatgaatattgaagcattaaaacacgcttgtcaaaacaacaatctagctggcctgtatctcatgccggaatatagtaacccgactggcgctgttctctcgatggctcgccggaaagaaatcgcaaccattgcgcaagaatacggactgaaaataattgaagatgactacctaagttttcttagtaaactcaatccagaacggccgcccaaaataatggaattactaccagaccagacttgttatgtttgcagtatgtcaaaagttcttgcatcaggactccgtgttggttatctagttttcccggcacagctagcccagcaaattaaaaatggtttcttcaacacaacagtcaaaacgtcaactctcaatacagcaattgcatccacggcaataaaagagcatatcgtccaacaaataattcaaaataaagtcaaccttgccaaacaagctaatatcctttttgaacaatatttcccgactgctcctacaaaccaattaaccgactatgccttttttcgtcgattaccgcttaaaagtattcaaaatacagccaagatcgaacaagcccttgctaatataaatatccgttgttttggctctgatcgttttcaaattaacgcttcttcaaatgaccattttctccgtgtttcattgtccgcaaataagtcacttgatgagttagaaacaggcctaaaaagattacgcgagtttttacagaaagctaatttaatttaaaaagtgatgttaagaatttttcctagcatcacctttacttttttgtttagcttattttctaaccgcctcgtaaatcatcccatttcactacataactctcttccctgccatccaagtttcattcacgtggatatttttaagttcactatgagcaactgtaaagatatcatcatttaagataacaaagtccgcggcctttcctacttcaagcgtaccattttcatcaaagccaccaatttttgcaccatcccgagtataaccaagaatagcttgtggaaccgtaattgcttcttctgcgttaacaacatcacaattagcggcctttcttgttacagccgcataaatactataaaacgggctatcaggttctgcccatggcgtacatggggcatccgaactcaagcctaacattgcttgagaattcaacattgttttaacgcggtaagctaatttaaactgggctggtgaaagataatgacgataggattcatcttccgcaaagaaaaagattggttgcgtgactaacgcatagttcattttactattggcaatctctgcaaacatttgatcagtcattaaggatgcatgttcaatacgaaccgatggcattgtggttagccatggcgctatctcttttgttacatcaatcactgtttgaattgctttatcgcccatcgcatgcacagctagttgaagcttattatcacgcgccatctttactgctcgctgaagtttttccactaaagtcaaactaactcccatttttcccgatggataaggatcagtattataggccgtttcgccagaaatactcccatccataaatactttaattccagcaacgcggagtttttcatccccgcttggttgcagtccaacctgcggatcaatttcatcaaagacatagtagatcgaggctttcggaccaaacccttgcttaactgcatcttggtatagttttaaagaagtatatggcttcatccggcccatcatttcaccaattgccacaattccctctttaagatagtgttcggaactattaaccatattagctacgtcgttctcatagctctgtgccgatttagcccgaataagaagttgtgaggcagctatttcgcgcataaaaccagttggtcgtccatcagcaaatcgttcaattttcccaccaaccggatcaggcgtattttcatcaattcctgaaagctctaaggctttagaattgccgacagaagagtgacagtcagaacgataaataaagattggttgcgttgttgaaacagcatctaaatcatcacggttaggactccgatgttctgctaattttgtctcatcaaccccccacccttcaatcggtactgtaccctgtcaagtttacatactaaataataaaaattaattggctttgccgtaacgaaattccgttgcagtaaggtcatttcttttagctgaaataaatgtatttgtaaagtattcaattccttcagccactagtgtttgaagttcatcaagtgtttgtgacttagatgaatgcgctagccaaattgctttaaagtcggcccaccagtgctcgataactgcgttatctgctggtgtgccaggagctgaatagctatgttgactattattgctagttaaatattgattgaacgccttagaagtataagcagctccgcgatcagtatgaataagtggggctaatacaccttcttgtttctgagctttcttgaatacttgaattgctccctcgctagtttctgttggggtaattagccagctaattggaaattgaccatataaatcaagaaccacatgtaaacgaactttataattatgaatattgtaggcgagttctgttgtatcagttacccaaacctgattagctgcttcctgtttaaattgacgattaagtatattttcagcttgataggtttgacgttccttgtcgcgttttcttttagcttgacgatagtcagctttaatcccatgttccttcataattctaataactcgttttttgttgaccaaatatccaagacctgcgcgcttaataagacgagtcattttcccatagccaatactttgcttattagttttctcaatttctttaatcacgcggtttgtaaaattaagttagaaaaataaaaagccatttgtggtagacttttgaatacccatacatcaaaagaaaggacaccacaaatgacctaccatcatcttaccatagacgaactaacgatgatcgctaattttcgtgaccaaggagtaaaagcctaccgggccgccaaacttttgcaccggagcttagaaaccgtctaccgagtttatcgctttctggccgccggccacacgctccaagaatattaccaacactatcgtgaaaacaaggctcattgcggtcggaaggctattcaattgcccactgatgaggtaacttatatcaaagccaaagtggctcaaggctagacgccagacacaattatgggacgcgctgaacggccactcagctgtagtatgcggacactttaccgccttttcgagcggggcaattttgatgtgcggaccttgccgatgaaaggcaagcgtcgccccaatggttacgtagaatggcggggggaaggccggtcaacttggccaaagcattcaccaacgggctatcgactttcccaactttaaccgtgaattcggccaccttgaagccgacaccgtccagggcaaaggacatcagggcgccgttatgactttggtagaacggacttccaaagtcgaagtgattcttaacgtccatagtaagacggccaccagtgtgatccagcacttacaggaatggttggcaaagtttccaccccacttcttcaagtcgattaccttcgacaatgggaaggagttcgctgactggcgagcaattgccaaccaatttgacctccagacctactttgccgaggtgggggcacctaaccaacgggggttaaacgagaacaacaacggccttctgcggcgcgatgggctccacaaaggccgcgatctccgccacctagctgatgaagaggttgctcaaataatgagttaccggaacaacattcctcgcaagtcattgggctatcaaacaccttacgaggtattcatgaagtatgtcactgatgagcaactactttttttctaacttaaattgacatttcgggataaaaaagaggttagagcttaaaattgctcaacctcgtaaagtttgttactcattaaaatgcctgctcatcatataaagggatcgcatttgaccatttatttcagaaatctgtggtaatttacctcattctttgtacccacaggaggtaaaaagatgatagcttgcttgattttcaatataaatatatgcaattacggttcttatatctagatgatcttcaatttgtttttgcgcatatattaataaatcacggccaagatgttgctgtcgataatcttcataaatataaatagctatctgtgccgaatgatcataggcgagatgcggataaaaatactcaagagcacaccaggcgattacttggtcatccattgttgcaacccagattggatgagtattgtcaaactgcataaatcattcacgtcgatcagcaacttcgatcggtgcactctcatcgttgacttgcagcggaattgcttgattaaatatatcgacaatcgctggtagatcatttattgttgctaacctaatttggtaatccatatcaaagcttccttacagtatttttacccactaattattacttatcatagaagtgctgccattctttattaacgttttcgcgagtcgtctttgtcccagtccatgatggaacttttacaaccccatcaatcttactcttaggtacaaatccccagtaacgaccatcgtttgaaacgctccggtgatccccaagaacaaagtattcacctttcggaacttttgtggcaccattattctttaaccaactgttctgaactgagatactacgcagtgtccagtttccagttccggttgttcgttgactcttgctaatgtagtcttgattaatctttttgccgttaacataaatgtttccattcttagagctaacagtatcaccagggagtccaattactcgcttaacataatcggttttaactgatacttgcggatcaatgccattagcatcaaatacaacgacacttccatgatggattttggcagttttcaaacaaaatactcgttcattattttgtaagtttggttgcatggatggtccatcaacccgaacaatttggaagaaaaactgcttaattactaatgcgattattaacccgattagaatgggaataatccaactcattgcttcacgaaatgctttcattataattcctcaatttctttatttaactgttattaatcatacaactagtaataaaacctgaaaagttatttataataaataatatattattttcacatttaataacatcaaaaagatattaaggttcaaagggagcgagacaaaaggcacttgtgacttcgttttcgagccccgcaagcaacaataggcctctaaggttcggttttgccggacgttagaggcctattgttgtactgcgtatttgctttttatgaaagtaacttaacttatgtcacagtcccttttaatttttatttcttttcgacaaagtacttttcgaagttcttttgatagttatgattaatccgttgttccattaaccaccgcatgaaattcatgtccttgtcataatggaaagttgttccatagcggccttctttaataagcttctcagcctgctttttaatttcattatttttagcatactgaaggaaggtcttttttgaaacccccagccataacttatagttgctttcatctttgtttccataaatcgtctcttgatcttttaagctatcaaaaacgtaatcttcaacggggaaagtagcaagttgatagccatttaatgaaacgaagaaactactacgaccttggcgaggattgaggtcaaataccttgaattggccatcacgacggtcatatttcaaatcaaagttaacaaatccagtaaattcaatactttcaaggaaattcttgatattgtcatagatttgttgatcatatgctggcataatcgcaacgtaattaccaacatttgctggattgcaatcttcaagtagcgggtgaccgagacacatcatctttaccttatgatctttatcaacgtaacaattgatggtccgcatattactatcatcaccagggataaattcttgtaaaacgaggtcgccattgtatggactatgctcatagataatctcaagaacttccgctaatctttctggtgtcttaataatataagccttttcatacccttcaaagtttcccttatgccattgcaccgcatcagcagccttcaaagcaattggaaattcaaatggtgatttatagttcttataatcaaggtctggttttaaaatatcggttttagggtaaggcaaaccatacttttcgcagacattgtagaacttctctttatccgttaatgttgctacttcatcataatcagcatacgggcagaacatgtgctgcgaaagttctttacgatttttcgcaactaattcagtatagtcatctccacaactaattaaaacggtcttcttgccttgcttagcaaactcatctgccgctttaattaataccttcgtaaacaattccggtgattgtaattgttcattataatgcaactcgacaatttttgaataacgggttggtgccaatggttggcgagcatataattgcgacttaatcccatatttttcatacatcgaccgcgccattccgtaagcattgaaatcactacctagaatcaatggaacaaaaggttgttcactcattagattcccactcctctttatctttctaaatcattaatataatcacgtgcaatcttcacatcagttaggtaagggacatcttcaccattaatcttctggtaaggatcttcacccttccctgcaaggactacaatatcatcatttccactaccgtcaattgcctttttgatcgccgtttcgcggtccatttcaaattgaatatgtttaaccttatcatgatcaatataagaatctatttcccgggcaatagtcatcggatcttcaaacccgggatcatcagtcgtcaaaattacctcatctggttgttcttcagttaaagcttttccaaaccctggacggcgcgaaatgcctttatcaccggttgctcctaagacaactgttactttaccagcattagtttgtcgttttaagaatgccaagagtcgcttcaagctagcgtaattatgggcataatcaacataaattgttccatgagtattactgttaatcatttccattcgaccacggatgtgaacatgattcaatgtttctacagcatcgttagcactcgccccagctaacccactggcaatgattgcagcgaccgcatttccttcattataatctccagggacactcgttttataacggccatctaagttcaactgctttgctttctcagttaaggcggtcaactcaaattcactttcatgaagatcttctaaatcatttcgatattcaaaatctatttgggcattgtcaggtaattcgatgtttgctcctcgccgtgcaaataagaaaatgtcttctggttgtgtggttgccttagcagtgtaataaacatcagtaaacttttcagtttctgcattgattaagcatttagcagaatttactaataattgttccttacagtgaagataatcagcaaaagttgggtgctcatttcgtccgatatgatctggcgagatgtttaagaaaattccaacatcatactttaaaccataaatccggtttttcttgtatgcttgcgatgatacttccattactaagtgcgtcattccattatcaacggcagcgcgcatatcatggaaaaggtctaaggattcaggagtagtcaaatcagatttaaattcatcttccggcttattgcctaaaatccgatcaagcgttgaaaaaagggcaatatgattagcagtactttgggctaaaatatggtcagcaaaataagccgttgttgttttgccttttgttcctgtaattgcaataatgaacaaatcattttgtggatagtcataaaatgctgcccccagtaaagacattgctttttgttcgtcgttcacgataatagctggcaatccttcgccttctggatattctttttcagccacatacgcaatcgcacctttttctttagcggatgctaggtatttaggcaaaaaatttcctttacaaaagaataaagttcctgattttaccttccgtgaatcataggacacgctagttgcggtaaaatcagtcaaattactaacatgatccaataaatggtgctcgcacaataatgctaaagcaggtgtaatatgcaattccatcttgcaaatgactctccttcaatctaatctgccctatattatttcattttttatcataaaaataaataagggttatcaattaacaaaaaaggagacttagaagagtcctacccttcgccagcctcctttaatatttttctatacttctgttgtagccgctttttgtgcgcggtcaattcccgattcatcaggtttgaagttatcaatgaaatataacttataccacgttaagaaggtgtagattgtccaaatcttacgacgaccatccaccttgccttcgaagttatcatcggcaagttttagaagcttttcttgatcaaagaactcttttacgaagtcttgttcaaataattcacgtacttcttggtaatacttcttttctcgaagccatgcacggactggagttgggaagcccatcttaggccgcgtagcccattcttccggtaaatgccgattagcagccatccggaatgcccactttgtatccttatagttaaagaggtacttagttggtgtcgtttcagctactttcattacctctttgtcaagaagtggtacccggatttcaacagagttagccatactcatcttatctgcctttaaacaaatatcgccaggcatgaaacggtgtaagtcaacatattgcttctttgcgacttcatcgatatctttatcttccatcttatcaaaaagtggattaagaatgtcggcaatacttggtccgcaatcaaattctggttgcaagtagtcagcggcttcttcaggactaaagatgtatgcttgaccaataaaagtatcccgtgctggcgctaagttgcgatacatatgctcttggccgtggaagtgtttcccatctaaccacttagcaaacttataccgacgttcacgaggcatcttctttaattgatcagttacccaacggataaatttaactttcgtattaaaaccataatcaatgtatcccgcaaacaattcatcggcaccttcacctgaaagaagggccttgtagccgttatcctttgctaacttgttcaagaagtataaaggaacaacagatgggttagaatcgggttcatctaggtagtattgaatcattgggaatgcgtggaaagcttcttcgttagtcaacttttcatcagtattcttcaagcccatcttagctgctaattcacgtgcttgtttggtctcatcgtaagtactatcaaatccgattgagaacgtattatctggacgcatcaaagccgttactaaacttgaatcaacccctgcggaaaggaatgagccaaccttaattcctttatctgcaaaggtatgtgccttaacagaattcttaacaacttcgtcaatcttgttaacagcttcatcaaacgtctcgtcttctggctcaaagttttcgtcccagtattgggtcatttcaaactgaccgtctttataagtgaagtaatgcccctctggaagacggtaaacacccttaaagaaagtttcttgagtaactgggtattggaatgtcatgtatggtttaagcgcttctttattaagttccttcttaaagttaggatgatcaagaaatgccttaatttcagacccaacaaagaaagtaccgttcattttagcgtaatacaatggtttaattccaaaatggtcacgggcaccgaacatttctttagtcttaaaatcccagataacaaagccaaacattccgcgcagcttgttaacaacatccttgccccattcttcatatccgtgcaagattacttcagtatcggcatgtgtcttaaatgtgtgacccttactgattaattcttcacgtaattcttcaaaattgtaaatttcaccgttgaattcaatggcttttgagctatcttcattaaagattggttgattaccagacttaacatcaataaaactcaagcgccggaagccaagtgctacatcatcatccacatattgaccttccgcatcaggtccccggtgaataatccggtccttcattttttggattaattggtctttaatttgtggtttttcattatcaacaaatgcaacaatcccacacattataaatttcctcttctttctcttaaattcacggatcacaaaatagttatttaaaattcgttattaaaacttgaacctagattataccatataatgccaaacttaagtatattatccatttgctttaagaaaatcataataaaatctggagagcggagtcattactctgtttctccagattttatttcccaggaaattttatttacgatccttcttggaaaacttcccctgacggacgtaaacacttaagattgcaatatcagcggggttaactccactaattcgtgaagcttgggctaaagtttctggacgaatcttttcaagcttttgacgtccttcagttgctagaccatcaatatcaccataatcgatatcatctggaatccgtttagcttccatccgtttcatccgttcaaccttaacttcctctttcttgatgtaaccagcatatttcaattgaatttcaacctgctcaatcacatgacgatcaagttcctgttctggtgctggaatgaattcggccaacgtttgataatcgaagtatggtcgcttcaagaggtcagctgccgcaattccatcttttaagcgattatccccgtgtgcttcaataaattcgttaaccttatcatcgcttggcttgagcttaatttcttctaatcgtttgatttcagctgcgacttggcgcttcttctcttccattttagcaagccgctcatcactaactaggccaacattatgacccatttccattaaccggaaatcagcattatcatgacgtaaaattagccgatattctgcccgacttgtaagtaaacggtaaggttctttcgttccctttgttactaggtcgtcgatcatcacaccaatatatgcatccgaacgcttaaggacaaatggttccttgccttgtgcccgtaatcctgcattaatccctgcaattaatccttgccccgctgcttcttcataacctgaagaaccgtttgtttggcctgcagtatagagattcttaatgatcttggtttccaaggttgggtgaagttggtacggcgcaactacatcgtattcaattgcatatccaggacgcatcatttctgcattttctaaccccttaattgagtgtacaatcttttgttggatttcttctggcattgatgtcgaaattccgtcaaggtaatattcatccgtatcccggccttctggttcaaggaaaacttggtgccgcggtttatcagcaaaacgaacaatcttatcttcaattgaaggacagtagcgtggcccaacacccttgataacaccagagaacattggagcccggctaagattttcccgaataatggcatgggtcccttcatttgtataagttaaccaacaagataattgttcgctaattggaatataggcactatcaggagtatcaaaactaaagtgatgtggttcctcatccccgggttgttcttccgttacactatagtcgattgtctttccattaacccgtggtggcgttcccgtcttaaaacgctcaagatcaaagccaagttcttcaaggttttccgaaagttttaccgctgacttagagttatttggaccagattcatactgtaattcaccaataatgatctttccgcgcgctgcagttccaacagttagtacaaccgtcttagcgtggtaacgagctcctgtattagtaataacacctttgcagacaccatcttcaacaattaactggtcaacagttgcttgacggagagtaaggttaggttcttcctcaattgtctgcttcattgcacggtgataagcatgtttatctgcttgagctcgtaatgcacggacagcgggacccttaccggtatttaacatccgcatttgaacataggtcttatcaatgttatggcccatttcaccaccaagagcatcaatttcgcggaccacgattccttttgccggaccaccaacagaggggttacatggcataaaagcaaccatttcaagattaattgttaccaacaaggtcttatttcccatccgggctgcggcaagggcggcctcgcttccggcatgacccgccccgacaataattacatcgtatgatcccgcttcgtattgaacggcatcagatgtttgcaatgcttctgaactcttcattcttctattccctactttcctaaacagaattgactaaataactggtcaagcaactcatcttggtaactatccccagtaatttcacctaataattcccaacaccgggtcatatcaatttgaaccaggtctaccggcattccatcattaattccttttaagacatcgcttaaagcatcattagcttggtgaagtaagccaatgtgccgagcatttgtaaccattacattattctggttgctttcaatccccttgttgaagaacatgtgaccaatctgttcaccaagttgatccattccttcatgattaacgattgaagtttcaataacagcactcttaccagctagtgatttcaattcctctaaatcaaccttgcgtggaagatccgtcttatttaagatgatgatccgctgcttatccttggttgcttcaagtaattggcgatcctcgtcagttaattcatttgaactatcaatcaagagaagtactaagtcagcggcgcccaaagctttgcgactccgctctaccccgatcttttcaacttggtcatttgtatcgcggattcctgctgtatcaattaacttcaatggcaccccgttgacattgacatattcttcaattacgtcccgggttgtcccagcaacgtttgtaacgatcgccttgtcttcgtgaagcaaggaattcaataagcttgatttaccaacatttggctgcccgatgatagccgttgctaaaccatctcgcaaaatctttccttgcttagctgttttaagaaggccttggattcgttgttgaatgtcctctgctttttcttttaagagtttcgtcgtcatttcttcaacagcatcatattctggataatcaatattaacctctacctgtgccaatacatccaaaatgtcttgtcgcaaattacgaattaaccgcgacaaatcaccatcaagttggtttaatgcaaccttcatcgatttatctgtctttgcacgaattagatccattactgcttctgattgggataaatcgagacgaccatttaagaaggctcgtttagtaaattcacctggttctgccatccgggcgccaaagctcagtaccaattgcagaatacggttagttgctaacaatcccccgtgacagttaatttcaatcacgtcttcacgcgtataagtgtgaggcgcgcgcattactgaaaccatcacttcatcaacttcctggtccgtatcagggtcaacaatatgaccatagttaatggtatgagttgctactttggcgagatcttttcctttgtagatccgttgagcaactttcaccgcatcatccccactaattcggataatggaaattccaccttcaccaaccggtgtcgaaattgctgcaatcgtatcattctcgctatttgccatcgctactttactcctttctaacaaaaaaagtgctagtccatgcatagtaataaaaatatcactaacatggtcaaagcactttcactactttaacgaatattaaatttataaccgctcatattctaagatcattaccagaaattgtcaacaaataagttagtccttaggcgcaatcacgatactccggtaaggttcccgaccgtgggagtatgtttttacgtggtgattattctcaagttcatggtgaatttgtttccgttcgcgggcgggcatcgggtccataaaaactgctttcccacttgcaactacttccatcgccgccttttgcgctaggttgtgaactgcttcttgacgccgttcacgataattggaagtatcaagttcaacatttacttttgccgctccatgataatccatgaatatattactaagctgttccatcgagttgatccggcgaccgtgcttaccgatcacccgtccattttcctcagtttggagattaattttgagatcatgagcttctaaattaataatccgcggttcaacagcaatacctaattccttaaatactgtcgttagatattcaaccaattctttactagttgcttgaacctttttaagattggcctgttgccgccgcttgatttcagtagggtcgagctcatcttcagctaaatttaagcttgcaggcttttgttctggctcttttgccagttgctcatctttttcttccagtgagggcatcgcaatttctttatcttttattactgcatccacttgcgcttggcgtcgtccaattcctagaaaaccgtgccgcggctgttgaagaaccctaaattcaattgtctgattaacagttggcttcaattgtgtacgggccttttcttttgcttcttcaattgttgttccagtaaaaactgccatttttatcccccgtgaatttaattaatttccactctttaaatttattactaaataaaaaggctcgcaacaactttacttgtcacagccttaataacttatttccgccgactttggtaagcgcgacgttttgctttttcaatcttgcgacgttttgctttttcagcccgttgcttttcttcacgttcacgacgaatcttaaatggattctggatgataagcgtttggacaacttggaaggcatttgttactacccagtataaggtaatagctgaagagaatcccaatgccatgaagaataccataatcggcataaaccacgtcattgtagttgtcattgagtttttttcgggcattgaagccatggataaccatgaactaataaatgtaaataatgccgctagaataggcataatgtagtatgggtccgggtgacctaactgaagccacaagaaagttccattccgtaaggctgaggtccgccagattgcttgataaagagcccacataactggtagctgaaccagtaacggaagcatcgaagcccatggattaactcctgcttctttatagagcttctgcgtctccatttgcatcttttgcattgactcgcgatcacgtgatgagtattttttctgaattgcctttaattgaggagcaagttcttgcgtcttcatcatggtctttgtttggtagaacatcaatggcagtaagatgatccggatgatgatcgtaaagataatgatccccattccatatccgccaaagtgctttgataaccaaatgataaattgtgaacagttatagataatgtagtggtcccagataccagtactatgactagtaattggcttattggagcaagcagctaaaaatagggtcaagctcatgattgctcccaagcttaggaatttttttgttttcttattcaaatcctaatcctcacttttttcatctaacaaatgtgctcgctttaaaacgtgcactaggtttttctttgtttctgccattgataaaccatctgccgctgaccgagcaataaccaagaaatcaacatcagaccgtaattgcggtttcacctctaataatgtttgacgaatacgccgcttaacccaattacgatgcacagcatttccaatcttttttccaacagaaataccgacacgaaaatgtttttgtcctggcttttccatttgatatacgacaaatttgtggttggccacggaattatgggtttcaaaaacccgttgaaactcactttccttttttacgcgatatgattttctcatttgtataatccccagccttaatttaagtagatataaaaatagggccgggcatacgacaactttaacgattcaaattgctcgtcaagctgactgccctgccccacacaataaaaaaagccactataaaagtggccgtggttatgcagataatacttttctgcccttttgacgccgacgtgctaataccttacggccgttactggtgctcatgcgcttacggaagccatggacacgtgcacggtgacgcttctttggttgaaacgtgcgcttcatacaattgcacctcctattaaattcgagtggtttggtttctagagtctaaaagacgatctcttcaaacatactttggtagtataacacacttaccgaaattaataaacggcgaatttttatttaaatttttttgattattaacaaaattagcaaaataatccacagcgttgtgtaaattcataatttgtggacaagttatcaacaatgtttttcagagattatccccagattcacacatgttgataaagttatccacaagtggtctttcaggtgttgataactctctattttactgctatatcaatagtatatatcaacacaattctgtggataagtgataatggaatctccttttccccatttttcacagcaatattattaatttacacacagtgttgtgtaaacttttttattattatccacttggttgtggaaaactttcccatgtaatgataaaataccgtttgtaatttaatactttaggaggaaattattttgactgagctcgattctctgtgggaagcgatccaaaattcatttcgtcaggataccactccggttacctttgacactttgattgctccggcaaaagcaatttctctctctcaaaatcaactggaaatcgaggtgcccactccggtgcatcgcgatttttggcgcaaaaatttaaatacacagcttaaagaattcgctcaacatgaattgggacgtaatattgagccgcattatattttagagggagaatttacctatacaaataaaaaaacagaagatgatccaactccttcttttgagatggacactcctcttaatcctcattacaactttggaacattcgttgttggagaaggaaataaaatggcacacgctgcagcatttgccgttgccgaaagtccgggcagcctttacaacccgctctttatttatggaggggttggtttaggaaaaacccacttaatggaagcgatcggtaaccatatgcttcaagttaatccaaattcgcgtgtcaaatatgtgacgagtgaggattttaccaacgattatattaatgctattcgtaataatacgactgaacaattaagagaagaatatcgtaaccttgatctcctattaattgatgatattcaatttttagccaacaaagagggaacacagctagaatttttcaatacttttaatgcccttcatgatcgcaaaaaacaaattgttatgacatctgatcggattccaaatgagattcccgaactgcaagaccggcttgtatcacgtttcagatggggacttactgtcgaaatcactcctcctgacttagagacgagaattgccatcttgcggagtaaagttgaggaagatcatattgatattggaaacgacacccttaattatatcgctggccaaatcgatacaaatattcgtgaactagaaggagccttaacaaaggttcaagcatttgctaatttaagcggtgagcgaatcacgccaagcttagcatctcaagcattaaagggacttcaccgcgtagccaaaaacgaaatatcaatcgctacaattcaaaaacaagtcgctgatttttataatataactcaaggagatatccttggtaaaaagcgagttaaacaaattgttatgcctcgccaaatcgctatgtatctttctcgagaactcaccgattcctcgttgccaaaaatcggcaacgaattcggcggcaaagaccataccaccgttttacatgctatcgacaaaatcgaggcagaactaaaaaaggatactgacttacaaaacgatattacaaaattaaaagctaaactacgatcataagctgtggataagtataataattatcctcaaacttatccacaagttatcaacaggtggataactcgcaataaagatgtttaaatagttttccacagtattaacaggccctactactacgactatattttaaactattaaatatatttatatacttatacaaaaggactgaaacatatgaattttacaattaaccgatctgcattcattagtcaactaaataatgtcttacgtgccatttcatctaaaaccacaattccaattcttactggattaaagatggtcgtaaacgaagacaacattgtgttaactggtagcaattctgacatcactattgaaagtgttattaatgctaatgatgctgagaacgatttaacaattgaagccactggcgctattgtattaccagcccgcttcttcagtgatattgttaaaaagctgccagacaaaaaagtaactattgaagttacaagtggttttcaagcagatattacttccggttcagctaagtttcaaattaatggccaagatgctgaaaactttcctcatttaccagaaattgaaactaacaaatcagtaacccttcctaacgacatccttaaagaagtaattcgtcaaactgttattgcggtatctaagcaagaaagtcgcccaatccttgccggggtgcatatgacgttaaaagatggcgtcctaacagctgttgcaacagatagtcatcgacttgcacaacggaaagtggtcctcgaaaacatcgataacagcatagattttgatgtgattattcctggaaagagcatggaagaactttctggaatgattagcgatgtccatgaagatgtacaaatgcaagtaaccgaaaatcaagtattgtttatttttggtaatactcatttctattcgcgattactagaagggaactatcctgaaacaagccagttaattccacaaactgctgatacaacagttgaactagaagctgggacatttctatcatcaattgagcgtgcttcgcttttatctcatgaaagccgtaatgatgtggttaagttaagtctaaagccatcagaaagtgttgtccgaattagtggtgattctccagatatcggtaccgttgaagaaaaggtagtcacgtctgctcttgatggtaatgatcttgaaatctcgttcaatcctaactacatgaaagatgctttgcgttcttttggtcaggcaacgatcaagatttcatttacttcaccattgcgaccatttaccttggtgccaacagaagatcaagaaaactttgtccacttaattacaccagtacggacattctaagaaaggtcttatataagttttataaaaaagagactacagaacgttttgttttgtaacctcttttttatttgccatagattaaattttattagtattgctagtttatattcagatttttgaccatagagcaaatttaaccgaattttgataaaaaaggctaaaataagttaatgcgctcagaaaggctaataacgcaaaattaaatcaaataatgtggtataataaaattacaaaagtaggtgaaaaaaatggaagaaaagtcagtgttgattgatagtccatttattacactcggccagttactcaaagaagaggggattattcctactggcggagcagctaaatggtttctaaaagaaaatactgtattagtaaatgatgagccagatgatcggcgaggacgcaaattgtatcccgaagataagattcaaattcctgaccaccaattacttgttattaagggtaagtagggataagcatgattctgacggaattgcatttacatcactttcgaaattatcaggatctaaccgttcacttcaaccctggagtgaacgttttaattggtcataatgcacagggtaaaacgaatatgctagaggcaatctatgttctttccctgaccaagagtcatcgaacaagtaatgaccatgaacttattaattggcaagaaaaatcagctctaataagtggcacagtagagaaaagtattggcaagattccacttgaattacaattctcaagtaaaggaaaaaaggcaaaggtaaatcatttagaacaagcgcgattatcacagtatgttggtcaactaaatgcaatattatttgctcctgaggacttgtcgttggtaaaagggtccccagctttacggcgccactttatggatcgagaatttagccagatgagtagcaagtacctctacaatgcaggccaataccgcacactcttacgacaaaaaaacaaatatttaaagcaactaaaatataagcaacaaactgatcgcgtccttttaggagtcctatctgatcagcttgctgcttttggtgcggaagtaattattgcccgtcaacattttttaaagcaccttgaaggatgggcagctgatttacatcaagagatttcactgaataaggaatcattacagcttgaatacgttaatcaattaaaggttaatgatgagactactgctgaagaggcttatcaggccctttttaaattatatcaagactacgaacagcgtgaaattgagcaggggacaacaatttacggcccccatcgtgatgatatccgctttctggtaaatgataaaaatgtacaggcttttggatcgcaaggacaacagcgaacgacagcactatcagtaaagctagcagagattgatttgatgaaagagcaaacaggcgagtatccattattattattggacgatgtgttatcggaactagatacaattcgacaaacacacctgttaacagccattcagaataaagttcaaacatttttgacgacaactagtttgagtgatgttgctcgccagctaattaatgaacccacgatttttgaaattgagcacggcactttgaataaggaggaagtaaagtgagcaacgaacaacaaaaagaaaccaagatggaattggctagcgaatacgatgctagtcaaattcaggttttaaagggattggatgcagttcgaaagcgtcccggaatgtacattggttccacttcagcccagggacttcatcaccttgtttgggaaattgtcgataacggaattgatgaagccttagcaggattctgtgatgaaattaatgttgtagttaatccagataacagtattactgttaaggataatggtcgtggaattccaattgatacgcaaaaagaaactggaaagtcagccttagaaacggtctttactgttctgcacgccggaggaaaatttggcggcggcggatataaggtttctggaggtcttcacggggtaggggcttctgttgtaaatgccttatctactgaattagatgttaaagttgctcgtcaaggtaaacgttactacatggattttgatcatggtcatgttaagtctgcaatgaaggtaattgaagaaggacttccagaaactgagcatggtacaaccgttcactttaagccggatccagaaattttccgtgaaacaacgacttacaatattaaaactttaactgatcgtttaagagagttagctttcttaaataagggacttaaaatcacgatcgaagacttacgagaaacagatcatgaacggaaagaattccattatgaaggtggtattcgtcattatgttgaataccttaatgaagatcaaaatgttttatttgatccaccaatttacgtggaaggtaaagaaaatgatattactgttgaagtttccttacaatatacagattcatatcgtagcaacttactaacttttactaacaatattcatacttatgaaggtggaactcatgagaccggatttaagatggctcttacacgcgttattaatgactacggccacaaagcaggtgttttaaagtcgaatgagaccttatcaggagatgacgtacgggaaggtttaactgctgttgtctccattaagcaccctgatccgcaattcgagggacagactaagactaagttaggaaattcagatgcacgaacagcgactgaccatgtctttgcggcaacatttaaccgattcttattagaacacccagacgaagcgcggcaaattattgaaaaaggtcaactcgcttccaaagcaagagtggctgctaaacgggcacgggaagttactcgtaaaaagagtggtcttgaaattagcaatttgccaggtaagttagctgataacaccagtaaggatcctgaaatttcagaattatttattgtcgaaggggattctgccggtggatcagcaaagcagggacgttctcgactcacccaggcaatccttccaattcgaggaaagatcttgaatgttgaaaaagcaacccttgatcgagttctagctaatgacgaaattcgttctctatttaccgctcttggaacaggttttggggatgactttgatattacaaaggctaattaccataaattgattatcatgactgatgcggatgtcgatggtgcccacattcggacattactgttaaccttgttctaccgctttatgaaaccaatgattacgcatgggtatgtttatattgcccaaccgccgctatatcaagttcggcaaggtaaatttgtaaaatacattgactctgatgaagaactagagcaggttgtaagctcactgcagccaagtcctaagccagttattcagcgttacaaagggctaggtgaaatggatgctgagcaattatgggaaacaacaatggacccagaaaatcggcacctattacgagtaaaactagacgacgcagaacaggctgataagattttcccaatgctaatgggaaccaaggtcggaccacggcgcgactttattgagcaaaatgctaagttcgttgaaaaccttgacctgtaattaactgttgtttactgctaacgcaaaaaaggaggaacgacattggctgaacaagatatgcctaatcggatcacggatgtaaatcttacgagtcagatgaaaaactcattcttggattatgcaatgagtgttattgtttcacgtgcgcttccagacgtccgtgatggattaaaaccggtacaacgccggattctatatggaatgaatgaattaggggttactcccgataagccttacaagaagtcagcccggattgtcggggatgtaatgggtaagttccacccacatggtgactcttcaatttatgaaggacttgtgcggatggctcaagactttagttatcgttacatgcttgttgatggtcacggtaacttcgggtcagttgatggtgatggagcggccgccatgcgttatactgaagcaaagatgagcaaaattgcagttgaaatgcttcgggatatcaataaaaataccgttgatttccatgataactatgatggtactgaaaaagaaccggatgtattaccagctcgttttcctaatttattagttaacggtgcctcagggattgccgtggggatggctactaatattccaacccataatttaggtgaggtgattaatggcctgcatatgttaatgaataaccctgatattacaacggaaggactaatgaaggctattcctggtcccgactttccaactggtggagtagtaatgggtaagtccggtattcgtaaagcttatgaaaccggtcggggaactattattgttcgagcaaaagttgatattgaagaacagaagaatggtaagcaacggatcattgttcacgaaattccatacatggttaataaggcaaagttaattgaacgaattgctgaattagctcggaataaagatattgatggaattactgatgttaacgatgaaactgaccgtgacggaatgcgaatcgtaattgatgttcgtcgtgatgccagtgctgaagttatcttgaataatctttacaagatgaccttgatgcaaacaacttttaacttcaatatgctagcaattgttaatggggctccaaagattttaagcttgaaacaaatcttgcaatattatctggaacaccaggaatcagttgtacggcggcgaacggaatttgaattaaagaaagcccagaatcgtgcgcacattgttgccggattgcggattgctttagaccatattgatgagataattaatattattcgtaattcacaaacaagtgaagtagcgaaaaatgagttgatgaataattatggtttatcagatcgacaggctcaagctatcctcgatatgcggttagttcggttgaccggtctagaacgggaaaagatagaggatgaataccaaaaattaatggcagcaattgctgattacaaggatattcttgctcatcgtgaacggatcaatcaaatcatttatgacgaattgatggaaattcaaaaacgttttggagatgaacggcggactgaacttcaagttggtgatattaccaatattgaagatgaagacttaattgaagaagaagatattatcgttgccttgacccacaatggatacattaaacgtcttccagttgatgaatttaagtctcagcatcgtgggggtcgtggtgttaagggaatgggagttcataaagatgattttattgaacaactaatttctagctcaactcatgatatgttgctcttctttactaattcaggaaaagtatactcaatgaaagggtatgaagttcctgaatatggtcgggctgcgcagggaattccaattattaacctgcttggaattaataataaagagaagattagcgctgttatcaatgtttcacatgaaactaacgatgatgataaatacctcttctttactactaagctaggaacagttaaacggacagcagtaacagagtttaagaatattcgaagtaatggattaaaggcgcttaatctccatgaaaacgatgaattgattgatgtagaagttattagtgaagatcagccaatgattattggtactcataatggatatgctcttagctttaaatcatcagttgttcggtcaatgggacgaagcgcggctggagttcgtgggattcgtttacgagatgaagactacgtaattggcgctgcccctcttaattctgatagcaaggtacttgtaattagtgaaaatggttttggaaagcaaactcctgcttctgaatacccaatcaaaggccggggcggattaggagttaagacagttaatgttactgcaaagaatggcccgctggttggtttaacgactgtcaatggtgatgaagatatcatgttagtgactgaccagggagtaattattcgttttggcattgaaagtgtatcgcaaactggacgatctgcggttggtgttcacttaattaagatggataatggtgcccgtgttgctacgattgcaaaggtggataaagaagtcgatgaggagactgaagaagtaactaataattcctcacaagaagaaaatcaaccaacagaaaattaaaaaaataaagtgagaaagtagatattttacgtatatatagttatagtgaccgcaacatttaggatttcttgttagatgttccttgttttaaatagaattttatgctatattttatgtctgtgagtatacgtaatgacgtctactttccttgttcttctcaaatagcgagaagagccagagtccataaggaggtgtaacattcatggaaacacgcaaatatgaaattacttacatcattcgtcctgatatcgaagaatctgcaaagagcgaattggtagaccgattcgacaagatcttggcggacaatggtgcaactatcgctgactcaaaggattggtcaactcgtcgttttgcttacccaatcgctaagtacactgaaggtacttaccacgtggtaaacttaactactgattcagaccaagctttaaacgaatttgatcgtttagctaagttcagtgatgatatcctacgtcacatgattgttaagcttgatgcttaattaatttgtcaataaagtaaagagaggagaaagatctatgcttaatcgtgcagtcttaactgggcgtttaacaagagatcccgagttgcggtacacaaccagcgggacggctgttgtttcatttacgttagctgttgatcggcaattccgaaaccaaaatggtgatcgtgatgctgactttatcaattgcgttatttggcgtaaatccgctgaaaactttagtaactttacgcataagggttcacttgttggaattgaagggcgtattcaaacccggaattatgaaaaccaacagggtaaccgtgtatatgttaccgaagttgttgtagataactttgcattgttagaacctcgtcaaaatggtggtgtgaaccaatcaggcgttcaacagccatttaacaataaccaacaatcgtttggtgctcaggctccacaatatggcagtcaatcacaacctggaaataatgctcctcaaagtaatccgtcaccaagtatggacaatggtttcgatcccaatcaaaatgctggcaaccagttccctggaagtagtgatgatggtggtcaatccattgatttagctgatgacgaattaccattctaaataaatttttactcagaataggagggtaatttcatggcacaacaacgtcggggcggacgtcgtcgtcgtaaggtcgacttcatcgccgcaaaccacatcgaatacatcgattacaaagacactgatttattacgtcggttcatttctgaacgtggtaagatcttaccacgtcgggttactggtaccagtgctaaaaaccaacgtaagttaactatcgctatcaagcgtgcacggatcatgggtcttttgccattcgttgcagaagactagtttccactagtaatattaattaaagagacctttttataggtctctttaatttttaaatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattatagaaaaggagtgactctaagatgaaactaaataaatatattgatcatactttactaagtcccgaagcaacagaagcacaagtagaaaaagttattaagcaagcaattgataatcattttcatactgttatgattaatccatactgggttgctaaaactcataaagcattagaagaaactgatgtagtaacagcaactgttattggttttcctcttggagccactacaactgcaacaaaagtttttgaaactgagtaagcgattaaagatggtgttgatgaagtcgatatggttatgaatatcggcgaaatgaaaggcaaaaattatgctaaagtagctgatgatattaagacagttgttaaagttgctcataatgccaataaggttgcaaaggtaattattgaaacagctttgctaactgatgatgaaatcactaaggcatctaagattgttgctgatgcaggtgctgactttgtaaaaacatcaacaggtttctcaacccgtggagcagcagttcatgatgctgaattaatgtcagcagctactaaagaaactcccactgaagtaaaggcttctggtggtattcatacaaccgaagaagcagaagcaatgattaatgctggagctacaaagttgggcgttagccatagtatgcaagttattggtaaagaatagaataatgtcgaaaatagttcagcggttggtgaaaatcagcctctgaactattttaatgttattatagattaataataaaacataaatgagggattgcgagtggatagtaagcaacaaattaaacaggccgtccaggttagtaaactttactatttagatggcgttacccaagcagaaatcggaaaaaaactaaatttatcgcgaccaacaatttctcgattacttcaatttgcacgcgagaaaaatattgttaaaatttcaataaatgatccccttagcaatattgaagatctgcagcaccaattaaaagaaaagtatcaactaaaggatgtcattattagtactccagaaagcaatgaaacggctgaaattttatcatctttaggtaaggccacggctcgttaccttgataaaaaagttaaggataatgatgttattggtgttagttggggaaggacactggtcagcgtagcacgtcaattgataccaaatgaccgtaaaaatgttcaggtggtctatttgaaaggaacagtggcgaactctactcataataattatgttgtagaggttactaaatgttttaataaatgctaccatacccaggcgcagattcttccgcttcctttaatttttgaaaataagcaaattaaagagatggtgataaaagataaatttattaacgagattttagatactggtaagcggacaagcgtggcactttttacggtagaaacgacggaacaagatgcaacgctatttgaactaggttattttaatgatcagcaaattaaaaccttgcaagagaaagcagccggggaccttgtttctcgctttattgatgaacgcgggaaaatcgttgatgaccagttaaatgatcgcacagttgctattgctttagatgatctaaaacaagctcgggaatcagttcttatcgctggtggaatgaataagttaaaagcaatcaaagcggccttagctggaaaatatgcaaatgtattagtaaccgattcacttgtggctcaacacctattatagttacccattagatgatataatctattgactaagtatttgatgtgatatgatagatttatccaattaataatttaaagctatttttaggaggactagcatgcgaaaaattttcagtcgtgagaactgggagttttattttgaacacccagccgtccgctggaatgtctgctatatagtgcttttaacaatcattgggcttattttagggtttatggataactggattattggactaattgttttagtaatcgcagttattggtggagctattagtattcggcggttaagaaaattattagtcgatgctcatgaatatttaaatgaattaacgtataaagtccaacgtgggcaacaagaagcattactggaaatgcccatgggaatgattatgttaaataagcgtcatgaggttgaatggattaatccatatatggcgcggtattttaatcttgaaattgttgtagggaagccgattgcagatgttgatgtaaaattagcggaattaataaaagatcatgcagatgataagcaaacacaagtagtgacatggcgtgaccatcaatttgaatttttggttcagcatcacggacaggtagtttatttattagatattacaaaatatgaacagattagtgcacaatataaggatgaacaaatcttcattggtaatatttacctagataactatgatgagctgattcaaggaatgagtgattctgatgtctctaatcttcataattacgtaacttcacaaataagcgattgggcagttgctaatcacttattgatgaagatcattgatgatgataactacttgattattggacatcaagcttcattaaaagaacttgaaaaacaaaaattcaagattcttgatgttatccgtgaaaatacatccaagcaaaattcgccagttactcttagcgtaggaattgcttatggcgaaaatgatctgataaaacttgctgatacagcacaaaataaccttgacctcgcgttaggtcgtggtggagaccaagttgttgttcgggctcaagatcaggaggcacgtttctatggtggaaagaccaacccgatggagaaacgaacccgggtacgagcacggatgattagtcaagcattacaagaattaatggctcaatcagaccaattatttgtgatgggccacaccaatccagatatggattcaatcggtgcctgtttggggattcgacggattgcggaaatgaacggtaaagaatgttggattgtgattgatgatgaacatccacactctgatattcaacgtttgatgcatgagattgataattaccagacgattaaggaccatattatttcaccagtcgaagcgttagaaaaagcgacaaataacagtttgttagtaatggttgaccatgctaagcggggaattaccattgctcctgaattatatgataaaatgcaaaacagacttgttatcattgaccaccaccgtcgcggcgaggactttcctgaaaatccattgcttgtttatatcgaaccatatgcttcatcaacttgtgagttaattacggaaatgtttgagtaccaaccacgtgaaggaaaaggacttaacaagcttgaagcaacggcaatgctaacagggattcaggttgatacaaaatcattcaccaagagtgctggtacgcgaacttttgatgcagctagttacttgcgttctgctggtgccgatggtttaatgattcaatcatttatgaaagaaaatccagaaaccttcatgatgcgtaatcatttgatttcaagagcggaaataaatgataaaatagcattatgtacgggtgaagagggacaggtttatgatcctgtcacggctgcccaggctgctgatatgttgctccaaatgagtgggattgaagcttcatttgtaatttttgaacgtgctgataacaagatcggaatttcagcacgctcaatgggaaatgtcaacgtccaggtaatcatggaaaaaatgggtggtggcggtcaccttgcaaatgctgctacacaaatcagtgataaagatattacacaggtcaagcaagagttagttgatattctaactaaacctgataaagagcaagacgatacagaggagtgatcataatgaaagttatttttacacaagatgtacgaggccgtggtcaacgtggtcaaattaaggaagttccagatggctatgctcaaaactacttaattaagcgtggattggcaaaacaagctactaaagcggcgatgagccaactaaagggtcaacagcgtgctgaagaaaaacatgctgctgaagaattagctgatgccaagcggatgaagaagattcttgaagatgataatacagttgttgaattaagcggaaaagccggtacagatggccggatgtttggttcaatttcaacaaaacaaattgcaactgctttacaaaaacaatttgaccttaaaattgataagcgaaagattgagctggcggctccaattaaggcgcttggctacgtaaatgtgccaatcaaacttcatccagaagtcgaagctcaaattcgtgttcacattgctgaaaagtaatgaggattaatagatttaaggagcggtatcgtcatggataatgcaccagtgcaagaagagccacgcgatattgaagcagaaaaagcagttcttggagctgcttttttaagtaaaaacgcgttggctgatgcgatggaatatcttgagccgcaagatttttatcggaaggctcaccaaattatttttgaaaagatggtccaactaaatgatgcggaccagccaatcgatccgttaacgatgaaaaatgtccttgatcaggataatcaaacggaaaatattggtggcgttgcttatattgctgaacttgcaacagcggttccgacggctgctaatgttgtctattactcaaagattgttcatgataaggcgatttcacgacggttgatcaatactgcaaccaagattatcaatgatagctatgccggaaatgataaaattgaagatcaacttgaccgggctgagcaagaaattatgtcagtttcggaaaatagtcgtcaaactggttttaaaagtattagtgacgttttacaagagtcaattaatcatgtcagtgagctctctagtcaagattcagagattactggactttcaactggatatgctcaattagatgagatgacgactggcctgcataaagatgagttggtgattattgcggcacgacctgctgttgggaagactgcctttgttttgaatattgctcaaaacgttgcaactagaaccgataatacggtcgcaattttcagtcttgaaatgggtgcggagtctttagcaaaccggatgctttgtgctgaaggaaatattaacgctaaccacttacggaccggacagcttacgcaggatgaatggcaaagtttatttattgcaactggtgccttgagtaacgctagtatctatattgacgatacaccaggaatcaaggtagcagaaattcgggcacgttgtcggcgcttagcaaaggaaaaaggcaacttaggattgatcgtaattgattaccttcagttgattgaagggagtaatcctgataaccggcaacaagaagtttcagaaatttctcgacaactaaagaaactggcaaaggaattagaagttccagttattgccctatcacagttgtcgcggggagttgaacagcgacaagacaagcgcccggttttatctgatattcgtgaatctggatcgattgaacaggatgcagatattgttagtttcctttatcgtgatgactattatgagcacgatgaagattcggaagataataataacccgggaaataatcaggatgacgatggatcaaatgctagtgaagttgaagtcatcattgaaaagaatcgtagtggtccgcgggggacagttaaattattatttgcaaagtcttataataagttcacttcgatttcctatatccctgaagataataattaaaaactaaatttctaagagggcatttcagtaaaaactgaggtagcccttttagtgcgcttaagacattaaaaatgttttaaaaaaaataaacggtatgatagtaattgaggaggcgtaaacaatgaaccgtcaaggcgtagaattaaaatggcttttattcggaatgtttcttggaagtattgggaatagttttgtctggccattaacaacaatttatattcacgatcagttgcatgagtcattaactgtatcgggaatcgttttactcttttattcgggagcaaatgttgtcggaagttatattagcggaatgctatttgaccgagctaacccgcggaaattaatgattggcgggacactgctagcgacaatcgtaatggctattatgattttcttcaatggctggccgatatatggaattcttttaacagttattggattctttaatggctggatcattacaatggttaattcttttgcgactcgttcaggtcgagatggtcgttatgtttttaatatgttgtattttgccaataacttgggaatggtgattggaactactattgtcggcccgctttatcagtatgcagatggcaatgtttcaccaatgtttttgattaccacaatcctttatacaatgttctcacttgttgttatctttttctttaaggatagtcaacaaacagttgcaaagaccgaagatatggaagctgaagaagagaacaagacagttaatattaagatacctcaagctaacttatggattaactggatcttcttcattgccttagttgtaatctggacaatgtatgaacaatgggcaagtaacctatcagttttcatgactgatcaaggaatctcgatgacaaaatatagtcttttgtggacattaaatgggattttaattgttgttttccaattaggaattacttggcttaatcgctgggttaatcggccatatgcgcaagtatttattgggatgtttacaattggtttctcatttgtcttattactttacgctcactcatatagctggtttgttgcggcaatggtcgttctgacaatcggtgaagccactgctctgccaacaatgcctgccattgtaaacagcctttcaccggttgctgttaagggaaagtatcagggaattctgaacgcattttcttctttaggaaaggcaattggtccgctatttggtggattgatgattgaagcgacctcttatcatatcctctttattatttgtgcgatttcaatttttgtaatggaaataatagtagtctttgttattaagataaaacgtgcaaaagcagttgaatattaaagaagtgattagatgttttataataattttgataatgtccatggtgaagaccgttatggaatggtaggaaaaacaggagatccttttagggaagaatgtaaactagggatttcttgttatcagtgccatgaacagccgttagtaattgcggaaagaaattggatggatacgaataatgatgactcgcaacggtatcaaattgtggtagtttgtgagcattgtggtgctgttgatgaatttattgttaatgatggtcgagaacaccaaattggtaaattaaaacatagtaaataccagccaacagaaaagaatattataaataatggagctgtgaactagaattgttcatggttctttttttaaatccgtttttattaaccaaaacttgagagatttgctatgatggtagttaaaatcaaattaaaagcaatgaggtgaatgttgatgaaaaccaagaaatatcgttacacaggaaaagactttgatattaagacggcaccaactaaggtaaaagattctgctgatgatcttaagaagattaaaaagaagatcaagaaaaatgtaaagtcaatcaagaatgcgcaaaagatgatgtatgcgcggcgtcattatggtgttttagtagtatttcaagcaatggacgcggcaggaaaagatagtatgatttcgcatatttttgcgggcgtaaatccagttgggtttaaggtggccaattttaaacaaccaacaggccgcgaattacgtcatgattatctctggagaatcaatcgtgaattgccaatgcgtggtgatattggtgttttcaatcgatcttattatgaggacgttcttgtttcacgcgttcaccctgctttaattttgcaatctaatattccagggattgagtctgttcatgatgttaataataaattctttgatagtcgttatgaagatattcgtcagtacgaaagttatctaacgcggaacggttacttaattgtaaaattcttcctccatgtatcaaaggaagaacagaagaagcgtttcttagcacggattgatacaccagaaaagaattggaagttttctgcagctgatattcgcgaacgtcaatattgggacgattaccaaaaggcatatgaaaaggcgattaatgctaccgccacaaaggaaaatccatggtatgttattccggctgatgataagtggtattcgcgtttaattgtatctgatattttgacaaagaagattaatagtttgccattagcttatcccgaggtttcgccagaacaagaaatgagtttactccaagcacgaaaagaactaatagcagaagataagtaaataaaaaggacgtccgaatgacgtcctttttatttacttggtttaaagatgtacttgtgagtaaagaagtagattgctaatgtagaacaaagtattagaatgttaaagtttttgtcgggtaaggccaaattctttgcgttgaactgttcaccaaattattaatttactcatcgttattagttaaattagattattcattcaaaaaagcagttttcaaatatatgtttaagtttataaatgcccaaaaattgatttttagtatttatatattaacttctaatgataataacccctgaaaatctattttcaagggttattatgttagtattttagtataataacaccaaaaaatagctttttagctttaaggagggaagataaataatgaaatacataccattatctaaatataagtattttattgaagataagacgaatgacccggcagcaattgaaagtgaatatcagagtcgactgaacggatatacaagccagaagacaactctgtttcctcttcttaactatcgcgatggtgcacagacaagtaaatatccaattttctatcttccattaccggaaattcaaaacctggcggatcagcttaggcgtaattctaatatgattaaggatatctctgtaacgcttccccaagttgcgattaatcaatttttgaattcattattactctctgaaattttctacactaatgatattgaaggtgtaaaaacgagtcgtgttgaaattagtactgttattcaggaaaataaccacccaataaatggtgatgatcatatatcaaagaaaaggcttggttcaactataaaaatgtaccagcgcacacaatcaggaaaaaaagttgaaatcaatgttcttcaagactatagaaaaatctatgattccttgttaaaaggcgaacttaatgaagatcgactgcccaatggaaaaatatttcgtgataagcttcctaatagcgaagtgctttcgatcggggatggcattaaaacagttcatcgaccaccaaccacggaaactgcaatcaaggttgcccttacagctttaattgaatatatgaataatgatgatactccttcaatatataaagcccttgtaactcactttttctttgaaaatacccatccatttcttgatggtaacggtcgaatggggcgttatcttttatcgtcatatattactaacaaatttgatcgctttactggcttttctgtggctactgcaattcataataatgttcagcaatactataaggtatttaaggatgccgatagtgcggaaaatagagctgatttaacattttttattcaaaaattattaatgatacttgttagtcagcaggaaaaagtaattaagattttgagtcaatctcgtgaaaagcttgataaagccaatgaaattattagtcagtgggtcaatgaacaccatcatcaattagctgcaacgtctgatagtttgtattgtaatgttctatatcttcttgcacaatcaaagctatttactaaccagttagatttaggaattaaagataatgatattattgaaactttgaagaagagtaatcgccgttatccaatgacaaagactaaggcagccattgaagaactagaagcacttggcgcaattgaaattgtttctaagcgtcctaaacaacatgtaattacaattttataataaaaaaaaagaccaccgattactcggtgatcttttttatatgatgggcagtcaggggatcgaaccctggacccacggattaagagtccgttgctctgccagctgagctaactgcccatgtctttgacaacataaataataatatcaacttccgatcattttcgcaagtgtttttctgaatttatttaataaattttcaaatccatattttaattaggtgtctaactgttataattaacaataaaattaaaattgggagtaattttatgacattaaataaggataaatttgagcaaatgaaccgtttattgcggaactatatgattaacatgaagcatttttatactgaacttgcccctgaattagatataactccacagcaagcacatacgcttttttatatagaaaaacacgctgggcttattcaacgagaattaggtgaccatttccatttacggaatgctagtgttactagtatggtgaaaaatcttgaacgcgacgggtatattatccggaaggcggatcaagagtcagcacgaattaagcgtatttttcttaccaaaaagggtgaagaaaagactaatgaggttaaagaaatatttgataaagcttatttgcagattattagccgcctcgatgaaagagatattgatgcaatagttaaagggatgactaatattaataacaatctaaaaaaataagttaggctcttgacagttaggtatctatgtgtttaaatattcatcatcattaaaagttagatatttaactgttaggaggcttatgctttgagcagaaataaatttagttttcgaagtttctttagtttaataaatcaattacatccgcagtatattaagctttttgtgggaatcttactaggttttatctccacgggtgctaacctatttgttcctcaactagcgcaaaagttaattaataattttaagagtattagtctaacgttggcaattttaacagttgtaatttttatagcaggattaattacaagtgcgttatcagggttattattaggaatttttggtgaaaatattgtttctaaattacggaaacaattatggcaaaaactacttaaaatgcctgtaaaatattttgatgatgttaaaacaggcgaaatcagttcacgattagttaatgatacgtcacaggtgaaggatttgcttgcctcaacattaccaaatgcaatgacatcgcttttacaattcgttggtgcactggttattatgttagcaatggattggcggatgacattgttgatgtttgtggcagttcctttagtgattttagtcatgctaccagtgatgaatcagtcgcgtaagattggtcgggttcggcaagatgaattagcaaaatttgctagtgattccaccgatgtattgggtgaggtccgattagttaagtcttcaaacggtgaagaacatgaactggcaaagggaaatcgtcgtatcgacaatttatatcatgtcggaagaaaagaagcgttgattaactcagtaacgcaaccaattacaaacatgctcatgatgataatgtttcttgggattcttggttacggagcaattcgcgttatgaatggtgcaatgacaatgggcgccttagtttcatttttaatgtatcttttccaaattattagtcctgttgttgtaattagtcagctctttaataatatggcaaagactagcggagccacggaacgtatccaacaaatcttaactgaaccagaagaatttgttgctgataaagatgaaaaagatattgtgagcgcaccgttgaaatttgagaatgttgattttgcatatgaggaaggcaagccagtcttacgagatgttagttttgaaacccaacccaatgcagtggtagcttttgccggtccatctggtggaggaaagtcaactattttctcattaattgaacgattctatcagccaacaggtggaaaaattttgatcggtgaagagaatatcgaaaatgtagacttagccaagtggcgtgaacaaattggtctcgtaagccaagatgctgcggtaatgccaggaactattcgtgataatttaacttatggattacgaagagaagtctcagatgaggaattttgggatgcattgagaatggcttatgcagatggttttgtcagtgaaatggaagatcagttagaaactgaaattggtgaacgagggatcaaactttctgggggacaacggcaacgaatagcgattgcgcgagcttttctccgcgatccaaaaatcttaatgcttgatgaagctactgctagcttggatgctgaatcggaggcaatggttcaaaaagcattgggagacttaatgcaaggaagaacgacactagtaattgcgcatcgcttaagtacgattgtcgatgccgataaaatctactttatcgaaaatggaacagtatccggcgcaggaacccatcaagaattattaaagacaacaccactatatgcacagtatgttaaggatcagtttaaataaaataaagactgcgaaaagataagattttcgcagcctttattttaagtatgaaaaaagcgactgagataaaatctcaatcgctgtaaacctctgatgggcagtcaggggatcgaaccctggacccacggattaagagtccgttgctctgccagctgagctaactgcccatatcctttaacagaatacttaaacagtttaacctgttattgatcaaatgtcaaatatttttcataagtttttagaaaatatttatgaaacttttccctgtgctataatagaggcactgatatatagcagatttaaagtaattaatcaattaacccaatggagggaatcattgatatggcaaagaaaattttagttgttgatgatgaaaaaccaatttctgatatcatcaaatttaatcttgaaaaagaaggatatgaagttgtcgtagcctatgatggcgaagcagctttagaacaagtagaagcagaaaatcctgatttaattattcttgacctaatgctgccgaagatcgatggacttgaagtggccaagcgggttcgggctaagcataccatgccgattattatggtaactgctaaagattcggaactagataaggtgctggggcttgagcttggggccgatgattatgttactaagccgttctctaaccgcgaactagtagcacgagtaaaggctaatttacgacggcaagcaactctgaaggcaccggcagaagaagaaaataataccgatattcaaattggcgaccttacgattcatcctgaagcctataccgtaactaagcgaggcgaaaatatcaatttaacgcatcgtgagtttgaacttttacactatctagctcaacatattggacaagttattaaccgcgaacatcttcttcagactgtatggggttatgactattttggggatgttcggacagttgatgtgaccgttcgacggcttcgtgaaaagattgaagataacccgagtcacccccaatggttaattacccggcgtggtgttggctattacctagcaaatcctgatcagaattagaggctgaaccattgtgagcagcaagttaaaattttatcaatcgattcgttttaaaatcgctctcgtattcgtgttaattttgatgttaacacttgaatgtgttggggcggtttttgtgcgtcaattagagcatcaaaaccttaatacgtttaagcaaaccattgaattaccgtcttacgttgataattctttagcagagcagctatcacgatcaaatactaaaaaagcaaacaaacaaattaaccaaatcctttcagaagttaataataataatatttctgaaatccgggtggttgatagtaagagtattgtgcggggaacaagcaacgctgataatcggagtgcaatcggtcagaaaacaacggaccaagcaatcaaagcaaccttattaaataataggtcgcataccgaaaatttatacgataattcaaatcacacgcgctactatgtcaatgttattccccttgtggataatagtaacaataacgttgtgggagctgtttacctgcgagctagtctagaaagtgtctacgctaatattaataatattactttggtatatctatctgcggcgatgattactattgtcttgagtttgatcttggcaattattatttcccaggaaattacccgcccaattgaagaaatgaggaaacaaacattacgaattgcccggggagactattctggtcaagtaaaagtattgggaaatgacgagttaggacaattagcaggagcagttaataatctttctgtccgggttgaagaggcacaggagtcaagcgattctgaacgacgacggcttgatagcattttatcccatatgtctgatggggttttagccactgatcgtcgagggaatgtgaccattgtaaataatatggcgttacagttactaggtgtcgaaaatgaagatgatttaattggtaagtcaattattgatgtgttggatattcgtcatgactataccgttcggcaactagtaaatggtgaacagcgcgagatgattattgatatgtcaaactctggcaataatttgatcttaaacgcctacttctcaccaattcaacgcgaatctggctttgtcagtgggcttgtctgtgtccttcatgatgtaacgagccagcaaaaagaagaacgcgaacggaagcaattcgtttcaaacgtctcacatgagttgcggactccattaacaagtgttcgaagctatgtcgaagcattaagtgatggtgcttggcaggataaagaaattgcccctaagttcttaaaggttgttcaggatgagacagaccggatgattcggatgatcaatgacctgttgagtctatcacggatggatgcagggacaacgaagctcaatctggaatacgtaaatatcaatgagttatttaactatatcttggatcgtttcgatatgattattaaaaaagaagaagatccaaaaaagaaaaaatataccattgaacgatactttactaagaaagatttatgggttgaaattgataccgataagtttacccaggtaattgataatattatgaataacgcgattaagtattctccagatggtggtgtaattacaacccgcttactggagacgcataatcatgttattttaagtatttctgaccaaggtttagggattccacgaaaagatcttggacgtatctttgatcgcttcttccgcgttgataaggcaagaagccggaagcaagggggaacaggtctgggactagctatttccaaggaagttatcaatatgcttggtggacaaatttgggttgatagtgtagaaggcaagggttcaacattctatatttccttgccatatgtaccttatgaggaggaagactgggatgatgaagaagctgaaaagtaattggcaagcaatcgccttaacggttgttgtgcttcttagtttattcatttcatggattgtctggaccaacccatttccttttgagggagcacgacacgaaaatttcaataataaccaatcacaacaatatacaccgcaatcaaggggcgatgtttatctcccaactaaagcagttgagacaaatgaaaaaggaactcagaatcaactttatagccctaaagctaatttaattctgagcgtaaaaaaagagttagaggattggaaattaggccggacaaatgttgtcaaacaaaataacagtgatgtttatttgagttatttgcgacggcggaactcgttaatgctgacatatccggatgaggtaccgagctcagtcttcaacgaaacattttcccagtcaattgatactgaccgggttaatcagattaaccatattattatcccgctaaacgggcaacatgagatttacttacttggtgaccaccattatagtgtgtaccgagtacgggtagagcagggaaaatttaaccatattcggcaactcttaaagtcaatggatcgaatcccagttgaccataaaactattaacggagtagcagtaatgatgtatccccggtcctttgagttaccagcattaggatatcaaatcactgcgcaaaacattgatacccttagtgctagtctaatgagtactaaccaacacacaacaattacggcaaatcggaatggcaacgagactacctatacggatggaaccaatcgtcggctgatatttaatcaccaagatggaacgcttaaatacgaaaattaccttagtacggacgatcgggaatcaacaagccagattttcccacacttctataataagttgacgacaattggaattccgcttgataatttgcgctatgatgaggtgagtgagcatggtcgtcggttaaactatcgggcttatgttaatagctttccaattttcaatagtgatggttatggagaagtaacgcttgaatctacaagtagcgggaatgaacgcttctggctaagtctttatagtcttcgagtgccattgccaattgatcaccagatggtcaagcttccatcaagtgcagatgtgattaatcaattacatgcaaccaaccggatgcgtgacatcaaggacttacgtgtcgggtatatttggaaaactgataaagatagtcatgttgtaaagttagtgccaacgtatttcattaagtatcgcggccactgggttgaatataccgagttagaaaagtaggagggttaaagaatgaattttaaacgtattcaatggatctttatccttgcctttttgctttttgatatctttgttggaagttcattaatcttagaaactagatttaccgtttctaatggtcagcaaaatcgccagtcaacagtgttaaaagaaatgcgcaatgactcgattagttatggcgagctttctaataagcagcaaaccggatattatattgctggaaagaaatcctctgatagcggagtcctagagcaagaagccgggaaattacgtaatcaaaattttcgtctttcttcaggaacactaactagtgagtttgataagccaattaaaacaactaaaaataatgagattcggcgtgtcgaccgtctattaaaaaataaaaagatggtaagtttaggaaatcattatcgctataacaaggaattatcggacaaaaatacccttgtttatacgcaaatgctagaaggaaagccgctattttcaaatgatgggcaaattcgttttcggataaactctgactgtgagataacaggttatacgcagacttacttgcaagatgttgaaattctccggcaacggtcaaatacgattagtcagcgccgagcaattacctggttgtataaacataatcaaattcctaataactcccgcattaggtggtcggtgctcagttattctaagctccttaacactactactgatgataaagcagtctatgtgccaacgtggactgttgaaatcaaaactaaaaactcaggagcaattcaacaattacaagttaacgcatttaatagtacagttatgaaggaaacaccagatagtgtgaatacgaactcgttaaataataagtaattgaggaggaactttaagtgacagaaacggatccattacgttatagtatacttgcgagcgggagtactggaaatgtaacttatttggaaacgcgcaaccaccggatcttgattgatgctggtttaagtgggaagcggattgaaaatttaatgaagaagattgatcgatcattaaaggatgtcgatgcgatttttgtaacgcatgaacacagtgatcatacgcatggtgttggtgtcttggcacgtcgctatgggatggatgtttatgccaatgaaggaacctggcaagcaatggccaataaagttggtaaaatcccattagcacaaaagcatattattgcaccaaatactgttaaggacttgggagacatggatattgaaagttttgcggtatctcatgatgctgcgcaaccgcaattttaccaagttcaccacaataataagaccttctgtattattacggatactggttatgtttctgatcgagttgagggaaccatccgaaatgcagatgcctacgtaatggaatgcaatcatgatacagaaatgttgcggatgggtccttattcatggccattaaaacagcggatattaggggatgagggtcacctttccaatgaagaaggtgccgatgcattgatgagtgttgttgggcggcgaaccaaagagattttccttggtcaccgtagtcaacataacaacatgcgttcgctcgcccacttaacagttgcaagtttgatggagcagcatgactttggcgtcgatcatgattttaaattgcaagatgctgaaccagaagaaccaagcaagttaatgacgttataataaagagatcacggtttttatcgactttattcaatgatttttcatatttaaattgtaatttgaagatagtaattctttaacttagtggagggtttaattggtgaataggataaaacaagcttttaaagatcgattgtggctaggcgtaattattgtcggcttatttgctggtcttatcggtggtggaatcgccttaggaattaataacctggtacaacatcatgaagaagtaacaagtacacgagttccagctggctctaataagtctggtggtacgaaggttaataagaataaggctgacttaaacggggaagcgtcccaagcttataagtccgttcaaggagccgttgttagtgttattaataaacaaaaagttcagcaatcaagtgggacgctaggaatttttggttatggcagtagtaacggaagcaacagtgattcttctagtgataataaattagaaaccgctagtgaagggtcaggagttatttataagaagagtggaaattcggcttatgttgtaactaataaccacgttgtcaaaggttcaaacgcactccaagtaattttaagcaatggtaaaaaagttaatgctgatttagttggtgctgattctgcaaccgacttagctgtattgaagattaacgctacaaatgttaagacagttgcatcctttggtaactctaattcgattgttcctggtcaggatgtgctagcaattggttcaccaatgggaagtgaatatgctaatacagtaacaaaagggattatttctgccaaagatcggacattaaaagccgggactgatggaactttgacatcggttatccaaacagatgccgctattaactctggtaattcaggtggtccattaattaatatggcgggtcaagttatcggaattaattcaatgaaacttgcttctgatacacaaggctcttcagttgaaggaattggttttgccattccaagtaatgaagttgtgacaattattaaccagttgattaagaatggtaaaataactcgtccatcactcggaattagtatggtggatcttagtaatgttacttctgatcaacagcaatcagtcttaaaactaccaacaagcgtaaacaaaggggtagtgattatggatgtgaatagtggttcagttgctgatactgctggattgaaaaagtatgatgtcattacaaagcttggtgacactcaagttacagatgcgggttcattaaaggcggccttatataaatacaaagttggacaaaacgctaaagtcacttactaccgtgatggtcaacaacacaccgcaactttgcatttaacaaagagtgctgatacaacatcaactgatgactcacaacaagataataattagtgaattgggagcgagacagaagtcacttttgacttcgtttttcgacgcgaagctagcctctgggagcccccgcaagcaacaataggtctccaacgttcggttttgccggacgttggagaccattgttgtactgtgtatgtgcttttaatgaaagtaacttaacttctgtcttgcttcctttcattaaaagcctcttaattaaaaggggtataatattagttatcaatataaaggatggtgggtaaaatgaataatccacggtttaaatacccagatacaaaggcatttgaatttgtagtacatcgtttagaagaacgcggagtaaacttagacgaacttgcgaagattgtgtatgagacgcaaaaaagttttgaacctgacctaacaataaaagaatgtcagaaatttttgattgatacaatgcataaacgtgaattattaaatagtacaatggtagcccttgagctcgatcggttaaccgaagaaggaaaagtcgatgaacccctagcaagtattatcaaaaatgatgctggtgtatttggggtagatgaaaccctagctttacaaattgctaatatttatggaacaattgggacgacaaactttggttactttgaccgggttaagagtgggattattgccaaatttgaccacgataaggttcatgtaaatacatttattgatgatattctcgcggcgattgtggcggctgtttgtggaaagattgcccaccagtacgcttgattaaaataatctcattgacttttaaataatttatcattaaaataaacataattcgtttagaggagtaaagcaaatgagttatcaaactttacaattaaattatagttggcaaagccggtaactcagggatagctgtagtacagatatgacctgggtttattcacagattatatctgtaccggctgctttatcatgtacaaataaggcctgtacggatttcacgcacgggctttttctatttcactggataaatagtgggatttccgaaacgtggagctcctttttattttgaaaggtggagatagggatgaaacgaattatgggctatattattattggaattgttgtgattggtggttattttggacttttaaggcttcatcaacagaccacaaaaccggtggtagggattttaacgatgatgcatcatccggcattagatcagattcaaaagggggtcgttgccggattagcagaagaaggataccaaaacggaaagaatatcaaaattgaataccagaacgcgaatggtgatcaaggaaacttaaatactatggcaaataaattagtgaatgatcatgcgaaagtaatcgttggtattaccaccccagcttgccaagcacttgctaatgcgaccaaggatattccgattgtgatgggcggaattggtgatccggttggtgccggtttagtaaagaatgaaagatatccagaaggaaacgttacaggagttcatgatgtgaatccgagtgaacagcagattgccttagtaaagaaatttataccaaatattaagaccctaggagtaatttacacatcgagcgatacctcttctgaaagtcagtaccaaacgatggtaaaagcagcgcataaattacatgtaaacttaaaaacttatacaattgcgaatgctaatgaacttaatcagacttcacaaacaatgttgagtaaagtagacgcggttattgttcctagtgacaatacaattgctggatcaatgggagtattggtgaaaaatgcagatgtggtcaataaacctgttttcccgagtgctgatacaatggtaaaagatggtggagtagcttcgattagtcttagccaatacgggcaaggaaaagcagctggaaaaatggcagcacgtattttaaaaggtgaaaaaccaggacagatggcagttaataattaccatcatggaaaaccggttcttaatttaaagcaggcacataagttaggaataaaagttccagcagattttcaacaagaagcagaacaacatggaacagtctttaagtaagataatgggaaaattccgaataataagaaaaattaaagaagataacattcgctaggtaacattccgttgtatatttaccacagattgtgttgtaaatcgttagaaatacgttaaaatgataatgtgaaattgcttgtggataagtcagtggataactaacagtaactttaaagtaattttataaatgttggtatatcaataaaaattattgttcaaaacttatccacaagctgaatatgtgtttgtggataagtggaattctttgtcaacgttctgcaacgacgcttactggcgcaagggatagccaagtcgttgctgaacgattgttcctgtagataactgtggataagtaatttttaagaaaacgcttttttaacaaaaaattaaccgaacattcgggaaaagtaaaaaaatcaacgcaggcctgtggacaactttgtggataaactgtggaaggtagtggatatcttgaatataaaaattattggtgtgggtaagttaaaagaaaagtattttaaagcgggaattgctgaatatgctaaacgacttggacgttattgtaaatttgaaattgttgaggttcctgatgaaaaagcacctgaatctttaagccaagcagaaatggatgaagtaatggcaaaggaaggggaacggattcttgataaaatcaaagatcgcgaatatgtatatgctttagcgattaaaggtaaagaacgttcttctgaagagtttgcaaacgaaatcaataaattaacaacttatggtcacagtgatattacttttgtgatcggcggttcattagggttaagtccagcagtattaaaacgggcagatgcccaaatttcgtttggaggttttaccttgcctcatcaattaatgcgtttagttttaagcgaacaaatttatcgagcttttaccatcatcaatggcctcccatatcataaataaagaatttattgagttttggttagattattatttatcgttgttagcgatggtatagtgtaaatatgaagtgtaatggcataagaattaaaggatttgatttaaaataggcatacgaggttaccaagtaattcttttaggggtaatagcaggaatatgcattttagtgatgcaaggaaaagcaagtgcaatgatagtaaatgaagcacggctgacattgcctaatgaaaaaagaattgagtatgatgaatttgaacggtaccagtttcgggcaaaacagttacgaacttggtggcaagtcaagcgaccaaaatataaaattgattggtcattttatcataagaaacggggatactgggattagctcaggtcctcgtttttcttttaactttcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgttttcaaaaaagctattaaaatgaagatattaaaaggaggcaatgataatgaaaaaagttgggattatagtcggcagcgttcgtccaaatcggcggagcatgcaagtagcaaactggttaaaagttcaattaaagaaaagtacaaaggttcaatttgacatcatcgacctaaaagaagttaatttaccgatgatggatgaacctaaaattccttatttgggtttatatgttcacgaaaaaacgcgtaaatggagtgagttagtacaaagctatgatggttttgtgttagtttttccgcaatacaattggggctatccagcagttttgaaaaatgcgattgattacttaggaaaagaatggcaaggaaagccggttagtttagtaacattcggtggacatggcggcttgcaagcacaaattgcaatgaaattggtcgtaaccggcttaaagatggcggcgcttcctgttgatttacaaattaacttgatgccggatgattcaactgcgactgctgatcggaagttgaatacttataatacgcaagcagcgttattaatgactgcttttgaaaatgagttaagctagtttgtgattaaagtagcaaattattgtaggacattaatataaaattggttcaatttgtgaatattatgacaaacatcgtgatattgcagcagattaggcaagattattattacaaattgggcgataatgaacaaaaaatcaaaatgtttctattgcaaaaataaaacgcttgcatgataatggaatcgtattcaaatgccatgaggagggtatttttaatgaatagacaatttgatttcttaatgccaagtgtgaacttctttggtcctggtgttattgccaagattggggatcgtgcaaagatgctcaatatgcacaaaccattgattgttactactgaaggtttatccaagattgacaatggtcctgtaaagcaaaccattgcttcattggaaaaggctggcgttgactatgccgtatttactggcgctgaacctaaccctaagatccggaatgttcaagctggtaaaaagatgtaccaagatgaaaactgtgactcaattattactgttggtgggggttctgctcacgactgtggtaagggtatcggtattgttttaactaacggtgatgacatttccaagcttgccggaattgaaacattgaagaatccacttccaccattgatggctgttaacactactgccggaactggttctgaattaactcgtcacgctgttattactaacgaaaagactcatttgaagtttgttgttgtttcatggcgtaacattccattggtatcattcaacgatccaatgttgatgcttgatattccaaaagacattaccgctgctactggttgtgatgcttttgttcaggctattgaaccatacgtttctgttgaccataacccaattactgatagtcaatgtaaagaagctattcaattaattcaaactgctttaccagaagtagttgctaatggtcacaatattgaagcacggactaagatggttgaagctgaaatgcttgccggaatggccttcaataatgccaacttaggctatgttcacgcaatggctcaccaactcggtggtcaatatgatgctcctcatggtgtttgctgtgccttgctcttgaccactgttgaagaatataacttaatcgcatgtccagagcggtttgctgaattggctaaggtaatgggctttgacactactggtcttaccctttacgaagcagcacaaaagtcaattgacggtatgcgtgaaatgtgccggcttgttggtattccatcatcaatcaaggaaattggtgctaagccagaagactttgaaatgatggccaagaatgccctcaaggatggtaatgccttctctaacccacgtaagggtactgttgaagatattgtaaagctttatcaaaaggcttacgatggcatctactaataattaaataaacacaaagaggctggaaatcagctcagtctctttactgttttacgtattaaactgccagccaaccttacggaggtgggactatgaactagccaagctaattctgtccccctctttttttgtctacttttaattcttaatattttgaatttttttcacaaagttacttgcaagcgtattcttttgaaactataataaaaattattctaagagagaataagaggaaaagagaaaatgatatatttacttgctttaattccagcaattggttggggtgcgatgccattaattactggtaaaattggtggttcaccagttaatcaaatgtttggaatcggtgctggagcttcaattgtgggaattattgcatatttgataacaaaaccaaccgtcagtgtaactgctttttggttctcgctagcgatcggttgtttatggacaattggacaggttggtcagttcatctcgtttaaacatatgggagtttcaaatacgatgcccctttcttcagcatttgtgttagttatgacgtcgtttgtcggcatctttttctttgatgaatggcaaggagccagagcattaagtattgggttgacagcgtgtgtagttgtaattattggggctgttttaacctcgatttcggacggaacatcggataaaaaggtttcgactaagtgggtattatttttattagtaacaacaattggttactgtgcttattcgatttttcctaaaatgccacaggttgctcatgaaagtagtcagggtattttcctaccagaagtattaggaattttacttggttcagtaatttatactatttgttcgggtaacgctaaagcatttaagcaaaaagaacaatacttaaatattttaggaggactttcatgggggattggtaactttgcctatgtttttgttggtaaagctcttggagtagtgactgcttcaatttttggtcaaatgaatgttattatttcaacatttggtggtatcctacttttgcatgaaaccaagaccaagcgagaaatgatatatacagtagttggaattatcctaattgtaattggtagtattttaacagtaattgctaattaattattgaagattttaggtaatatcaataaatgagagaggaaacgcgcaaaatcagctttttaaccgattttacgcgtttttttagtcttatattatttcccaggttatattgtgctatttcttatcaagtagatcaaacctaatttgtccaagttgtaatttttcaggttgtttagccccgtggaaaatcagtttaaataatcgattttcaacgccagccttgaaaacaagttgtttatcgccaatattaattgtataggtgtcaccttcacttactacttctgcctgcaagagggctgaccattgtttagcagcctcttctggatcactaacattaaagattgcttgcttaacaaaaaggtcacctgccggatggaatttaattaagccctgtttcttgaggtcttcccggcgttgatcatcgttgttgccccattgaataaagaatggtgcaggtaaatggttaacaagttcatcattgacatagaaaatcttccattgaataagtttaccggcaggatccacgcgctttccatcagtaatatcaccaacattaagccccagaccctctaatcgctggtgagtttcttcaatattgtcagtccgaatggcaattgttgtgatgcgctgaataccagcaacataatcttcaacggcatcatgaattgctgagttattttcatatgggaatgccttagctttttccttattagcgatggttaagagctcaatgtaattaaggccaaaataatctagtgcattttttgttccccaatattcgtgatgtccaccaggggtaaaggctaaacctttagagttgaagtaatcaattgcatcttgaaggttagttacatcaaccattgtatgatcccaatttaacgtttctgtcattttaatcacccttgttctgtttgcctaattcctttgttcgtttaacagcagcaaggacagcattttcaattcccgctgaaaaagtgcttttatctagttcatgctgggcggtgatacccactccgccagcagaattattaatatcaagtaattcggcagggtgtttaccactttgttctacaaatgcagcggctgcgcgtagattctcaagagcaagtttgtttgcttgttggcgaggcattccggcaagcacacctgcgtttgtaaaactaattagaaagttatagatatagtttggtccagccacgccatatccagtaaatacatctagcaaggattcatcaatgtaatcgacttttccaaaactatttagaaagtcttcaatgacagtttgattagctcgattgtttttaacgacgccgctataacccatggcaacatcagtcaaggtattggggatgatccgtgtaattgcaaaaagatcttcctgtgatgaaagttgtgcaactgttacgccggcaataattgaaagcacgtccttttggtagtggtgggcgacaagttctttcatgatctcttgccagttatcttgtggacgcactcccagaataacaagatcagcattctcaacagccgtccaatcaggttgttgacttgcttgaatatgataagtatcagtcaaataattaactcgattgctcgaaatatctgttatcccagttgtttcaggagtaattacttttttcttcagtgcagcccgcagcattgcttccaccatttgaccaccaccaaatgagtaaatcttaagtgtcattgaaacatcatcctttctatatgtacctaacctaatcgtagcgtatttcaaaccgagacgctaatttaaacacttctttcaaaaaaataaattcacaaattggtctacttgaaattaaattaacaaggaagcgtttgctgtataataaaattgttagttataaatataataaaagggcttttgtttgttaaaaaacaaaattttcaatatgaggtaattggattttgatggagtaatattagttgaattggtctatgaaatagttgtaaaatgtaagcgtttatttaaggaggaaccataatggcatatcaaagtatcaatccatttacgaaccaagtagaaaaaacgtttgaaaatacaactgatgaagaattagaacaaacattgactacggcgcatcaattatatttagattggcggaagtataatgaccttgaagaacggaaacgtcaaattttaaagttaggtcaaatattacgtgaacggcgtgttgaatatgcgacagttatgagtaaggaaatgggaaaactaattagcgaagcagaaggcgaagttgatctttgtgcttctttctgtgattattatgcagcccatgcagatgaatttatgcaaccaaaaatcattgcgacaacgagtggccgcgccaaagttttgaagcaatcattaggaattttagttgcggttgaaccttggaatttcccattttatcaaattgcccgggtatttattcccaactttattgcaggaaaccccatgattttgaaggatgcatcgaattgtccagcatcagcccaagcatttgctgatgccgttaaggaagctggtgcgccagctggcagtttaactaatttattcctttcatatgaccaagtaaataaggcgattgctgataagcgggtagccggtgtttgccttactggttctgaacgtggtggtgcaaccgttgctaaagaggctggtgctaatttgaagaagagcactttggaacttggtggtaatgatgcctttattatcttagacgatgcagattgggaccttgtcgaaaaagttgccccggcagcccgcctgtataatgccggacaagtatgtacatcatcaaaacgttttattgtacttgaaaaggattatgatcgtttcttaaagatgatgaaagatgcgttctcgaaagttaaaatgggtgatccgcttgatccattgacaactcttgctccactatcttctaagaaggctaaggagaagcttcaaaaacaagtagatacagctgtagaaaatggagccaaagtttactatggtaataagctggtagatatggaaggacaattctttatgccaacgatcttaactgatattactccagataacccaatatttgatacggaaatgtttgggccagtagcttcagtttataaggttagttccgaagaggaagcaatcgaattggctaataattcaagctatgggttaggaaacactatctttagcaatgattccgaacatgcagagcgagtagcagcaaagatcgaaactggaatgagttggattaatgcaggctgggcttcattaccagaattaccatttggtggtgttaagaattcaggttatggtcgtgaactcagtagttacggaattgatgaatttactaacaaacatctaatttacgaagcacgacaataaaaattaattaaacgacgcaaataaagggatcgcaagtttggattgcggtccctttagtattacctgggaaattattgaattcttttcaatacaatcttgcaatattgtcttacttcttatatacttagttacataagtgattaactacaaaattgctatttggaggaatattcatatgactgcgaaaagaaacagccatcataaatctcgattacgacaattatttgcaacacgtcgacgtcggtggattggcatcggtggcctaattgtaattataatttttgtattagtttcaattcgacatgcaagtgaggaaaaagcaacagaaaaaaatgaatataatattctacgggttactgagcagtcagattttaatctgacaggaaagattgaaccagtccagatgcaaacattaaccttgccatctggtaacctgcaaaatcttaatgtgaaaaacggagatcacgttgcgcaaggagaagcgctcttaaccatgcataatgatagtacacaagatagtgttactgaactgcagggagatcttagtaaaagtcaacgaacgatgaatgtccaacaacagacgattaataatttacgccaacagttgaatgggatggggcaaggtgatgaagggtacaatgacctgcgcaatcagcttaccgaagcgcaaaatgcatatgcagacgcacaagcaagtgttgctgccactcaacaacagcttagcaccgcttcaagcaaggttaatcaaacattaacagcaccttttgctggttatgttacggttgaccaatcaaagcaaaatgctcctgtaattactctttactcagatacgcttcaatttgtcggtcaagtttcggaatatgattatagtaaacttcatcaaagtgctgatctaaaggtgaaggccttagcaacaaaccgaactgctaatactcaggtaagttatctttcaacaattccaactaaaaatagtggaaataataccaaatatgaagtaactgctaatgttagtgctaataaatttatggcggggcaaacagcaaaagcttctattaaacaagatggagttcaaattcccaaatcggcagttcgtcatgggaaggtatttgttgttgattcagacaatcgagttcgcgagacagatgttagtggccgggcagtcaacagctcttatgttgtgacagacggtgttgatgctggtgatcggattgtgactaaccctaacagtaagttgaaaaataatgcaaaggttgattaatatgatcaagctaaagaacattaataaatattaccgtcaaggtagccaacgttttcatgttctccatgatattaatgttgacattgagcaaggagaattagtagcaattatcggtgaatctgggtcaggaaaatcaaccttgattaatattgtaggctttcttgatgatgattttgagggaacatacttctaccaaaatcacccaatccatgattattcgcgaaagcaattttcaaatttacgaaatcaaaatgtcggtttcgtttttcaaaatttcaaactgctacgtggatcaaccgttgcagataatgttggattacccttgctatatgcaggaaaacgacgtcgtgaaattggcgaacgtgtttctgaagtcttagagcaagttggtttagccggatatgaaagtcaatttcctaaaaatatgtctggtggacaacaacaaagagtatctattgcccgggcaatatcaacgaacccgaaatttttaattgctgacgaaccaacgggagcactcgatacagaaacaagtcaagaaattatgaatctttttaagcgattgaatcatgaagaaggaacaacgattattatggttacccatgatccccatgtcgctgaacaatgtgaccgagtaattaaaattattgatggtcgaattgtaagtgacagtaaaggcggtgaatatcatgcagacaattgagttgatcaaatcagctatccagtcattaaaggcgaataaaaagcggagtttcctaacgattatcggaattatgattggtattgctgcagttattgctatccttggaattggggacgggattacgaaaacgatgtatgataagttcggtaataatgctaagcaaggccagcaaacaaccgaaatcgtctataatcctgataatgttaattcgactgtcaatggattcacgcaggaacaagttgctgatattaatactcaatttggtggtgaaattaaaaaggctgagattgagcaggaatcagataatctttcaacacatgcagatattggtgatgcgactaaatcagtgacattaagcttattaaaggaaccaacccatacggtaaaactgattgcgggtcacaactttggtaaacgaacttttgaactaggggaagctaatgtcctaatgagtgaaaaagtagctaaacggcagtatggttcagcacaaaatgcgcttggcacaactgtaacaattaataatgtcacttataaagttacgggagtatataagacacaggcacaattcactgatgatgggaaccaaaactcatacggagttgatttattattaccgaagaaagtttactatcaaggagatagtgctaaagaaggaaatacgcttaaattaacctttagccagggtgtaaatgccagtgctatttcccgcagagtcgcaaagtacttaaaaaataatagttcagcagcgactcaaggaacctatcagtacctagacatggaaaaagcccttaagcaattctcttctcaaatgagtattattactactttcattagttttattgcggcgatttctcttttcattgccggaattggggtaatgaacatgatgtatatttcagtttctgagcggacgcaagaaatcggaattcacttagctgtgggggccacaccatttaacatcatgatgcaattcttagtggaagcagtaattcttaccatgacaggtggattattaggctttttaggcggcgcaggattggcgcacttactagcaccgcttttatcaagtgcgattggtggtggcggcattcatattcacgcccatatttcacttaatgctttcttgttggcatttggaacatcggcagctgttggtttgatttttgggatcttgccggcacgccaagcagctaataagaatttgatcgatatcttgagataagaaaatcctcagttttttgctgaggattttttacgaattctgcagaatgtaaaaaatatcaaattattgagtataataaaaagataaattaaagtgaaatattaggagataggaaaagatgagtaaaaacaggggtaaattaacggttgtttcattactagttgtaattattgtggtatgtgggggatatatgctattacatccatcctcatcaaagaaagttgctagtgaaaaagctactaagaccgagacaatcacaagcagcagttcatctaaagaacataaagcagctacagaagatagttcagataaagttaaggatgatgattctgatgattcgtcttcagtagctgatactaatgatagtgaggcaacttctgcatctgccacagtaagcagtggtaatcaaacagcccaacctgcacaaagtcaaaatacaacccaagcaacggcggtaagtaattctggtcaaactgctagtcctaaagctaccacgaataactataagggaaactgcagtgtcgccaacacaaataaccggtggacaggaagccgaaagacaacccaagctgcatcaactcaacaacctgtaacagtggaagatgggatgaactttagctaccgggctgcgcaaaaagctggcgtgattgataataatacatctgttgaagagttttacaaaaatgccaaggaaggtaatggctctgtaacctacaacggtcaaactatttactacaaagctaagggtaataatcaatatcaagttacaaccgctaaatagtttgattactaaaaaagtgtccggcattttgtccagacacttttttagtaaaaatactatgaaaaatgtaaaatatactaattgtttgcgctttagtatataatgaatatgtttattaagtgatcattcagtatagaaatatacttaaaggtttggatgttattggagtacttttatgcaaaaactatctattaaacaactaataataattacattgtgcttattagtgctggtggttggctgcatgactattcaccagcgtcgtcattttaataagaacgttaagatcgataatgtggcagttggtggattgactgctaagcaagcattaaagaagttacaagataatccacaatcgccaaaaatttatgttaacaatgaattagtatttaaggataagcaatcagtagcaaagtttagtagtgctgacaaacaaaaaattaaaaatgcattacatagtcagtatactttcttcccatcatctaaggcaaagaacattgcgattaagcctcaaaatgttaatcaagatgaagtatcaaagattgatcaagcagtcagtcaaaaggtaacagaactaaataatggtcgaaaagctcctgttgatgcttacgcggtatacgaaaatggccgagtacaagtaaaaccagcagttggtggtactcaatacagtttagatggtttgcataataaagttgaaaatgaaattgctgggggaacagttcatctgaagccaaaatatacgactccactttctgcaaatagtaaaactgttcagaatgaaaaagcaaagctcgaagaattatcaaaacgaactgtaacataccaagtccaaaacaaaaaatatcaattaaattgtggtgagattattaccagagcaacctatcaaaacggaaaataccactttgacactggagcagctgattcaaagattaatgaaattaataatacccaagcaactcttggcaaatcatttgaattcaaaacccatgatggatcagtgatcaaaacaacagatgctggctcatatgggtggaaaatcagtaagaaacaagctggaaagactcttacgaatgcattggttgcaaataagcaaacagtaaacgccaaaaatgatatctatggtaaaggatataatcaacaaggaactgggtataatactacaagcaacaatggtataggggacacatacgccgaagtttcactagccgaccaacatgcctggttttataaagatggtaagtgtgttcttagtactgatattgttagtgggacgaataataaggataatgaaactcctaagggtgtctggtatatcatgtaccagcaaacaccgtctgtccttcgaggccttaacgatgatggttcgaaatatgcaagtaaggtccaatattggtcaccatttactgatagtggatgtggatttcatgatgcaagctggcgtcatgactggtcaaaacaggcttatcttgctaaaggtggtggatcgcatggatgtatcaacatgcatccagatgttgctggtcaagcctttcatgacttacagaaaaatgagcctgtaattatctactaaaggagaatttattatgcgcccaagtgctgaacgctcaataatgattgcggttatttgtttcatattaacaattattatttcattcgccatgtctgagggatggataaagtagggatttaacgatggatttagaaaagaagaaaaatttggtaattattaatctattttatgtaggattaattttgatttactgtattttacatgcaggaccactgaatttaatggtgtttttgggtatgttagtggttgcaaatttaatggggatgttaattaaataatggtttagaaaatgattgatttaactttaccacaagcattcgtttcgggctttttaaatgtttttgaactaattattatttggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggctaattattatttatagactagtgacgggttatttgaacaggaaaattattttagttgatttccttgcaagcttagttattatttgcgttcctgttctagaaggttcattagagtttccattaataatgatatatttatggctgtttgataggaaacatgatcgtcagcaaattatatataataaacccgtggtgctagttaattttttcctagaggaaaatgtctaaacatgttggtaaattaacaaaaaaatcttatttttatggtcttaaaattcatgtgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccatagcttacttggaaaacaaagaaaaattaggttgtcaaaatttcaactcacattctgttaaagggctagagagtagatttgaaagcatattgctggcttacagtgttctattaagtcgagcacaacgacgttttgaaggaactttgagatattctttaggatattaaaattaactagcaccacgggtgatttatagtatactatgtcaaaaggaggagttaggtgaacaatcaaatcacactagcatatttagatcatgatgatctagatgctttacaagttgtaagtgttgtcagtttttatgaatcgtttatcgatggcgcagatccacttgatatgcaagaatatttacagacacaattgacaactgaaatattggcagtagaattggcacagtcaaccagtaaatttattggtattaaggatcatcaaatactcattggttatatgaaagtcaatgatgaaaaagatgctatagagattcaacggctctatctgctcaaagattatcaaaacaaagggttagggcaacggttactcgatgaagcgaatcgttatgctaaaacgaaacaaaaacgttatttacgtttggctgtttatgaaaaaaatcatgcagctattcgtttttatgaacgttatggatttaaaaaaatcgggatcaaacattttcttttaggaaaacaagatcgtatttgtccgattttagaaaaagaaatctaaaaaaacgtcctcacttttgatgctgaggacgttttttagactggtagtggaaccataattcgctttcttttttgataaaacgctaattccgtcacaccttttgctttggtggctaacttcattctataatccaccattttagatattccggatgcaagcgatgtttatgaaaaaaagtatctgtattttttttacagttattgggatctttgctactatcaagattttatttaaaaagtaaatggctgggaagaattttttctcctcagccattttttcaactaatcaacttttacaaatccatcttgaacaaatttcgttccgtaggtcagagtgttttccacgggacactttgcggcaacgtcagcgaggaacttcttgatgtcttcatcagactcgctgctgcgaagatgtggttggtaacggatctcagtaaacttacgaacattcttaccatcagcaacgtcttcacggccaaggtcaccttcgattgttacccaaaaagctcgtaagtcaaagttacgttttttagctaatgcctgagcagtaattgcttggcaggcaccaaatgacgcaaggagaatttctactggattcatccccgtatttgtactttcaggttcatcaaaggtaatttcaaaaccacgggtacctgctgaaacttgcatccccgttgttgtcttagttgctgttactttatatttactcataaccgtgccctcctttaatacccatagtgtaatcgagacgatacttttggtcaatgagggtgctcaattataaggtgatttcatgtgatgatttttcgccattaaggattgccatcacatcatcaagtgaaatatccaccatatttttgaccgctaaattagtaaagaaggcaatgtgaggcgtaagaataacattatccatttcgtgtaattctttaacaaggggctgatcatcaagcccttgttctcgacgatttgtggccgccaccgtttcttcaccttcaaaagtatcaagggcggcagctgcaattgttcccttttttagggcggcaactaaatcagctgtattaacgactggaccacgactagcattgactaaaccggcagttggtttcatcatttcaaagtcgttagcagtcaataaatctttagaagttggatttaaatcgacgtggagactaacaacatcggcttgctttagtaattcttctttagaaacgaactggacaattccatcgaggtcagtgcgcggattcgtgtcataaccaagaacagtggcacctaatgcatgaagaagctttgccagggttccgccaatgcgtccaacaccaataattccaatcgtggcagtatgaatttccgttgattgttcatcactaaaccagcggaagtcattttcggcgacttggtggtcaaagcggtaagttttccgaagcaaccggaaaatctgcattaatgcaaactcggcgacactccgcggtgaatatgctggtacattggtcacgactaggtcattttcattagcctttttaatgtcgaccatgtcaaatccagctgtccgcgttgcaatctgtttgagcccattggtatggagcttttcataaatatcagccggaactttactacgttgctgaatcacgagtccatcaacatcggcagttaattcaacagcatcgtcaatcaatttcggcgttgtgatgatttcgatattatgttcttttgcgtattcgttaatggcgatttgttcatcgtcccgcacactagtcattaagatttttgtcatgttaatcctccttattaatgaaggctgcaatgttatcaagagctctggttagattttccatactggtggcgtaactgattcggacgtaaccttgaccgccagcaccgaagaaggaaccaggaattacagcaacttttccttcattggcaagatctgtcgcaaatttaaggtcatcattaccatattgttcaggaatcttggcaaatacgtagaaggctccttgaggattaatcagctcgaaccctaatttttggaggttattaacaacaaaatctcgtcgttgctcataggcatctttcatttcttgagtagctgtttttccttcgttagtaccaaatgcggctactgcagcggccattgctggattagaagcagcggttactaacatcgcgtgaatggcactgactgatttcatcaattcttgcggcccagcgataaaaccaatgcggtacccagtcattgcatgtgactttgaggcaccatttaaaattagcgtttgttcggggatgtaattagcgattgaagtatgagtagctccgtaaacaagttccgagtaaatttcatctgcaattacaatcaggttagttgatttaaccgtatcggctaatactttaatttgatcttgggtgtaagtaacaccagttgggttggaggggtagttaagaactagtccctttgcgttaggatgttcttctaggacgctttggagtcttgcgggtgtgagaataaaatcatcgctgcttgtatcaacttcaatcggaatcccaccaagaatctttgtgacagccatgtagaaggggaaagttggggttggaatgataatttcgtcgccaggattaataatggtagaaagagaagcgaaaattccctctgttgcaccaactgtaaccgcaatttcgttttctggatcgtattctagctggtaacgatcttgcataaaatgagcgatggcttggcgtagtgctaaggttccacttcctggagcatagtgtgaatcattggcattgatgctatcgattgcggcctgcttcatcgcggctggtacattaaagtctggttcacctaatgttagtttaatgatgccagggattgagcttacctgataatcaaattcgcggattccaccaggagtgagtttagtgaaattattgttaagacgattaaggatttcttttttagtagctggcatgataaattcctcctatatagtatgtagatttagaaataaaagaagccctgaatgctataggaataacatccaaggcttcttgatcagattggaatgagtataaaagaggctctcggatgtttgggggtcatccgggaacatcacaatgacaaaatcactgctggttagcggacggtaattgcgctaaaccagaagacatacgcttgattcaagtgaattgtcgcagtgatcatcattgtgtcctccttttgattaactgattactaataattctaatcattttttaatttttgtcaagcgttgattgagaaaaactattaattacaaaaatatttattggttacaaatgtaaatataacaaagtttgaaaatgtttgtgattattagttcgcctttagtttgatattaaaattatattctacaattttttttatttttttgtgtcttttttgttgtcttactccacaaatgtgatataatattaatcgtaaaggaagtgagtagcaatgcggatcgacatcaaacattatttggaagttaaccacttgaccatttatcaagtttccaagcgttccggttacggctacacgactttacacaaatcgtttaacaaaccacagtctagttcgacctcgcttaacctgcgtgatcttgatgccttggctcgtgctcaggacaagagcatgtggaaggtccttaaagaactagaagagcattacctcgaatgagattgtggctttgctgtagccacaggaagttaaatgcgttaacttttaacttctagaatacttagactacgaaacttagaaaacaaaatagtatatttaattgaggaggaattgcatatggctcaaaacccaatgaatccatttgacaacgacatgaatgacatcttcaatcaattaatgggtggcatgaatggtttcaattctgataatcggcgttacctaatcaatggtcgtgaagtgacaccagaagaatttgctgaatatcgtagaactggtcaattgccaggcggtgcaaatcctcaacaaggtgggcaacctggccctcaacctaacgcaggtaaggacagtatcttacacaagttaggtcgaaacttaactcaagaagctcgtgaacatgaacttgaccctgttattggtcggaacaaggaaatccaagaaacagctgaaattttaagccggcggacaaagaacaaccctgtattagttggggacgctggtgttggtaagactgctgttgttgaaggattagcacaagcaattgtttccggcgatgtaccagctgctatcaaggacaaggaaattatcagtatcgatatttctggtcttgaagcaggtacccaataccgtggtagctttgaagaaaacatgcaaaagttggttgatgaagtcaagaaggctggaaacatcatcctcttctttgatgaaattcaccaaattatcggtgccggttcaactggtgattctagtggttctaagggtatgtctgacattattaagccagcattatcccgtggtgaactaacagttatcggtgcaactactcaagatgaataccggaacactattatgaaggatgctgcattagcacggcggttcaatgctgttactgttaatgctccaagcaaggctgatactgtagctattcttaaaggtatccgtgacttgtacgaacgtcaccacaatgtaaagttaccagatgacgttctccaagctgctgttgattactctgttcaatacatgccacaacgtgcattacctgacaaggctatcgacttaatcgatatgactgctgctcacttagcagcaaagcatcctgcacgtgatgctaaggcaattgaaaaagatatcgaagcagaagaaaagaagcaaaaagctgctgctaagaaagaagattacaaggctgctcaagatgccaaggaaaagattgctgacttgaagaagcaattgagcgaaaactctaaatctgaaaaggttactgctactccagaagatgttgctaaggctgtagaacaaattactggaattccagtttcaaagattggtgctagtgacgttgaacgtctaaaggacatggacaagcggcttgaaggcaaggttattggccaagacaaagctgttgaagcagttgctcgtgctattcgtcgtaaccgtgctggatttgacgaaggcgattcaccaattggtagtttcctctttgttggacctactggtgttggtaagactgaacttgctaagcaattagcccttgatatgtttggcagcaaagacgatattattcggttagatatgtctgaatactctgaccggacagctgtatctaagatgatcggtgctactgctggttatgttggttatgaagacaacggtaataccttgactgaaaaggttcgtcgtcacccttattcaattattcttcttgatgaaattgaaaaggctaacccacaagttatcaccctcttgcttcaagtacttgatgatggtcgcttaactgatggacaaggtaacactattgactttaagaatactgttatcattgctacatcaaacgccggctactccaacgatgctccagttaagatgggtcggaacgaagatgaagaagacttaattaagaagttgactgcttacttccgtcctgaattcttgaaccggttcaacgccattgttgaattccacagtttgactaaggaagacttgaagcaaatcgttgacttaatgcttgctgaagttaaccggacattagctaagaagggaatgcatgttaaggttactgatgctgcaaagcaataccttattgatgaaggttacgatgaagccatgggtgctcgtcctcttcgtcgggttatcgaacgtgaaatccgtgataaggtaactgattactaccttgaccacctcgatgcaaagaaccttgttgctgaaatgaaggatggccaacttgtaattgttgacgctaaggacgcctcaaaagacgatagtaaagaatatacctcaccatctgaaaaaaaggatgaagaaaaaaacgataagaaggaagaagacaagaagtctgacgaagataagaaagacgaaaagtaattttcctttaatgtagaaaaagacataggatgactctgaaatgagttaacctatgtctctttttgctttaaataataaacattattaatgatctaggcaatcactatggaggctaaaaactaattaggatagttgaaaattgatggtaagatctgattttatgcataaaattattgggattaaggagactctcttttaaaacgaattgcctaaaaatatcgaaaaaatagacaaaaataagtgaaaaaatagtctattttggtgattggcttatcaatccatttattcagacgacaaatatattagcaaattatgattagttaaataatcaatagaccacaagtgctattatatcaacgtttgttcgaattaccagctgttaaataagggctgaatagtgattgtttattaccccactttatctgtatcattctttcacagttgtctctaaataagacatttgggcaaaaatgaaacggtaataatttgtggattttagtgtaaagataaattcgtttagtaacttataattatcgcaggaacagatttgaaaaaatttaaattttttacgggctttttcaaatagttttaaacaacaaaaatgaaatgttgatacatactatttgctaattgcttgattagccattaaatattgatataaaggcatttcaaccatagttgcaaaaatattcgtttgattttcgtttgattaatgaatggctatttcgctaataagtaaagcaacttaacgggtgaatagttaaaatgcaaaatgatcttttcggaaattgcctctcttgtaatccctcaaaaccttgatatagtaggaactgttaagtcattaagcaataaaccttgcatgaataatttattttcttttgaatattttttcataaacgggggtttattaaaatgagaaattcgaatacaaataattggcgttcaactgctctgattgcgggggcaatcttgacagcaggtgtcgttaccaccacttcaacgacagatgtacacgctgataatagtcaaaacaatgcacaagtaagtaatgaccaagttacttacgaccaagttcgagcaactgctgatcagcaacttgcacaattgcaatcagctaatgatagtaaaaaagctcaacaagctacggccaacgagcaatcaaatgctgcggatcttgcacaaaccaacgcacaaattgatcaattaaaagctagtcatgctgctctagaacaagaacaagccggtgctattgcacaagcacaagcttctactgctgcttctattgaagcacaaacttcagctgctaatgctgaataccaacagcaaattaacacacaacaacaaaacgaagccactcaacgtgcagcaaatgatcaacagtacgcacaagctgttagtcaagccgctgaaaatcaacaagctgttgctgatatcgatgcacaatatcaaaaggctttaagtgatgccgctaatacgcagacaagccaagcacaggctgctgccaataattacaactcagctgttgctaaggaaaatgatacttaccaaggtaagctatctgctcaacaagcaactaatgcagaaaatattaaaaatgctgaagcatctcttgcatccgcaactgctaatgctaacaagccatatgaagtcgcaactactaatgatgttgccgttactggtcgagttgctaaaccacaaacagatgttaaagttcctgcttatgtaacaaaatatggaattcatctagaagttcgtggttataatggtgctattcctgtatctgattatacttatcctgaatttgctaatacttactatggtgaataccctgatagtactgtaatcacaaacaaggctgctgaatcaactccacatgatatttcagaaatgccattaaacttccaaccaggtctattaagctatgatgctaaaaatgaccattcagaaaaagtttctgctgatggtttaacggctgaccaagttcaagtattacgggcattagctctttcatgggaaaatggtttccgtaacaatgttttccaaaactaccgtgaattttacaatgtggttaataagaatgatggttttgtaaacgttgctccagttaatttagtaagtactgactttactgataacattgcaaatcaagttgttgctaaccggacaaagtacaatattgataataataaccatactgttatcagcagtggaatgcctgccgaagcaacttatactagcgttattaatgatgcaaccaagaacttgaaaaagaatttaacaagtgaattcaatggtaagacagtttacactgacgttaacgaaaacttaactactacgcaagctggaacgccaacccttcttaattacgctattaatctctacaactcaatgcagggtatgtactatggtgaattagtaaacccaacacacatcggtggacatgcagttaaccttctttgtgctggtgttcgaactgtgggaattggtttccaaaagttgactgatgaaatgactgctaagaatggatcaggtgtttctgatcgcaagaacccatcatatgctgtaacgtttgatcatgtcggatttaacattgatcatgatgctaacttaactaaagaagttcaaaaccgtaatgtatggggtacttcaactgttgatgcgcaattaaatactattaagactgctcaatatcacgttaataaggtgccaggcacaaagacagttacgccaactgctactgatgtgcaaaaagctactgctagcgaacaacaaaaattagctgatgttaaggcacaagcacaacaatcccttgatgcgttagctagtgcccaccaggctagcttaaataagcttgcacaacaatataatgatgcgaaggctcaagtaaaggctaactatgatgttgcagttactaaggcagctagtgttcgtgacgctgcccttaaggctactggagttgttgatcttcaagcttacaaagctcaattagacagtgcctaccaaaacttagtaaaggcagaccaagtagctgctcaaaaacttgctgctgatcgtgacgctaagatcgccaacatcaagaaagctgaaaatgtaaagcttgatgctaagattaatgaacttgttccaagcgttgatccacaaatcaagcaattacaagatcaacaccaagcagttattgctcatggtgatgctgttcttgccgaactaaaggctgaaaataaggctgtttataacaaacttgctgaacaattcaatgttcaattagcagctattcaacggcgtgaaaatgctaagagagctaatgaagttcgtttagcaaataatactgttgtccttccttcagcagtgaaagttgctaatgacggtaatactgatactgttgccttcccaacagcttcaaaccctctacaagctgaaactactggacgtgttcaaactgtttcagcaccatcaattgtaaagacagctacacaaacacctgttgcagttacaccagttgttactacagtaaatcatgctgctgaaaacactgttaagagtaatgaaagttcagctccagttgtaacacaaaccactgcagttaatggtacacaaacatcggttgcttctactgctgataacaaagccactaaagcagacaacagtgagaagtcagttgtaaaagctgatactgttgctaagaagagtgaatcatcacaaaaggttgatcaatcttctatgtcaattgttgctttaactaccactgcattacttggtacacttggtatcacttacagttcaaagaagcgccacaactaatccgaaacgattaataaatacaacaaagaggctgagaatatcccaacctctttgttattttaaactgttattctcttttgtatcctatagcttatcaatcaatggttgcataaaattattattgattcgggtaagcttatgatggtttcctaagtttagttcataggctaatcgctcgggatcattttggtcattaactttaatgattcctcgtttcttaaagttaaaattttcggcaatgtgctgcatcgctttattgctgcggtgagtatcaacccgaaaattcttaattccttgcatttggccaactgttagtaagttagaaaatagcaatttactaagtccttggccccgataattactgctgatagctacccggtggatggtagcataaggctcatctggttgttgccactgtccctgtgtaatgttgcggtaggttggttcgggtgtaagttgaagagtcgcagtagccactactttattatcattaattaatatccagtttgtttgcatcacaatatcttgagtaaaggtttcctgatctggataaccgttttgccattgcggactaccatttttctttagaagctcttttgcatcatcaattattttcataatcgccgttaaatcttgaagctgggcgcgtcgtaaatatatttctgccattattatcctcccctgattaataatatttctattgtacgacatttagccttattcagcggagaaaataagcgagattatatttcagaaagaagtggtttgcgttagaatgaaaagcaatgaaatgaatggaggataagcgatggcattaacatggacaattatttggtggtgtttgctactggttattctcttcaatgaaattgcggccatttatactgttttccgcgaaaagcgggatattgctgcaacttgggcatggttattggtgctaacgctgattcctggttttggctttatattatatgcattctttggacgaaaattaccacataaacaattagcccgaataaaatcccaaacgcaactaaaattaaaacaagcactagaaaggcagaagcaacaattcatcaatatgccgaagcctaaagatcaaaccgtccagatttatcggcggaccatcatgctttttcaaagtattgatgactcatttttaacgcggcacaatgccgttaatatttttacaaatggtaatgcgctttttaagaaaatgtttgatgatattgcagcagcaaaaaagagtgtccatattgagttttatacaatttataatgatcaaattggtaatgaattacggacgttacttgaacaaaaggccgctgagggagtagaagtgcgagttctctacgattcatggggatcgatgggagtctggccaagtttttatgatcatttacgtgaagtcggtggttatgcggccccgttcctgatgtcgcgaagtaacttctttgattttcggataaactaccgtgaccaccggaaaatcgttgttattgatggtgagattgggtatgttggtggttttaatgttggcgatcaatacctaggacgcgtttctaaatttggtccatggcgtgatacccaccttcgaattgtcggtggtggcgtttatggtcttcagcgacggtttatcggcgactggaatgcatcaatgaaaaaggatgaagataagattgtgcattaccatccttactttcaaccaattagagttcatggggacgttgcattgcagactgtctctagtggtcctgaagcgccattggaaaaaattaaaatggggtatttacgtctaattaatgcagcgcaggaccatatttggatccaaactccctatctgatccccgacgatagtatattggatgcgttaaaagtggcagctcattcaggaatcgatgtacggataatgattccttcaatgccagatcatgcttttgtatatcgggcaacgcagtattatgctcgtgagctcgctaatcatggtgtaacaatttattactatcaaaaaggtttccttcatgccaaaacaatgatgattgatggtcggatggcttctgttggatctgctaaccttgactttcggagttttaaattaaacttcgaaattaatgcctttatttacaatcaaaatacggtagacgatcttgagcgaatttttgttaatgatattcgtaactgtcgggtgattacaccagcaatgtttgcagagcaaccacgctggttgaagtttaagcaaacagtgtcacgtctgctgtccccaattttataatgatagaacagagctgtgacattagttaggtcacttccacaaaatacgaacagcgcagtacaacaatggccttcagcgtccggcaaagtcgaacgctgaaggcctattgttgcttgcgggagctcgaaaacgaagtcacgagtgacttctgtctcgctcccgtttttagctaaagaatatatgttcgttttatgataaaattagaggagtaatttaggcgatagaaaggattaaagattatgggaaccctgggatttgttttaggaacagcagcgatggatcatcagcaagtgttgattgatcaattagttgaccagataaagaatgcatctgctgatgagagcttttattatttggtgcctaaccatattaagtttgaaactgaaattaatgtccttgctggtcttcgtgatcgtcaaggatttagcggaagtgacagattcgcctcttcacgcatacaggtactttcgtttagccggcttgcttggtaccttttacgagatactccagcttttcaaaaacaacacctttctaaaatcgggatggcgatgctcacttcccaagttgttcaagaacaggcaagtgagctccgtttatatgcaagcgaagtaaaacaacctggctttattcaaaagatgacagctcagcttgaagaattaaaaaatgctaacataaccgccgatgacttaactgatattatttcccgggtgaagtccgcgaatgacccagcagctaatcaggcgtggcttgctaaaatgcatgatgttgagattatatatcatgcttatgaagatcggctacgggaccggtacattggtaataatgagttatatcggcaattagtgtcttaccttcaaaaatcaccagaagctgctaagatgcacttctttattgaccgttttgctcagtttactgcaaatgagcaacaggtagtggatgcattaattacgaatgccgcatcgacaactatttctttaactcttgatcgtggatatccagatcagaaccatccaaatccccaggaacttcctcctaaaaataacttgttttattcctccgcgatgcaatttcaccgtttgtggaaatttggtcaaatgcatcaaaaagaagtaaaggttttgcaaaatgtagcgtttgcgacgactcctcgtgttggtgcggaattacaacaagttgattcgtattttaagcgttatgcaagcgaaccaattggccacagcgagcgggaagacctttcttgtcccccaaatattcaatttatgacaactaccaatcggatgactgaattgaataatgtggccaccaagattcgccaattagttgctagtggtaaatatcgttatcgtgattttcttattcttagtcgccaccttgacggctatcagacaatgattgaaccagtttttgcggcacataatattccagtttttaatgaccatgaacgcttgatggataaccatccactagtaacacttcttacgacattattagaattaccgcagcggggctatcgaacagcagatatcatccaattgctgaagacatggttacttgttccacggacaggcactggcgatctgatggggctaagtgatttccaagcagctgttttcgccactgagaattggtgccttaagcaggcaattgaaggaaaaagtgcttggacaactaatgatccagaaaagattaagcaattatggcaggcacccggaacgaacctaacagaaccaaaatatgcgcaatcacggttgaaaaaattaaatgaccagttagcccttgtaaaagattttgttgcgaatcacttattgccagttttcgaccagtttaaacaagcacaatcaggccaagaacttgccactgcgttataccagttcttggccgctatgggagttacagaccggttatacgcttggcaacaataccaaagtacccgagatttagaccttgcgcgtcaaccacaacaagtctggactaccttttgccaaattctccaagaatatgtggaaatcttgggccaacaagaactacgggatggaactagtgaggtccttgcagattttagtgaattgctccaggcagggtttgcggctgcccagtattcccagattccggcaacgttagatcaagtggtagtctctgaaacgggaattgtccaaagtgaaaatcgaaaagtagtttttatgattggatcgactgatgatgtgatgccagaaatgcaagaaagcgatagtttgctaactgaccaagataaggatgttttgagtgcttatcttgatgaagatttccaataccttcctggaacggcaattgaccaactgattgatgagccatttgttcactatactggttttatgaacgctaaggaacagttgattttctcggcaccgcaaactgatagtgatgataaggaactcagtatatcgccatatatgcatgatatgtctcgctactttggtcaacctgttcgtgaatatccattagctactagcaaggccggacaagagaatgctattgattttgtaagtgccccactcgcaacaataaaccggttagtcgaagttagccggcaaattcgtgatgagcaaggagttggcattgatcgtcaaccggttatgcccgttggatggcaaacagttgctgaatcgttggttaagttagctaagcaatggcaacaatcagcagatactaaggttcaagcagaaggaatatcactaggtcagcgtctatctttagttgctgcgggctttcattatcaaaacaagattgattccctgggaaataaattggctcaggcactttatctccgaacggcacccgatgatgagcgtggacgggtattatatgcctcaatctcgcagttacaagatttttatattaatcagtacgaatattttcttaagtatggtttacggttgcaaaaacgagatgagttaaccttatctaatgaccgtatcggcaccttcttccataaagcgatggagacttttgttacaacaattcgagaaaataatttgtcatttgcagatcttgcccacgaagataatcagatgcaacgtgaccagctgattgaccatgcattagttacagctcaaaagaatcagccaactttattgcgtctcattaattcttcagcccaagcccaattccaatatcaacaattaaccgcaattgttaaaacaatgttaattacattatgccgccaagctgaatataccggctcacaaccagttaaaaccgaagttcagtttggaagaattggtaaccagcagccgggcaaccttggctctcttgattatcaacttaaagataatcatcatatttatctgcggggacgaattgaccgaatcgataatcttaagcaaggaaacgacaatttcttgacggttgttgactataagtcgagtaatcatctttttgacctcacttcggcttattatgggctctctctccaacttttaacctaccttaatgggttacaggcaaacttagctgaattggaaacgaataattcacgactggcaggggcattatatcttcgtttgaataatccgacaattaaggctgccgagttaaagaagagttccctcgatgatttgaaattaaaagagcaccaatacaagggaatcctcttgaatgatccacaattattgcgggagttagataagagtttagataaacaggcattcttatacccccttaaggaatataagaatggaaaaattaaagctaataaagaagcgcttctcgttacgccgcagcaacttgattggttgcaaaacatgaataaggaacttgtgattaatgcgggtaatcaaattttgagtggtgacttgaaactgaatccttaccggttattaactggaagcaaccgtcgtacaggacttgattacagtgactttttagacgtatttcagtttgataatatgcttgaccagcaaaactaccgcgacctaaatcctaatttagcaaaagaagcatttgataatgtagttcaagacgatgatgaggaggataagaagtaatggctggatttaaaccaacgcctgctcaatccaaggcgataaatgaccgtggcgaaaatatcctagtttcagcttccgcgggatcaggaaaaacggctgtgctagtaaatcggacaattgaattgattaaagaagggcaaagcattgatcgaatgctgctcgtaacatttacggacgccgcagcaaagaatatgcgggataaaatcagggcagccttgcagaaaatagtacaagattcagctaatcccaaagatttacgtgaccggatgagtaatcaaattaaccggcttgcggctgcagatattagtacaattcatgctttttgtttaaagttaataaagcggtactattacttgattaaccttgatccacaatttcggctcttaactgacgaaacagagcggttattacttcaagaagatgtctggcatgaagttagtgaagaactgtataaaaacgctgaagaaaaagttccgggcagagcttcctttagcgaactagtcctcaacttttctagtgaccgtgatgaccaaggactcgacgacttgattttacggttatgtgaaattgctaatgcccaacctgatcccgaaaagtggctccaaaaattaccagataattatgatttagggtctggctcactattagaatctaatttttatcaacaacagctaaagcccctggttatcgaaaagctcaatcagctcattcaagattatcgtgaattagtaacaagagctagtgacaacggtctagatcaagcagccgaagttattaaaagtgatgaagaattgatgcatcaacttctttcttcactcggggggattaccgtcagtgatgtttgtcaaatgatggcgcagcaaaaatttggtagttttcggggacgaccagcggcagatgatccacggattgatgtatttaaagacattcaaaagcagcgtaatcagctaaagaagcagtgggaacaaacagttagtatttacttgggaaagcaggaagcacaggaaccaattgcaaaagaagaattgctaactgagctaacgactttccgtgatcaatttacagccttgttaagcaaagcaactgaaagtcaattagacgctaaaactgttgattcattgcaaaaagaccagcagatgatgcaggagcttttagacttattgcaaccacctacctggaatactattcgggacttatttgctaatgctaaatttgcacgaatgggcggcaaaccgaaagacgatgagctagctgaagaagtatataaatcactgggaagtactcgaacggggataaaaaagcaatttgatcagttggttgatcgcttctttaattatcgtgaagaccaatttcgattaatttcaacgaatgcccaggaacttttacgcgaattgagtgcggtaacgattaatttccgtcgacggtatcaacaaaccaagttaaatcggcatgtccttgagtttagtgacttggaacactacgcgtacgctattttaacgccatcagacgaccagccaaactggcaaaccctcgtcaaagatctgcaaaatcattatcaagaaattatgattgatgaataccaggatacgaaccgccttcaggaaagtattttgatgaaattgacatctcctgaacgcaagaatctatttatggtaggggatgttaagcaatcgatttaccgattccgtgaagctgatccaacattatttcttgggaaatatcaaaactatcgtcaaggtaacgacggggaagcgattgttttaggggaaaatttccggtcgatgactaatgtgacgagctttaccaatatccttttcgaacaactgatggatagggaagttggtgaaattgattatgacgaagatgcccatttaaaatatgcggcaacttattacgaagaaaatcaagataataaggttcacccaacagaagtgttactgtatgacgccaatgctcttgatccagaaaaagaagatgttgaacatgaggatgataaattagctggagaatttcggatgatcgggatgcgaattaagcagatggtcgaaaatcaagagttaatttttcatccagaagatggacagatgcatccaattcagtacggtgatattgttttgcttgagcggacaaaggcaattaataattcattgatggaagagtttaataaacttaatattccattgacagttcacgatgttgaaagttattttcaagctactgaagtgcgagtaatgatgtccttgttgaagataattgataatccacaacaggatattccattagctgctgttttgcgatcgccgattgtcgggttaactaaccaagaattagcttttatccgtcttcagaatcgatctgttgattactacgctgccttgcaatcatttatgggtaattaccagcgaaaggctcttcaccatcaatcgctccttacttctgaacaggtaagtgccctctatgaaaaagcagaccacttcttaggcttgcttcgtgtttttcgacaaacagcccaacagcaaacccttgttgacttgatttggcagatctatgaccaaacaggttatcttgattacgttggagcaatgccaggaggccaccaacgacaggcaaacctccatgccctttatcaacgtgcacactcttatgaacaaagcagttttaagggtctttatcaatttattcgctttattgagaaaatgcaggaacatgataaagatttaggcgtagcaccgacacagttaactgcaaatacggttaatgttatgacgattcacggaagtaagggtctgcaattccctgtggtatttctaattgatgccacacatggctttaacaaaggagcagctcgtgaaaatgcagttgtcgatgctgttgcgggggtaggaattcgttacatggatgatcaacgggtcatttatgacacgccgcaacgacaagcagtgattgaagaaatccagcgcggcgaacgagcagaagatcttcgggttctctatgttgcattgacccgcgcagaacagcggttaattattacgggatcctttaatgaagaaatgcggacacagagtcttgttggttcatggcaacggtggcagaaagcatatcagagtaagaatttactaattggcccgcaaccacggatcactgcaaattcatttatggactgggttggccttgcactagctcgttatccagaattcaacgcgcaacaattgagtcgtggaaatgtcacgctagaaaaaagtactcttgctgatactaaagttactggtttggcggctgatcctcactttattgcaaaaacatataccgcacttgatgttagcgatggattggcaaaaattgggcaaaatgctagtgctaatgtaacggaaaagaacaatacagtcgcaactgatgcttctgaacaaaggattgatcaaattttgcgttatcgttacccccatcttgtcgctactaaaacaactgcttaccaatctgttacagatgtaaaacgagtctttgaagatcctgacacacgtgatatggcgcggtgggattatgatcaacaacaaagggtaaagacgcaagggatttacttaaataataactttgacgttccagctttcattcagcagactactcatgaacccgtggcaacagaaattggaacagcaactcaccttgttttccaaaaacttccgcttgatgaaggtccgattaacgttgaatttgttgatcaagaaattcaaaaattagtaggaaaaaaactgatcaatccagttgtagcagcacggatcaaccggaaaggaatagtggacttttatcagactgaggttggtcaaaagatcttaaagcatcccgcagattatcatcgtgaagtgccgttctcaatgattatgaatggtcatgaattatttaaaggggtaaatgttagtgatgatgaacgcattttaattcacggaatcattgatggttacttaaaaaatgacgagggcattgttctagttgattataaaactgatcaccttaacaaagattatcgcgactttgatttagcacggataaaggatcgctaccgaggacaattagagctctataaagaagctttgaacttaatggaagggattccagttgtccaaatggggctttacctgttagaattaggagagttcgtgttatttacaaaagagggtgattagttggcgacaattaaagatattgcacagaaagcaggggtatcggtttcgactgcttctcgagctttaaaccataatccacgaattagtgaaaaaacacgacaacaaatagcgacgattgctaaagagatgggatatcaaccaaattacaatgcacagaacttaacacggggcgagtcaaacatggtcggaattatttttccagtaaccagtgatactgcgcctgccaatccgtttcatattgacttattacggggaattagcatggcattaaagccgattcactatgaaatggttgtggcaattgcgccaactacgaccgaccttttgcaaagcgtaaaatcgatggtcgaacagtccaaggtgcataactttttagtactttatacggttaaagatgaccccattactaattacctgcgccaaaataaccttaattttgtggtaatcggtcatccagacaaggcccaagatcgctttgtcgacaatgataacgtagcggcagggcaagcggcgactgattatctgatggatcatcaggagactagtcaccccgtctttcttcaatctgcaagtaattgggtatttgaacaggataggcatcaaggttatgagcagagtatgcaaaatcatcaccttcctgctcttagctggcgatattcaccaacggggaccgcagttaaagattttattaaacaacatccgcaaatcgattcaattgtttgtgttgatgacttgttgctggtacgattaatacggcaactacaagaatttaatttaccaactatttgttttaacaatagtcggttgatggggatgttaattaatcaagaagaaaaggttgacttacaaccccgcaaattgggtcaacaagctgttgaattactttttaatccagaagagcaattccgaatcgttgattttaaaataaatagttgatagaaaggaccacggaattacttgtcacggtcctctcttatttttatatggagggaaatcggaatggagaaggtttacattgttgctgctcagcgaacaccaatcggtaagtttaacggtcagttagcttcaaagtctgcagttgaattaggagcgattgcaattaaagcggctgttgaaaaggcaaagctcagcggaaacgatattgaccaagtattaatggggaatgttattcaagcaggaacgggacaaaatccagctcgtcaagcatcaatggccgctggcttaggtgagcaggttccggcaataacgattaatgacgtctgtgcgtcgggaatgtccagtgttaacctggcagcaagtttaattcgcgcaggacaggctaatgtaattgttgctggggggatggaaagtatgtcccaagccccatatgttcttcctaaagcacggaatggttatcggtttgggaacggaaccttacttgatgcaatgcaaagtgatgctttaaatgacgtttatggcggttatccaatgggaattactgctgaaaatatcaatgataagtatcagattactcgtcgccagcaagacgaatttgctttgtcgagccatcaacgtgcagtaaaagctcaaaaagcaggctatttcgattcagaaattgtgcccgttgaagttaagcagaaacgaaccactgtaactgtaaaggttgacgaagcaccacgaccagatacttccctagtggctttagcaaaattaaaaccagcttttaaatctgacggaagtgtgactgcaggaaatgcctcgggaattaatgatgggggagctgctttggttcttgcttctgaaagtgcagtcaatcaattaggattaactccattggctgagtggcaaggatctgcagttgttggtcttgatccagcattgatgggtctgggaccatattatgcaatcaataagctcttaaaaaatcagcagatggcggcggatgacgtggatacttacgaaattaatgaagcgtttgcgacccaagcccttgtctgtcaggacttgcttcatcttgatcctagtgctgtcaatccttggggtggagcaattgcgttaggccatccagttgggtgttcaggcgcgcgaattatcgtcacgatgattaatgaaatgcattgggataatcatgaactcggcattgcttcgctgtgtgtcgggggcggaatgggtgaagcggttctgcttaagaaaatttagtaccaagaataacattcatcgtaaaaggcaagtaattgaggaaaattgaagtttttctctattacttgccttctttattttattaagttaaatacgttttaaataattaactataacaggcctgttttgcgggagctaaacagtaataactttaaattataaaaatccacaaccgttttctaaaaatttgcgcaagcggttgcacaacgattttaaatttgatattattaatattgcaataatgtatgaagcgcttacaataatcataagtgtcttttagaactattttataagttaaggagttgttagcaatgagtcaagaaaagtccacgggggctggattacctactctatcaaagagtactatctggatgatcaactttggattccttggtgttcagacagcttttactctgcagagttctcaaatgagtcggattttccaaactattggtgccgaccctaacaaccttggctggttcttcatcttaccaccattagctggtttgattgttcaaccaatcattggttattattcagaccgtacatgggcaccaaaattaggtggtcggcggttaccatacttactactgggaatgattgtagctgttatcgttatgattttgcttcctaattcaggaagtttcggtttcgggtatggttcgctcgctgccctttggttcggtgcaattactgttgctttacttgacctttcatcaaatgtggcaatgcagccatttaagatgatggttggtgatatggttaacgatgaccaaaagagttatgcctatgggattcaaagtttcttatctaacacaggtgctgtgttagctgccgttttcccattcattttaactgcttggtttggggttcgtaacactgcaaaacgaggcgttgttccagattcagttattatcgccttctacgttggggcagccttgttagttgttactagtttatttacagttttccgggttcatgaatatgacccagcaacttacgcaaagtaccatggtatttctgaagatgataacaaagagggtggaaattggttcacactcttaaagcatgcaccaaaggcattctggacagttacccttgttcaattcttctgctggtttgcattccaatacctctggacatactcagctggggctattgccaaaaacgtttggaatactgttgatgctacctctgctggttatcaggctgctggtaactggtacggtgtacttgcggctattcaatcaatcgctgctgttatttggtcatacgttttagctaaggtgccaaacaagtaccacaagcttggttacggtggtagtttacttcttggtgctcttgggttcatttcagtgttctttgttcatgatcaatggacgttgattgtttcatacacccttgtcggaattgcttgggctgcgatgaacacttacccattaacaattgttacaaacgcattgactggtaagcacatgggtacataccttggattattcaacggttcaatttgtttaccacaaattgttgcttcattattgagttttgctttattcccattatttggacactcacaagttcacatgtttatccttgctggtattgtaatggctcttggtgctctttcagttgccacaatcaaggaaacttatgctgaataggagttatttaataaaataagttaattaagttataataaaggcaggttaaagactacctttatttcagatgaaaggaattgagatttcaatgaaacgtacatttgatattgccccttggcatgttgctactcacaaatgggacccacaagacaagcgtttacaagaatcaatgactagtttagccaatgagaatcttggtatgcgtggcttctttgaagaaggttacagtggtgaccatatggaaggtatttacctcggtggagtttggttccctgacaagactcgtgttggttggtggaagaatggttatcctaagtactttggtaagatgatcaacgctgtcaacttcatgaagttaatcattaaggttaatggtgaacaactcgacttagcaaagcaaacaccaaaagactttaagcttgatcttgacatgaagcgtggtgtcttagaacggtgttttactgttgaaattggtggtactgaaatgtacttcaattttgaacgttttgttagtgttacccaaaaagaattagttggtcaacgtctccacattaagaaccgtggcgacagtgatgctaaggttgaaattactagcatgattgatgctgatgtatacaacgaagacgctaactacgatgaacaattctggaacgttttaggcaagtctgctgatggcgaacatgctgaattaacttctatgactaagaagaatgattttggcactccacaattcatcgttggaatgaagactacttcaaagactaaccttgaccacgtggatgacggcactgacgaaaaacacgcttacaacacatttgctggtactgtagctgctggtaaagaagttaactttgaaaagcgcagtatcgtaatgacttctcgtgattacgactcccaagcagatattgaaaagaacttggatgtattaggcgatcaacttgataatcaaagttttgacgacttactcgatccacatattaaagaatgggcagatcgttgggttaagtctgatgttgaaattgaaggtgacgaaggagctcaacagggtattcgtttcaacctcttccaactcttctctacttattatggtcaagattaccgtcttaacatcagtccaaaaggattcactggtgaaaagtacggtggtgctacttactgggatactgaagcttattgtattccagtttaccttggggttgcaaacccagaagttgcacgtaacttattaatgtaccgttacaagcaattagatggtgcctttgttaacgctaaggaacaaggacttgatggtgcattattcccaatggttaccttcaacggtatcgaatgtcacaacgaatgggaaattacctttgaagaaattcaccgtaacggggacattgcctttgccatttacctttacactaagtacactggcgacaagtcatacgttcttaacgaaggggcagaagttcttactgaaatttctcgtttctgggctgaccgtgttcactactcccaaaacaagaacaagtacatgcttcatgccgtaactggtcctgatgaatacgacaacaacgtaaacaacgactggtacactaaccttctttgtcgctggactcttcaatacacccttgacatcttagaccaagtagatgaaaaggtagctaagaagcttaatgtttcagaagacgaaaagcgtaagtggaagggtattgtagacaacatgtaccttccttacgacaaggaaaaggacatcttcccagaaaacgatggcttcatggacaaggacttgactccagtttctgaaattccaagtgaccaattaccacttaaccaacactggtcatgggataagatcttacgttcaccatacgtaaaacaaggtgacgttatccaaggtctctgggacttcatcgatgactttactaaggaagaaaagaagaacaacttcgacttctacgaacaatttactgttcacgaatcaagtctttctgcttcagtttactcaattatcgctgctgatattggttacgaagacaaggccgttgaattgtatgaacgttcagcacgtcttgaccttgataactacaacaacgatacttctgatggacttcacattacttcaatgactggttcatggcttgatattgttcaaggatttgctggtatgcgtgttcgtgatggtcaattacactatgcaccattcttacctaagaagtgggattcataccaattccgtcaaatgttccgtggccggatcttgaaggttaaggttgacaagcatggtactaagattgatcttgtatcaggtgacccaattaccatcgatcttgacggtaagaagcttgaattaaagtaattcttggaggcatttgagatgaagtttgaagatttgaaaggttttgcatttgaccttgacggtgttattgctgacactgctcgttttcatggtcaagcatggcaccaattagctgacaaggttggaactgaatggactccagaattggctgacgcattaaagggtgttagtcggatggattctttggaattaatcttgaaggctggcggccatgaaaatgactatactcaagaagaaaaagaagctttggcaactgaaaagaatgataactatattaagttagttgaaactctaacacctgctgatattcttccaggaatgaaagacttcttagatgaattgaaagctaacggttaccacattgtattagcttctgcttctaaaaatgcgccaaaggttcttaagtatttgcaattaactgattactttgaaggaatcgttaatccagcaaacttaagccatggtaaaccagatccagaaatttaccaagaagcagctaaattaatggatcttccagctgaccaagtagcaggacttgaagatgcccaagccggaattgaatcaattaaccgtgctggtgaattatcaattggttttggtgctgatttgcaggatgctgatgttaagttcgataagactggtgacgtatccttagctgctattaaagcgcaaatgaattaagatccaatttctctcttttaacaatccgtaaagacgtacttagaataatctaggggcgccttttttatgtgaaattatgaaaagaaaaatcgttataataacaaccatcattctaattagttgcttatgggtagtagttgcaattaactttaatcggccgtcctttcagccagttcaagatgaaacacagtcaagtcaacaaccgcgaccaaaatttaccgaccaacaaattggggttttggcgggattggcaatatctcccgactggttaaaacaaaatattgctgcaaatcaactcgtttatggaattgttaagccctctgataccgttccagcaggagtaaatgattatagctatttagtagccgctgacgaccaagatggaacggcaattttctttaaagttgaaggccagactgtgatcataaaatatacttctcagcgaaatgcaaaattaaaaacaaaggacttaaccttggcgcaactaagaaaagaattctaccaaacgaggtcacaaaaaaagcaagtagataactatgtagcaggattgcggaccgagtaaaatttaaggcatcttaaaaatgctattttcagggtattctttagtgatgagtactgtataatattcaaattaaaggaggaaactgtgatgtcaatttatggcccatatgagcagattttgtcaaatattctttccctcacaactgatcggatcaaagaactaaatcagcaaacagtgcaggataagcaaccaaaactttatgaacatttaattgctcgggtgaagacttccgagagtatggcggaaaaatgccaacgaaaaggctatccggtctctactgaatcggccttacgaaaatgtcgcgatgcagttggaatcagaattgtttgtaactttatcgatgatattgaccgttgcctttgccaattacgtcaagctgactggtgtgaggttattaaggaaaaggattatattacaaatgcaaagccaaatggatatcggagctatcatgtcattattgatgaaaaagttccatatcaagatatcgaaggaaataacccgggacatttttatgttgaaattcagttacgaacgattgcaatggattcatgggcaagtcttgaacatgagatgaaatataaacataatattaaaaatccagagcgaattggtcgcgaacttaaacgttgtgctgaccaattagcatcatgcgacgttcaaatgcaaacaatccggcaattaattaattctagtgaggaaggcgaataagatgcgaatccttgtagcagaagatgaacagcagctatctcatgtattaagttcagcgatgacagcgagtggttatcaagttgatattgctaataatggccaagaagccgttgagcaggcgaaagaaaatgcctatgatgtcataattttagacatcatgatgcctgttaaatctggactggaagcattaaaggaaattagagcaactggtaatcgaacatatattatgatgttaacggctatgggtgaagaagatgataaggtaactggtcttgatgccggtgctgacgattatttaactaagcccttttccttaaaagaactacttgctcgtttgcgctcccgtcaacgccgagatgattcttaccaagtagatgttcttgaatttggtgatttgacccttaacggtaacgatcaatcgcttgaaagccataattcgattagtttaacgaatcgggaaaatcgtttacttcagtattttattttgaatgctaataaagaattatcagcgaatgaacttattaaccacgtttgggatgagaatgaaaccgctgatcaagaagatctctggattaatatctgttatttacggcaaaaattacaggcaattcaatctcaagtaacaattagtggtgaaaaaactggaccgtttatgattgcatgctagggggtcaaggaatgattcaacgttttcgctataaatttattgcaatctcaactgcggcattattatttgtaattttgacaattgttggcagtatttgcaccctcacttactatcaatcgcaccaagaaattgaacgggtattgacgattttggtaaataacgacggccaaattccccgaaaagggatccggactactgacaatagtcaacctcaattttcacgtgagggccttcatcaatatcgttattttgctgtactggttgataataaaaatcaagtaacggaagtgcaagatgatcatattgcaacggttacgccgcaggatgcccgagcaatgacagaccgtcttgtaagaagaaaagtgcatagcgggcagttgctatatcgaggggtaaattatgcttataagattcggaataaaaacggcgagaaagtaattgtctttcttgatgaatcactcctcatggcccggacacgatcactaatgcatacagggttgatcttagggataattgttttagttctgtataccattgttttaaccctttactcgcgtcgtgcaattcggccaattattgaagcagagcagcggcaaaaagaatttataactaatgctagtcatgaattaaaaacgccattgacagttatttcagcgaataatgaaatgcaagagattatcaatggtgagaatgaatggacaacaagcaccaagcaacaggttactcgcctgacaaagttaattaataacctggtgtcacttgcacgcatgcaagaacaaccgacattaacgatgttgccggtaaatgtaagtcaaattgccggggatgtggctagtagtttcaagagtgtgatttcaaccgaacagaaacaattcaatgtacagattgatgaaggcttggtagcaaacgctgatgaaaatacactacgggaactgttgaatattttgcttgataatgcgaataagtattgtgatcctcagggtgaaattgattttacagtgtcctcgtctaatcatagtaaaaatatagttattacgattgcgaatagctataaagatggtaaaagcctggatgctaaaaaattctttaaccgcttttatcgggttgatgaatcgcatactcaaggaaaaaaggcaggctttggtattgggctttcgatggctcaatatatcgttaaacaattcaaagggaaaattacggcgaagtatacaaatggtaagttagcttttatcgtaacgttaaaagaagtaggaaagtaagaatgaaattttggcgacttaagattggaatatatgcagttgtttggagcctaataattggtatgctgacagcggcgtatttaaacttagttaactgggtaattgatttagtttggcatcaatacctagatccggcagttagtagtaaatggtatccgtttttagtatgtattccatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatggtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggatgaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattcataagtatctaaaattattgttagctctgcttgatcatgatgacgaacggctttaattgctcgcatggctaattcgttgtgccggcctaaagtatgttcaattttctgtaaacaatgatagcggtcgagaaagtattcaccatgtgcaccttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattaattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgccaaataagtaaattggtctacaaaaaagatttccacgaccagatgaattattcatccaacctatgaaaatcttacactaacaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagccggtcaggccacatatcttgaacatcaccgccattctggtcgtcgtcgcttatattattcttcaaagcaatttttacgattagctgatcagctaatgcttgttgagtttgacgaccaccattactccccacaagcggttatttataaggcccgagatttaatgaatgatggcaccctgatcccaaagtcggttgtaactttatatcaatggattaatgagggtgtgcttcgtacgtccaatttagacctctttgaaaaacctaaacgtaagcatcatcgaactcatccgcaagctaaaaggtgcttagggcctaatattgctcaacgacctcaaactgcggaccaacggtccgaaattggccattgggaactggatacagttcagggacagaaaaatggtaatgacagtgttgtactagtaatgactgatcgcctttcacgagttaatatcacgagtaaaattgctggtaaaactgcgcatgcagtaaatcagttctttacaaatttgcgccagaaaatgggcacagatgcttactatcgcatctttaagacaataacctctgacaacggttcagaatttagtgagttaacacaagttcacgatcatgttttctatgctgatccggattccccttgggaacgtggatccaatgagatcaataaccggtttctccgcaaggagattaccaaaggtgaagctataaataactatagtagtgctcagatcatagcgactaatgattggatgaatcactatccacgagctatatttaatggacattcgtcaatggacatctatcgtaaggccttctaccaagagatatcacagctccaccaaccaataatcaattggtcagtattatttatttgagtccagtggctaacttattcttgaaatttagggtatgtattccattgggatttttgattggtttcttgaatgagcgatggggtaattacccgttaacgattgaacaagtgctgacgcaagtaaggttgaaagggcaattaaattatcataattggtggaagtcttttattcttggcttattggccctcggagcaggagggaacatcgggccggaagcttctacaacagtcttaactagcagcatgattaattggcttggtgaccgtatgcgctgggcaacttcaatgcgccagaaagtttctctttggtacggtaaaatgcaaacgcaagatttagcccgtgctcctagattcagtcagctttttaaaaataaatatcaacgagtctttgttatttcaggattagttggaattggaatagtaggcgcggcgattgtttttaagctttttcctgaagaaggtgtttttgggatgcatcaccggatcattaattgggagtggatcaatttattaacgagtattccaacgattatcattgggattgcttttgggtggctgtttgttcacttagaaaattgggctgcactgataattaatgcaaaaataagtaagatttggcaaggtgggatttttgggttaattttagcgatcagctcgttgattacaagcgatatcttattttctggtgagtttagaattgttccttttacccacgaagccttcaatcattcaatcatcttcctattagttatagcactcgtaaaagccgtaatgagtaatctgggttttgcaatgggatggcggggaggaactattttcccggctatcttttcgagtgtcgcggtaggaactgcctgtgcgatgatgttgcctggagacgtacggataaatgcaattgttgtaatcgcggcaagccttacctttattttagaaaaaccgttattaacaattatcctgctgttattattggtaccgattgaactagcgccggttataattgtagttgcatttttagtaggaaggattattaaactttttcctgctagtgaatagagaatctttaatatcttttgtgtaataaagaagattgagtacttgctaagcgtgaaaaattatttaaatttcgttttattaatattttgttgtttatatgagaaaagtcctgtatctttattaaaaacaattagagaatggggcgataatgtgtttagcagaattggtcaattaatattcgataatgaagctgttgcaaagacttctgattttacaatgggtcttgagattgaaatgcaacgagtagacgaagatggcaacctaagccttgagccatatccgtcagcgattggggatgagaagactaatccatggattaccaatgattttttagaaacaatggctgaaatggtaactccttctgcccaacatgctcttgatgcaatgcattatttgtatgttatcaataatacattgcgatcagctcttgctcccggcgagttattatggccgttatccatgcccccacgacttcctaaagataagactaaattacggttagctaaaatgggaccgaaaaaagaagcttatttgaaggaatgggcaaaacgtcatgggtactcgcaaggaacgccctgtggagcgcatattaatttgagtattgatcagcacattattgagctagtccttaatgctttcccggaacgctttaatagtaagcgtgaagtgcggaattatttatatactatcttggcacaaggttttgtccgatatcgatggcttcttacgtatctttatggtgcaagcccaattgttgaagaaaattattttgaaccgggaaaagagttgcctcatccgattcggagtgtgcggcaaagtcaatacggttttgggaccaaatttaccggtgattttactaatctcgatcgttacattgcacggattgaagaaggagttaaagcagggatcttaacatcggattacgaatttcatggtccggtgaggttcaaaggaaacacggatttaaaaaagttgcctgaacatggaattgagtatttagaattacgaatgctcgatttagatcctagcagttcagtaggagttcgaactggtacactaagatttattcgtttattagcaagttacttgatcatgcagccgccattaaaagaaaacgaagtagaagaaatgttggtgactgccgataaaatgaatgaagttgtagccgaggaaaatccccaagcaacttgtagatatcaggccaaagctcgtgctgtcctcaaaagtttagagcggtatgccaatcaaatccaactcggtccagaatattccgaagttctggaagacttagaagatcgggtcgaaaatccgctaactaccccgagtgctaaactcttaaactatgtaaagaatggttcactcaccgagtatgcgttgcgtcgtgccaaacgttaccaacaagcggcacaggaaacaatccatccttttaaagggtttgaagatggacgaatctatactgctgatgagcttcgaaaagaattaacattgtaaccttttcaaggagaagctagctccagtaagcaataataggcctccaacgttcgattttaccgggcattggaggcctattattctatgtttttttctgaaagtaacttagcttatgtcacagccctccactatttatttagccgcttttttcgctctagtaattaagtcagcaaaaatagcgcgcgaataatcgtaatgtttaaacatgttttctggatgccattgaactgctaaaatttgatcagagttaatggtttccacggcttctggtacctgatcatcagcccatgccgttacatgaagtggttcagcaatctgatttagtgattgatgatgacgtgaattaacatatggtctgggtcctactaagttaaataatcgacttgccttgtctgtattaacgtggtgggaaggaaaatttcctggggcatcttgggaatgcttaagggtttgatggggattttccgaaaggtcttggtataaagtcccgccaagcgcaacatttaatacctgcattccacgacagatccccatcattggttttccagcattaaatgcagctgtagcaagactaatttcaaattgatctcgtttaagatatgtgggacctaatttttgatgcggctcttcgttgaaaaaggttggatcgacatcacttcctccagcaaagataatcccatcaaaaagatcaaggtaggatggtgctagtgaagcagcaacactaggaagaataacgggtaatcctcctgacttgataatggcttcgattaatgggcgaggtgcgaaggcagcatttcgctcgttaatgatgtttgtagcttcagttaatgtatctgcaggaatagcaattcgtggatgcatataacccctcctcatttagttctcatgatattataatcaaagcataattcatttggaatagcaatcaatatttttaataaaaaaagatataatagaagaagaaagaaggaatgtaaagatgcttgaattaactaatattaactcaacgttcaacttaaataatgaggtcaagattccctgtgtgggatatggtacatttaggactccggcagatgtagctgaacaggccgtgaaagaagcaattgaaactggttatcgacacattgatactgcggctgtttacggaaacgaagaagcagtaggcaaggggattaaggattcgggaattaagcgtgaagacctttttgtgactagcaagttatggaatactaatcgtggctatgaacaaacgaagaaggcttttcaagagacgcttgatcgtttgcagatggattatttagacctttacttaattcactggcccgccaatgaaaagcagtttggagatgatgctgccaagattaatgctgaaacgtggcgcgcaatggaagacctttacaatgaaggtaaaattcgggcaattggggtaagcaattttatgcctcaccatattgcggaattaatgaaaacggccaaagtagcgccagcagttgatcaaattgaggttcatccgggttggccacatacggaagaaattaaatacttacaagcacacaatatcttagttgaggcatgggctcctttaggtggtcaaggtgctaaagtattaactaatccaacaatgattcaaatcgctgataagtatcaaaagacgccagcgcaagtctgtttacgttggattctccaacaggggattcttccattaccgaagtctgtccataaagaacggatgataagtaaccaaaatatatttgatttcgaattaactgatgaggatatgcgcaagattaatttattgccaaatcttggcggtcaatgtgctgatccagatgaggttgatttttaacgataaaaaatatgaaattgatgcagtagtattgggtatccagtcaaataaaaatagtatgctaaaaagtctcgaaccttcacggaagaggcttttttgatataatttcttttagctaataatgaggagaatttgaaaatgaaaaatgcttatcgcgcttttcgccaatactcttgccagttcaggaaaaattggcttgaatatttaatattatttggcggtcttgatattttaaaccagtttctggtaattccattttttcgctggataactacctttgtcctgcaggcaggagaaattccgtttatttcatatcaaaatattgtaattattctgacccatcatccattagttgtagtgatccttttaattgaattaatatgcctaatggtaattatctatggcgaatttatgctcttgttgaagagcttttgtggaattggcttgccagagtttagctggcgccgaatgtttaggcaaacaaaagaaactttatcgttactaaattttggatcgttaattctattattaggttactttttacttattattccatttgcggatatcatctttcgaactcccctgctggcgaaaattcaagttcctcagtttattgttgattatcttacccgtaatgcatggcttattggtggattgaccttgttctatcttttgatgacaatgatcggtattcgtttaatattgacaatgccgttaatggcttatcaacatttacggttaagagctgctatgtctcaaagctggcaaatgacaagtaagctaagatggttgaagtttttaattcaaattgtgctgatgacaataattgtaggtagtataacggttgttttttacctcatgatttacattctccaggttgttttggatttattacccgggaaattatctttgattactgctatctttaacttgtcgatcttacagcttggtggggaagtactagcagtatgggcaggaacaattatcttactggtagtcgttaaccccttaactagcattagtgaactagcgacaactcctgaacatccatcacgaggattgctaacttcctttatgcttgtcttccttgtaatcggcttggcgactcttgcaaataatactttttacatgatgggaacggggattaaacgcccaataactatctctcatcggggagttactgaaaaaaacggggtgcaaaatactattccagcaatggaaaaaacaagtaaacttaagcctgattatattgaaatggatttgcatgaaacaaaggatcaccagtttgttgtgatgcacgatgaaaatcttaaagacctaacaggagtaaataaaacacctcatgaactaacattgaagcaattaacacgactaacagcacgcgaaaatggctatcatgctaaggttgcgagttttgatcaatatttagcagcggctgagaaatatcatcagaaacttctgattgagataaaaacaacaccccatgattcaaaacagatgctccagaattttaatcgccggtatgggaaaaggattttgcaagatcatgaccaagttcactcgctcgattacagtgctgtgactaagctaaaaaatattaatccgcggttaacagttttgtatattcaaccctataatttgggtaatccccagggagttgctgacggtttttcgatggaatattcaacattaaatcaggacttcattactcaagcccagtggcaacataaaccggtatatgcatggacggttaatgacaccgatttaatgaaacagactatgtataaccacgctaatgggataattaccgataatttaggggaattaaatgcggcaataaaagattttactggaaagcagagttatgctaatcgaattctaaattatattattgtcgttcctacaagtgggggaattgaaccgtaaaaaaatactcgagaacagataagccgttaaggcgatcagttctcgagtatttttatccaacgtgatgcttcttcaattgcctaataacaattaacgccactattccaccgatcattccttggataaagtttgaacctaaacttaaaaaaccagtaattacatggtacataacggtattgcagataaagtagattgcaatcattacgattgttccgaccaagattgcggtccatttgccccaggtggtgttgccatattttttataaatccagccactgataaatccttctaaaccatgagcggcaaaggaaaataaggcatcttgggggaagccggaaataaggtcaaggaacattccgccaaagccaccaacaattgtccctgctcctggtcctaaaagcatggcagcaatgaatacaccagcatcacataagttgacgttaccatgtgtccatggaatagggataagaaagaagcggccgaggacaagagttaatgctaataacattgcggcaataattgagcggcgtaaccgaaaagtagattccatattaaaactcctaacatagtcaattgtgagtaattttacaataattttcaaaaaatttcagagaaaaaatgtgtcgttatttatctatcgatacaaacaaaaattaacttaacatcttatatcatagtaattacattgaaatattatgtaataaaactgataattgattttcaactgataatcaatattcctattttatatattgattaaatgaaaataatgcgtataataaattgtgaaaatcagaacatgatatgaggtgtgtgttatgaaggttattattgttggttgtacacatgcgggaacaattactgccactcaaattttacagaatcatccagaaacagaagtcacaatttatgaacggaatgataacgtttcattcctctcatgtgggattgcggtttacttgagcggtgatgttggtgatccagatgcgatgttttattcgagccctgaacaacttgctgccatgggtgcaacagttcatatgcaacataatgtaactgatattgaccctaagactaagacagtcacagtgacagaccttgtgacaggcgaaacaaagaccgaccattatgataagttagttgatactactggttcttggccagtaattccaccaattgaaggtgtagatggccctcatgtttatttgtgcaagaattaccatcatgctaaagaattatttaacgttgctaaagatgcgcaacgaattgttgtgattggtggaggttatattggggttgaattagtagaagcttacactcgtcaaaataaggacgttacattgattgatgggtctccacggatgcttcataaatactttgaccgcgagtatacggatcggattcaacaggaatttgtagatcacggcgcccactttgcttttgaccaacgcgtaactggatttgaaaaccacaaaaatggtgtaaccgttaagacggataagggcaactacgaggcagatattgctatcctctgtgttggcttccgtcctaatactgatctcttaaaaggtaaagttaagatgcatgataatggggcaatcattacaaacgaatacatgcaatcatctgatccagatatttacgctgccggagattcaacggctgttcactataacccaactggcaaggatgcatacattccattagctactaacgctattcggcaaggaacaattgttggaacaaatctctttggtaatacaatgcacgatatgggaacccaatctagttctggcttaaacttatatggaacaacgatggtatcatctggcttaactttggagaatgccaaagaagcgggctttgatgcagctgcggtgacagttgaagacaactaccgtccagaatttatgccgacaacaactcctgtattaatgacattggtgtgggataagaagactcggcaaattcttggtggacagtttatgagtaagcatgatgtttctcaatctgctaacattatttccttatgtatccaggataagcacacgattgattatttagcatttgttgatatgcttttccaaccacactttgatcgtccatttaactatgtaaatattcttggccaagcggcggtaaagaaacaagctgaattagaaaaataataactaaaaaggttagaagagaaaaagttttcttctaaccttcttttttacgcttatttttaaaaatcgccgttcatgattgaatcttttacaatcatataatcgaccttccgaatagcttcaaggtcacgaccacccgagtaagagatggatgattgtaagtcttcctgcatttcggttaaagtgtctttgatggagccacggtaaggaacgagcatctgctttccttcaacatttcgataagcacctttttgaacctcagatgcagaaccccaatattgtttgtattgttttccatcaatgttgatgacatgtcctggtgattcgaggtgaccggcaagcattgagccaatcatcaccattgaagcgccaaaacggacagacttagcaatgtccccattatgtctaataccgccgtcagcgatgattggtttccgcgcggctttagcacaccaacgaatagcggataattgccaaccgccagtaccgaaaccagtctttagcttagtgatgcaggctttaccgggaccaaccccaaccttagtagcatccgccccagcattttcaaggtcgcgaacagcttcgggagttgcaacgttccccgcggttacaaaagtgtcgggaagtttttctttgatgtattggatcattttgatcacaaaatcagaatgaccatgggcaacatcaattgtaatatactctggatttaattgttcggattttagttgatcaataaaattatactcatcatccttaatcccgaccgaaatcgaagcaaataatcctttttcgtgcatcattttaacgaaagctgctcgtgtctctggattaaagcggtgcatcacgtaataatagtcattttggacaagccaaattgctaaatcttcatcgatgacgctctccatatttgcaggtacaacagggatcttgaatgtgtgagggccaaacttgacgcttgtatctgcatccttacggcttttgatcacacatttatttgggaccaactgaatatcatcataatcgaatgttttcattagggcagctcctttttaaaaatttaccgtaattattatgcgctaaaatatatgaagcgtcaatgaaaatagcgtacatttgctgagtaatatcaaaaaatagttcgataaactgttgacgacaatgaattaatccggtaaaatagcgaagtaaaaacgttaattttagaaagtataactatgaggtgaaaataaatgtcatcagttgttattgttggtagtcaatggggcgatgaaggaaagggtaagatgaccgattacctaagccaagaagcggacgttgttgttcgttcacaaggtggtaataatgcaggtcacacaattgcatttgatggtaagaagtttgccctccgtctagtgccatctgggatttttgctaaagacaagttagcggtgattggtaatggagtggttattaatccacctgcattattaaaggaattgcattatcttcaagacaacgggattgacatttcaggtttacggatttctagtcgttcacacatcaccttcccataccatattcttcttgataaatgtcaagaagaggcaaagggtgatcacaaggtgggaacgaccaagaatgggatcggtcctacctacatggataaggtttctcgtgttggtatccggatgtgtgacttacttgagaaagacacctttaaggaaaagcttgaacgtaacctcgctgaaaagaacgaattattcactaagttataccatgttgacccaattaactttgacgatatttttgaaagttactacgaatatggtcaagaattaaagcaatacgttactgatacagctcaaattgtcaatgatgcccttgatcaagataagaaggtcctctttgaaggtgcacaaggggttatgcttgatgttgaccaaggaacatatccatacgttactgcttctaacccaattgcggggggagtatgtactggtgttggcgttggtcctaacaagattgaaaccgttgttggaatttgcaaggcttactctacacgggttggtgctggtccattcccaaccgaattaactgatgagattggtgatcaaattcgtgaaacaggtcatgaatacggaacggttacgggtcggccacggcgcgttggttggtttgatagtgtcgcaatgcgtcatgcacggcgggtttcaggaattagttgtcttagccttaacttgcttgatgttttgactggcttgaagactgttaagatctgtacttcatacaaacttgatggtaagcaaattgattactacccagctagtttgaaggaacttgaacgctgtgaaccagtttatgaagaacttccaggatgggatgaagatattactggtgcaaagaagtttgaagacttaccaattaatgcacaaaactacttgaagcgggtaagtgaattatcagaatcaccacttgcaactgtttccgttggtgctgatcggattcaaacgattatcgttaaggatccgtgggaattagcacataaataaatagatgagagcttctaatgtttgaataatctttaagcattggaagctttttatttctcttggctcccctatggtataatcaaggcaaatacacgttataggaggcaagatgatgacacagccaacactaacagtagaaaaacattatttaaattggccacttaaccgtcctttaaatcaagctgacataatgcatgagttgggtgtgcatgcatccgatgaaaatggccaagatttaacgagtaaggtgatgatgaacctaactcaagtggatgttaacaaagtaggagaataccctgtgatgttaaatgtaatggataataacggacaaagtgcccaggcaagcattaccctaaatattcaaccgatgcggacacagaatgcacctaaggaaactgcaacgtccccaaagtcaagacggggatggttatgggttattatcgtaatcgtggttatcttatgtgcatggtgggcgatcagctctcataaccgacaagcggctaatcaagcggcaactgatagtcagcagagcagtcaaataagcaacaattcaagcagtatcagcgatttaacaaaagataatcaacgtcttgctagccaagttgcagaacttaaaggggcaacccaacaatatcagaaagaccatgatcaacaagcattagaaagccgacttgataagatccaaagtcaaatccaagacttgcaaaatcaagttcaaagtaacagcgtgaagcaagatttaaaccaagttaatgaaacagttaatgaagtacgggaaaacccagataatgggacgaaaattgtcaacaatctaaagaataaagacgactttcaagaaatttggggaaatattagccaagaagtccagaagtggttagacgagtttgctaattagtgagtttgacagcgacaagatagacccttaaaatggtaataataattagcgaggttccccgttaaattgttagggaaagactcaagtaaatgctggatccttccttagattagcggagggccttattcttttgaaagattttaaattaattaaggaagtgacatgatggctcatgagatcttagatggctcaagtatgcaacgtgcattgacccggattacttatgagattatcgaacaaaataagggtgtcgataacttagtatttgttggaattaagacgcggggggtatatttagcaaagcgcctcgccaagcgactaaatcagttggaaaatgtagaaattcctgtggcagcacttgacgtctctctttatcgtgatgatcgtcatgtaccagattatactcaagaaccaaccgtaaaaactgatcaattagatattgatattactaataaacatgttattttggttgatgatgtactcttcactggacggacagttcgggcggccttagatgccttaatggatatggggcggccaaaccgaatttcactagcggttcttgtcgatcggggacaccgtgaattaccaattcggccagattttgttggaaagaatatcccaacagcaatgaatgaaactgttcatgtagcagttgaagaatatgatggccatgaagatgtaacaatcgagcataattaaaagggaaacgagacaaaagcccctgtaagcaataaagacctctatcgttcggttttaccgatgatggaggtctttgttatactgcactatttacttcttatgggcgtaacctaatccttttatcttagctttcgccaccaatccaccgttgaatgctcattaaatacccgggtaccaaattttttctgaaaccatcggacttgtttgggcgtaaatccccgaaatactaatggtaattttttccagtgagaataaagagcatagagaagaaggatgtattgttctttactaatatcatctactggaatctcactaaccatggtcatcgaaatacctgttcccagagcagggaatgtatcgagactaattttgtagatgggattattactgatgttagtggtaaatactattaatgcttgtttttgtcgcggacgataaacttcttcaattcgcttattaatcttgtgaacttggcgtttagttggattgagaattatattacgcatatgaaacctctggtcgaacatttgtttagagaacagtatatcatacttagaaacagaataaatcatgtaagtcttttactgatataattttatttattctttccgttgtaattacactattcttattaatgcggtatgattggattagtgagttcagtattaatcgtgcaggacatctaatgcaaaactggtttgcaatttttggaatggtctttggtttcgtgattttaccgttaattttattctggttaacgcgtcgtgagcgagctgaaaatgacgaacgagtaaaataggagaatagaaaaaacgctcaatgactgcacaaatcattgaacgtattattttagggaataatagtagccgatatcgcacattatctgctactagtaaatgttaagtctaattgaggcgaataactaaaaaacaactattggcaccaccctagaagaaagaacaatttaactttgggagtttattaggatttttgtccttattaaaatgagaaaaagttaaggacactttagcagtcattaagtaataaaattgatctcttcacgaattgcttttgatgttaaagcttcaattcgatgatattttaccaagtaatttatcaatagttaatagttttacgagattatgcactcactgtgtacaagtgataccaagaatacactttgttctaacaagggtattattttactatatttttactaatcgtttatattaagataatatagtttggagtttatataggagaaaaaagatggatattcgtaaaattaatatgttaaatggaattaaggaaggatttattactgttttagatactaaaaaattatcagaatgtactactaatgatattgtaaatagcgctgaaattagtaaaaaactttctacaactattaccaaaataaacaagatcttctccatgaaattgaaaatgatctattgggaggtctaaaagaagctctcgtaattgatcgggaggagctaaaagatgtcaagcatttaccaagtgcagacgaaattaaggaattagcagaagtggcatttaatcatacgttggctttttgtaatgaaaataagcatgcgttgtcaaatttgctttcctcaaatggagatatgcagttttatcaaatgattattgaagtagcaaataatgaatttgatgcgcgagttccatatttgtttggggatataaatattaaagaagctaatgtaaaatcgtcattgccattctcatttattaaaaccctctatatcaatacaattgttaatttgttaatgctttggggtgccgcaccagactctttaagcattaatgaaattaagtcaattgcaggcttgattcaaacaaaatcaccagttgaattgattcaaatttataaatcatatttaaactagaaaatgaggagccgaaaattttttctcggtctcctcatttttattatcaaaaattctttttaaattaattgcccttccaataacgtgcccgggtaagcagttcccgtgaacgctggtcagctggtcgataacccttagtaaataggtgtcggaagtacatcatattatagaaaaagccaaagaaaacagaaggccatgggaattggaacagggcattaagtccaaagaaaagggctaccaaagcataatcgagggttaatacaatcattaaaatgaaattatagtaatccgcgcgaaaaagagctggcagtggcccgaaccaaagagttgtccaagaaaagccgactttggcgattcggatatccccctggtcattaacgattttagcgtaatttggtgggagggggagattgtttaagttaaacggattttggttatcattattgttattaccaaatgggttttgcatatctcgtccacttctttctataaataataatattaacacattgagtgagggataggaaacgtctctatcaggctttcaaggaatgttaacaattatatggtaaactcaaagcgataaccatgaaagggggaatcaaggatgctttttttcctaaacgataatattcaacgaaacaaatcaggaattgagcatgcgcaaattaagcgtctgcatctgtttgaaaaatatcatcaaccagctaagattgttacccggcaatattcgaatgaattacacttggtaacagcagaagcagggattgatgatcgtaactttattaacttgtttgattattttcaggaggcttgtgaggtcccgcaaaagaatattcggattaaagatattccggttaacccccattgggagcacaaggctgatgggattaattataattattatcaaaatggcaaacgtattctctatattcgtcggcgcagtgatactgatcggcgggtaattaatattcaatattttgatcattatggaaagcttctcaaagttagttggtttgacagccgcggttttatctcggtcgaacaactttatgactgggatggaaaaatggcaacggaaaactattaccgtccagatggaaccttagcaatccagctagcccaccagcatgataagcggggaagggaaattaaaacttaccatctttttaattaccatggtcgtgattatcaattcagtggctttgaccagttaacccggtttttcctcgatgagttggtcactgacaagcaaatctgtggtgaaggtccggttggctttgtcgttgaccgagtttatgaactaggctgggcagttctgcacatgaagcaccgggtttttcgggttcttcaactgcataatgaccatgttaataatcctgatgatatgcttcattctacccttaattataactatgattggggacttaagcacctccaagattgggatggggtcattgccttaactccgcaacaacaagaagatcttcaagatcggtttggcaagtttggtgtaaagatctaccggattcctggtccgattgttcctgcggcagttattgataagcatcatgttccttttaaaaagcgaacgaaaaaacaagttgtcatggttgctcgcttgtctcccgaaaaacagcaagatcacctattgaaagcatggccacaagtactagccgctgttccagatgccaagctcgatttttggggatacgctaatgatgattttgataagacgctcaataaaattgtcaaagaggaagcgattaatagttctgtgaccttccatgggtatacagataacgtcaattcggtttacgaagatgcgcaattactcattttgccaagtcgggctgaagggttaccactatctttagtggaagctcagtcccatgggttgccgattattgctaatgacataaaatatggtccttcagatgtcgttattgatcaacaggatggattgctgaccaagaacggtgatattgatggacttgctcaagcgatcattcgcttattgcgagatcaagagcaattagcgcagatgagtgaaaatgcttatgctgatagtgagcgttattctgaaccaaacgtgatgaagttatggaatgaattggttgctgacatgaaggaaaagggggaagagtaaagtgtacttttttgtaaaccaatacttattaagtagcaactccagtgttgaacatgctgaattaaaacgactagccctatttaaaaagcatggtggagaagctaaattggtgacccgtgacttcgacctcgttcttcatgataccatcaaaaaatttggtttaactaacgaccaaattgttaatatgtatgacttttttgcaaacacgactgattaccaaggcaaaaagctccatactgaggatttacctttaccaattgactatcaagtaggaactggaaataactatcgcgaagtaaaagatggtgaccgccttgtttgcgaagttcactttgcggctggaacgattgggcaagttaaccatgttgattactttgatcttgctggtaatatgactcttcgccaacaatatgatattcgtggttttaaggcagctgacgaattttttggtgaagatggacaggaatactatgcgcgttattaccgccccaatggagaagcgtatcttgaacggtattttgtaaaatcggttgaaaataccccaattaattcgctgaatgtcttacgtaattatcaggggcaagatcgcttctttgattctttagaagacctctttattttctttttggatgaattgaataaggcaaatggtgaggataatgtgtttattgctgaccgaccagctgttgcgattaaaccggttcaatcaatgatgacaaaagcaaagaaatttttgtggcttccgatgaaccaggttaacgatggtcagaacttaataaatggtcccttaaatccgatgttgcaaggtcctgttactacggatgcggacaagtgggatggtgtaatcgtcatgactgctaaacaagcggagattctccagcaacaaattcacaatgctgtaccaatctatgtaattaatgggacccccgttcttgctaactatgcgcggattaatgaagctgatcggacaccgggtcaattgatttacgttggaagattggcagaagataagcaaactagtcaactaatcaatatgtttgcgcagattcatcagcaagtatctgaaagtaagctaactttctatgggtatggcactggtgaagatatggataactataaaaaacaggttaaaagccttggattagatgggtcaattgagtttgctggttaccagatatcattagatgaggcatatgatcaagctcaattatttgttgatgcaagtcgaatcgatgcacagccattagcgatgggcgaggccttaaaccatggggtaccagttgtttcctatgattacctttatggaccacgtgaaatggtaatttcaggtaaaaatggtgagatcattcctttaaataaccagggacagtttattcaaaccgtcgtcaaattattacaagaccgagatgaactgcaaagcttaagtactggtgcctatgacaatctagatgaattggtagaagaaaaaacttggaagcaatggcaacaactatcagctatttagtcaaaattggttataatatattcagaagacgaaaagcagaaaataatcaaatgtttttgaagcctttggtcgttatcctttgataatctaaagacggaaaatgagggcggaatgatggataattatcaagcaatgaatttttactatggacttcttaatttgcgtgccggtttttttaaggctgacttatgcgaaatactaatggcgatcgcacagagcgtacctgataaaaatcaacaatcagcaacggcataccatactgtagaagagaatttgagccaagaccataagcaattaaatcgtgatcaagttgcatttgggtcattttatgaagatggtcatattttacataatgtcaaaattaatacccaatcagactttttcctcgatccgacccgggaagatactgtcaagtggcatgttagttttacggttgctaaaaatgtccgtccggccgatcaatttattgttcaactatcgccaaatttgatggttgcgcctaatggtcatcctgaaaagccaattcctgattttagtgatcaaaatgggactgttattgcaatgggagcttatgaccaggataagcacgaacttgtctatgcttttaccaattacgtaaccgagcatcgacaaataattggtgaattagagggagaattagcagttgatcctctaacgactccagagaacgaatttggcttggaatgttttataagtgttgatgattaccgaaaagactttacgattgatatcgactatccagatcttgctaacgacatgtttctcgggatttctagccggatgatgcattttgataaggatcagcagctttttgaggacattatctatgttaatccagcacaaaaagaccttaatcatgcctatattgtctttaatacgagtgatctagtggaagaattatctaatgccatcgtcaaaccgtcaacaatgcggattgagatttatcgtaattcacggggattaaaattacctcaatcatatggggtaaactttcagcgactaagggatattactaatcgattcccggtagtggaaggcgatcaccttgtcgagacaccttatacaatgtcctttgctgataacaagatgcgattgaattttggcgccgatcacacgaatgattcctatattattagggtaattggccaatataatggtgaacttgatggaacagtacgattgcgggctcgtttatttgggatggaccagcaaaatgtttatatgagtaattctactgctgcaacagctgctggaacttcaatgatcgcaagggggcatgctatttctaaggagaagttagcggaggagacagcggacacaacagaagatttgaagcaagacgaacattttgtcaatgtggaagaacctcttgaatctacagcagttgaagaagtgcgagaagaagctgatattccatctgcttctgatggtcaagaacaatttcctagttctcaagcggaagaagatgaaacgccaatcgaagaaaagcaggcggaagctcctgcagttagtggagcagtcggcggggatgaattatcaatctcctttgacgtcactcctcaaacggcaccggcagaggttatagaagaagctgaatcttcagatgacaaagaggagcttactatatctgaagaatccgcagtgtctgagtctgctgttgaaattaaagttagtgaagaggagacaagcgcagcacccctaccaatgccgggacgacgaccaccgcgccggcacagtcgttttcaaaatacaatccggtcgaatcattcgttgcgtcatttgcggagattctaatagaaaaaataaagtgtcaggagagattatcctggcattttatttttaccgaaatgtaatcgcttacataaaatgcttgcaattaaaaataaaggtgttaacatttaattgaagccaagtaaacgtttacattaatggataaagggaaaagtgtagtagttttatggagagaggttttattttatggaaaataatcattggtggaataaatcagttgtttatcaaatttatccaaaaagttttcaagataccaatcatgatggtgtcggtgaccttcgtggaataattgatcgtctcgattacattaaggaattaggcgtcgatgtcatttggttgaaccccatttataagtcaccacaagttgataatggttatgatatcagcaactatgaagcaattaacccgactcttggcaacatggatgattttcaagaattgatcgattgcgttcatgaacgtggaatgaaattggtcatggacttagtagttaaccatacttctgaccaacatgactggtttaaggaatcacgaaagggcaaagacaatccatatcgtgattattatatttggcgtgacggtaagaagggtgaagagccaaataattggggttcctacttctctggcgctgcttggaaatatgatgatgaatccggccaatattaccttcatctttttgctccagaacaaccagacctaaattgggaaaatccgaaagttcggcactctgtttatgacatgatgaactggtgggctgccaagggtgtcgatggttttcggatggacgttattaacctaatttctaagccggatggattgcctgatgctaacaagaacgaagacgagaaatacgccaatgttgaaccgttagtatcaaatggtcatcgcattcatgaattcttacaagaaatgaataagaatgttatgagtaagcataagatggtgacagttggtgaaacaccgggcgctacaccggaagatgccgagaagtatgccagtcttgataataaagaattaaatatgattttccaatttgaacatatgggccttgatagtaatcctaatccagcccttggcaagtgggatgatcgcaagacgacccttaaagacttacgggcaaacttaacgaagtggcaagaaaaattgtatggtaaggcatggaattcactttattggaacaaccatgatcagccacgcgttgtatcacgttttggtaatgatcagacggaagattaccgggttaaatctgccaagatgttagcgactatgacccacatgatgcaaggaacaccatatatctatgaaggggaagaaattggcatgactaacgcctatttcccaaagcttgaagattacgtcgaccttgaatcgattaatgcctatcaccaacttgttgatgaccaacatttacttgatggcaagacaatgatgaagtacattgcgatccattcacgtgataatgcgcggacaccaatgcaatgggatgatagcgaatatgcaggattttccgaccataccccatggaaaaaggttaatccaaattataagcagattaatgtcaaaaacgcattagctgataagaattcgattttctattactatcaaaagttgattgaactacgacacacgatgccagtaattactaatggaaagtatgcattagttcctggtaatgaagatgatgaacaggtctttgcatatactcggcaagatgatgacactactttgttggtaatcttgaactatactgatgagactgttaaccgccattataatgtgccagctgatgcgaagttactaattagcaattatgaggatgatcaaaatggcactatccggccatacgaagctaaggtttatcaatactagagtggggatgaataatcatggataaatcacgttcgaattcgaaacaaaaagttgaaacgaagcaggttgatctggatacagggatgccagatttgccaaagaaagagctatttgcgattacatttgcttttctgggaataaacatggctttctcactgcagagttcccagatgagtcggatttgtcaaacgattggggcaaatcctaacaatctaggtttcttcttcatttttccaccattgatggggatgattgtacaaccgattatgggaaagatgtcagatcggacatggaatcgctttggtcgtcggttgccctacctattatttgggactccaattgcggcattagttttgatcatgctaccgttctccggttcacttggcttcggctatggttcaatggctgcgatgatttatgctgcggcagcggtatgtttgatggatttatttagtaatatttgtatgcagccatcacggatgattgttggtgacatggttaataacaagcagaagaactttgcttggtcatggcaacaggtcttttctaatggtgggggaattttagcaacgatcttaccatttatctttacgatgttcggaatgtccaatactgcaaaacgaggggtagtgccaaataccgttatctggtcatacctttgtgcagcggcggttctcctgtttactggactatggacggtctttaatgttaaggaatatgatccggaaacatatgcaaaataccaccacattgatcccgaagaacaaaataagtcagtcagcctttggaaattaatcaagacggcaccgcgcgctttctgggaaatcaacttggttcaattgtttagctggtttgcgatcatgtacgtttggacatacacgactggaacctgtgctcgtaatatttggcatacgtctgatgttacttctgctggttatcaagctgccggtaactggtatgggattttaactgctgtttatagtattgctggtattgtttggggattaatttatgcccatgccaaggctggctcacggaagaggtggtacacatttgggatgatcgtcggtggtttagggttagtctggatgacctttgtcacaactaagactacttcaatcattgcaatgatcatgtttggaattggtaacttcagtatcaacacgattccatttaccctcctcacttcatctttaaacggtaaaaacgaaggtgcctacctcggactcttcaacgttggaatctgtgtaccgcaaattgttgcatcgttatgtagcttcttcctcttcccacttgttggtcacaatcaaccaatgatgcttttgcttggtggcatctccctccttattggggctttagctgtccaagcaattcatgaaggggtaactgttaaagaagtgtagcgctaattaaatctctccttaatataaaatagttaaaataaaagcgggactggaaatttatccggtctcgcttttgcaatctatttaattgtgatggcttccaaagattgatcttctttaacgtgcagcaacgcattgactgtatcaagtgaagtcatgaggggaacattttgcgcgattgtactttggcggatctgaaagccaagtgaatcttgttcataatcatggcgcatagtgttgataacaagatcgatttgcccggcttttaagagtcggttgagttcatcaatgttagatattttttgatggacgtgaatgccgttatccttaaagtgcgatgctgtttgtggggtagtgaaaatttggtagccaatctgagcgaaccgttttgctagtgggagaatgtcttcttcatccccattttcaatcgtaaagagaattttgccattgttagggacttgaacgtgtgctccagaaaaggctttatgaagtgctttttcataggtggtatctgtccccatcacttcgcctgtcgatttcatttctggactgagataagaatcaacgttcgctaacttgttaaaactaaagacaggagctttaacatgaatggtttgtggttctggataaagaccgttagtaaaaccttgatcagcaagtgactggccaaggataactctggtagcaacttgggccatttcgattcccgtaatcttgctgaggaatggcactgttcgactagctcgcggattaacttcaaggatgtacacttcacgattatgaacaataaattggatgttcatgatgccaatacatttaagagcaactgctaatttttcggtagcagtaacgatttgttgtttaatgtcatcatcaaaatgttgtgggggataaactgccattgaatctcccgagtgaacgcccgcatgttcaatatgttccataattccagggataaggacgtcttttccatcgcaaattgcgtctacttcacattcccgtccttcaaggtaggcatcgattaaaatagggtgatcagcagtaatggaggcgttttgttgaaggtattgttgcagttcttcttgattataaacagtctccatggccttaccaccgagaacataacttggacgaacaagaacgggatagccgatttttttagccgctttgataacggcagagtgagtagttgcggttaaaccgattggctgcttaagatttagatcagtgataactttatcgaatacttctcgatcttcagcagcatcaaggtcgtcaacggttgttccaagaatattaaccccatttttagcaataccttctgctaaattaatcgctgtttgtccaccaaattgcacgatcacgcctactggttgttcgagatcaatcacgtttaggacatcttcaagcgtgaggggctcgaaatagagtttatctgagaccgagaaatctgtcgaaacagtttctggatttgaattgatgacaattgcttcataaccagcccgttgaattgccttaacgctatgaacggtcgcatagtcaaactcaactccttgaccgatccggattggccctgaaccaaggacaaggatagatggcttctttgtccgttggctttcattttcatggtcatatgcgctgtagaaataaggggttgaagaagtaaattcagcagcacaggtatcgatcatcttatatacggggagaatttcattctgttttcggaatttccgaacttcttgtggggaagtatgccaaaggcgggcaattgttacatcgctaaagccatattttttgctgattatcagtgtttctgcatcaaatggcttggtactaagatcgtcttcaagttccaccaagtgtttgacgatatcgaggaaatagggggaaatcttagttaagtcatgagtttgcttaagggaatatccacgccgaaatgcttctgctaaataaaataaccgatcatcttggggataacgtaacttcttttcaagcatatctgttggcgcatgatgagcttctgctgaaaagaggtctttttcatcaatttcgagtgaacgaacagccttatggagagcttcctcaactgtccgaccaattgccattacttctcccgtggctttcatctggctgcccaggtgtcgatcagcctgagtaaacttatcaaacggccagcggggaattttgcagacaacatagtcaagtgccggttcaaattcagcaaaagttgtcttggtaacgggattcttaatttcatcgagggtaaggccaaccgcaattttagcagccattttagcgattggataaccggttgccttggaagcaagggcagatgaacgggaaacccgcggattaacttcgataacgttatactggaaactttgcggatcaagagctagttggacgttacatcccccttcgattttgagggcacggatcagcttgagcgcgcaatcacggagcatctgatattcgcagtcgctaagggtctgattaggggcaaatacaatggagtcaccggtatgaattcccactgggtcaaagttttccatacaacaaacgaccattacattgtcagctgaatcccgcattacttcaaactcgatttccttataacccgcgattgacttttcaattaaacattgggtgacaggggataattccaagccattcttggcaacagtacgcatttctgcatcattatggcagatcccgccacctgtaccacccatagtaaaggcgggacggacgattactggatatccgcattggtgtgcgaattcgactgcttcatcaacagtattaactgtctgtgaagccggaacaggttcaccaagctcattcattaattccttgaatttttcacggtcttctgcttcatcaatcgaatccagcttagttccgagaagttcaattcctaattcgtcgaggagaccagttttagataaggagacagctaagttgaggccgatttgtccgccaagggttggtaaaattgcatcaggatattcttgacggataattcgagagagggagtcaaccgttaatggttcgatgtagacatgatcagcaatttccttatcagtcatgattgttgctggattagaattaacaaggatggtttcgtatccttcttcgcggagggcaagacaagcctgcgtgccggaataatcaaattcagctgcttggccaataataatagggccagatccgatgacgagaattttatgaatatcagttcgtttaggcataggtgagggcctccttattactgtcaattaatgccatgaatttatcaaaaagctgttcagcatcgtggggtcctggcgcagcgtctggatggaactgaacggaaaatgcaggatactttgaatgctggagtccttcaactgtgccatcgttcacttcaaggtgggtgatttggaggtcagtatcatcaatggaggatggatcaaccgcaaaaccgtgattttgagaggtaaatgcgatttttcctgttttaagattacggacaggatggttaaaaccgcggtgaccaaatttcatcttataagttttagcaccattagctagggcaaagatttgatggcccatgcaaatgccgaaaatgggcacatgtttttctaattctgcgacagtttccgcaatagttgtcatttcaagtggatcaccagggccgttcgaaaggaggatgccgtctggattgaacgccattatttcactgatcgaggcgttataaggaaggacaattgcattgcagtttcttttatttaattcacggagaatgctatttttcattccgaagtcaagaacaactacagttcgcttagttcccggattagcgtaggattctttagtagatactttgctaataatgttctgggttggcgaagtttgttttaactgttcaagcttatctttgatatcggtaacattatcggtcataattccgcgcaatgttccatattgacgaagcttacggactagttcacgtgtatcaattccttggaggccaggaatgtggtgctttgctaagaaattagggagcgagtcagtcatgcgccagttgctgggaacacgagcgacatgatgacaaattatgcccttgatttggggatacaatgtttcgttatcttcactattaatcccatagttaccgatgagaggattggtaaagactaaaatctgattggcaaatgattgatcggtaattgcttcttgatagccgaccatccctgttgtgaagacaacctcaccaagagttgccttggtagcgccaaaaccctcgccggtatagacagtaccatcttctagaattaaatatcgtttcatgagtttcatcctttcttgcaaaacccttccactgatcacataaactagttgcacgttgtaaaaaagtttaataaaaaacgcttaaaccattggtaatgggcttaagcgtatacgaaaaattgaatatatatgtataattcaatgttagtaatacaacgctgcccttgttagcctcacgggaccaaattaaaggataatgattgatactaaactactgtaattttatgcttttgtcaagtcactaatgaatttttatgcaaaaacatgtttattataaacaaaaaactgcataaaggattttaggtattataacaaattttatttaaaataaaagtaaagtctgcaaattttgtctgcaaactctacttttttagaataattaggcttggtaagtttccttgataaagagaactgaaattgcacctaagagagcagaaataccggtaacaagcatcatgttgacttgggaactaccaagtaatgggaagagaccaaaactaagtagtgaggcaaccatttgtggtacacagattgaaccattaaataggccaaggtaagtacccatgtgtttaccagataaggcatttgtaaccattgttaatgggtaggtgttcattgaagcccaagcaattccgatcaaaacgaaggagaagataagggcgttttgtgaatggataaagaagattgatgtgtatccaacagccccaagcaaaagactgaaagcatagccagctttgtggtggttattaggaactttagccagaacatatgaccatacaactgctgcaattgattgaacagcggtcataacaccgtaccagttaccggcagcttggtaggcagcagaagaagcatccgttgttaaccaaacattcttagcgatggccccgaccgcataagttgaaaggtattggaaagagaaccagcagaagaattgaactaatgcgacattccaaaatactcgtggagcatgctttaagagggtaaaccagtttccaccttttttattgtcttcctctgaaataccatggtaacgagcataagttgcgggatcatattcgtgaacccggaagatagtaaagagacaggtgatgactaaaataacagcgccaacgtagaacgaaattacaactgattgaggaacaacaccctttttagcagtgtttgatataccccaccatgtcaaaaggaatgggaaaatggctgctaaaacggcaccggtattacagattaaactttgaatcccgtatgcataactcttttgatcatcgttaaccatatcaccaaccatcatcttaaatggctgcatcgccatatttgatgaaagatcaaggaaggcgacggtaatagccccaaaccagagggctgctaacgaaccgtatccaaatccaaaacttcctgaattaggcagtaaaatcataacgatgacggcaatgaccatcccgattaacaggtaggggagacgccgaccaccaagttttggcgcccatgttcggtcagaataataaccaatgattggctgcacgatcaatcctgcaagtggcggaagtaagaagaaccatcccaaattattaggattagcaccaattgtttggaagatccggctcatttgtgaaccttgtaacgtaaaggcgatttgaaccccaaggaaaccaaagttaatcatccagatggtactctttggtaaaattggcaatccactcgtcgaagtttcttggtcttggttaagtacgacagactcatcttgactcatgaaaaacaactcctaacgaaaaaatgtataaaataattgcaattcgagcttgtgtaagctcttacacgaataatataacaaacttatttcatttgtgcaaccgcttgcaaaaaagaatagtaaaaagtcgtgatctgtttcaataaaaagatcacgactttttaatgctctaatgtttcttgcctaggagtcttacgctatttcgcggtgtgatatggattggaataaattgtgagtcatcatcgttcaataggctcctaactgcgatgagtcccatttgataaaagtcctgagttacgcttgtaatagttgggatggtaatatcacagagaaaagtcccatcgatactaataaatgataggtcttttggaatatcaaggcctagcaaatgagcctctctgatcatgcccacagccaccatatcactagctgtgatgatcgcgtcaagattcttattcattagtgttttgagcatattttgctgaggaccaaaactgtaatccccatattcgacccatcccatatgagggattaatccgtgttcagtcattgcccgttggtagccttgaagtcgttgcttaccggttgaagaacgatcgatgccggctaatccaatccgtgagtgtcctcgttcaattaaatagttagcggctgaataaccaatttcctcgttatttgaacttgtaaatttaaatccaatatatcgggaatcagtttcgtcatagaccgatactaaccgacaaggggtattgctttcttgtaaggtgcgagctgcttgttcgtcgagggaggttgcgactagcagaatgccggcaacatgccgttcgagggcaacgctaattgcttgattaagcagtcgggcgttatggtttccagcgtaaagaataaacatttggtaaccagctttatctgtttctgcttgaatagcagcgatgatatcatttgagaaattcgtttgagtattatttaagataacggcaattaacatactactattggcagctaattcagccgctgcaaggtttttcttgtatcctagttctttagcgattgtttcaatcttagccgcggtttcgggacggtaggatttcgcctttttggataaaacacgagaaacagtggccgttgaaacgtgggcccgttgagcaatatctttaattgttggcttcatagacggacttcctttattgttttcttattaaacctattataatgaaattgcgattttttgtaaacgctttcaatgggggcttaatcattatttaaaacaaaaataggccgaaagaaaaattcttccagcctacatagctattctttatttccgtttcgtaatgataatttcacgactgcctcacagcgtgctgtttggggcatcatgtcaattggttgaatgtagtcaacgtgatagacactagttaaccgccgtaaattacgggcaagagaagccataccacatgagacgtaggcaaactttcgcggcttaacttttaagatttgcttgattaattggtcatctaacccggttcgcggaggatcaacaacaagggcatcaaagttgagtccttctttttgccagcggggaagaacttcttctgctttgccgacttcatatttagcgttagtaatattatttagcttggcattttcgttagcatcagccaccgcttcggggatgatttccattccgcaaacagattttacccgcgatgcaagtgaaaggccgattgtcccgatcccggcatatgcatcaattaaggtatcatctttgtccaattcaagggctttagaagcttcttcgtacagcacttctgtttgttcaggatttagttgtaagaatgaacgtgctgagagtttgaaatcgagtcccatcaagctttcaaggattgaatcttttccagcgaggtggatcattttatcaccccaaattaagggtgtatcacctgggttaacgttttgcataactgaaacaactgctggtagttctttttcaatgcgttcaagcaattcgcgtttgtgaggaagtttagcagaattagtaatgaaggttaattggacttccccagttgaccatgattcacggactgctaaggttttgatgataccgctattgttcttttcatcataaactgggatttgcaagtcttcgatcatcttcgtaactgctcgaactgtctccattgtacggggcatttgaacagcacaagtctccatatcaacgagggtatgactgtttggctggtaaagaccggctgctactttgccattgaccattcggatttgaaactgggccttgttacggtaaccgtattcttcaggggctgcaatagttgggcgaacatcgtaattacggtagccgtatggttgaaacttttcgagactatcgatgattacttgccgtttaaactttaattgttgttggtaagcgaggttttcaagttcaaaaccaccagcgatatcagcgtactcatctcgtggcgttacccgatcccgactctttttccggatccggtgaattttagcttcaagatagcgtgggagaacgcgtgtaacttccgcgactacgacttcatttggcagggcaccagggacaaaacataccttgtgcttatagtagccgattccgtgcccgttaacgcctaggcgacgaattgtgagggggaatcgtttcccaacccatacatcaacatcttgttcatgttgtttagtttgtgtcatattatttctccgttctattaattcaatgtgttgactattttagcacatctccaaataccactggacaaatatgtcagagatgaaaaatcgcgtaattaattttcggaatgataacttagccaaacttatagtcaattattatggaaatagtcaattaagtgtgcatattactaataatatgttttttgaatgagtaaaattatagtagaataacaatgtgaaatgttgcataaataacttaaaggaagtgacacgtttgaaaattgctgcaattgccgggtcaaatgctaatcattcatacaaccggatgttattagaatttattgcccgtcattttagtgatgatgatattgatgtgattgatattcgtcaagtgccaatgtttaatgaaaattataagggaaagattcctgaggctgttgctgatattgatcgtcgtgtttcaagcgccgatgctgttatcattgccagcccagaatacaaccactctgttacctctgctttaaagtgtgtaattgaatggctttcctatgaagttcatccattagaaaataagccagtcatgatcatcggtgcttctacccatgaccaaggctcatcccgttctcaagttcaattacgagatattttaatctcaccaggtgttaatgcttatattttccaaaacgaagagttctttatgagtgatgccgctaatatcattgataaagatggtgacattactaacgaaacgactattcatttcttagaaaaatgtatgcgtgaattcaaacactacgccaaggcaatcaatcgtatggttgctgaaaagaaggaggcgaagaagtaatgaaaatccttgctttagttggaactaatgccaatttctcatataaccggattttgcttaaatacatgaaaaagcacttccgtcaaatggctgatattgaaattgctgaaattagccaattgccaccatttagcgttgatacccctctttctgaacaaacagaggtatggaagttaaagcaaaaagttaaggctgcagacggagttattttctcaactcctgaatatgaccatgggattccagcagccttaaagagtacagtagaatggctttcttacaagactgatgtattaaaacgcaagccagttatggttgtcggtgtatcttatggacgccaagcttctgcaagatctcaagttcaaatgcggcagattctggtttctcctgattgtgatgctaacctattaccaggaaatgaagttctgattggtaatgctagtcattccttctccaaagacggtcggttaattaatgccgaagcacgtgataaccttgaaaactgctttacccattttgtggaatacattcaaatctttgaaaatgcaaataaggagggactggatatgtccgttaaacaaccaacgatcagtgaagcttacattaatttccctactggtcggttgacattaaaagaagttcaacaaatcttcagtacaatcccatttgaaattgacttaattgacagtactgaccatttcgcatggttctctgacaagccaaatcgggaacacgttcggaatgtagcttctctcggggaaactgttcaagaatgtcatccaccgttggctgttccggttgttatgaagattattaacagtttccggaatggtgaaaaagacgttgttacccgtccattatggatgaatggtcaccgttcattgattcaatactacgctttacgtgatgttaatggtcattaccttggaaccatcgaatttactggtagtgtggaatacattcttaacctcttcgaaaatggtgcatggagtactgatggtaacactggtgcatctaagcatgaggatgctaatgacaacagtgaagaagctgacagcgttgatgcatcaactggtgcttcagaatcaagtgatgatgataacaccgacaatgctagtgaagtggttacaaccccagcaccagcaacaaacgatgatactgatgcggacgctacaacaggcgtatcagatgcaggcagcgtagacgcaaatgatgatgaggcagatgctacaacaggtgcatccgaaaactagttatgaataatgaattgatggcgcagcggcatgtgatgactcatcacgctctcggaactcgcataaatttaacgatttttggcaacaaatacttttcattgttaaagaaatcaatggacctaattgaccactatgaggaccgattaacggttaaccgtaatgaatcagaagtgatgtcggtgaaccatggtgcagggaaaactccgaaaatggtatcgccaacgacttttgacctcattgagctggcagtgaaatatagtcgtgaaaactttggctttaacgctttgattggcccgttagtaaaattatggaaaatcggttttgcaggggcgcacgtgccaagtgatgctgagatcaaagagcggttgaagttgatcgacccttataaagtattgctgaaccgagaagcacggacggtatatttagaagagccggggatggaattagaccttggcggaattgcgaagggctatattgcggaccgtattcgggatctttggattgaagctggagttcccgcgggaattatcgacttaggggggaatctcttatttgttggtaagtcgccacggcgggatgatgggcagtggatcatcggtgtgcaggatccgcaactgcatcgaggtgaaaatttggcaactgtccgcgaaccggcttgttcggcagttacatctgggatttatgaacgatttttgatcaaaaatggtcgtcgttatcaccatttactagatcctcggactggatacccattagagactgatttgagcagtgtgactgttttcactgatcaatcggtaatgggtgaaattgaggctaagcgactcttcttcaatggtgaaccaatcacaggctgggaagtgcgtcctggtaaccgtggcgctatctttattcataatgatgaatcaatggtaaacgttgggctgaataaaaattgatttcatttaagcgtaggtaaacgaaatgtttacctacgcttttttgttaatgcctttagacctggttgagtgcgcgagcagagcgagtgcacgaaacaaaaaaacacctgctatgcgggtgggcgataaaaattatataaaaaaggcctcttttgccttaagatgtaggtgttcaagccaaagccaataagggaaaagaggttatataaatatggctaataaattaaatagcttagcccatacgaagtggttatgtaagtatcacatcgtattcataccaaagtatagacgtaaagcgatcttcaatcaataccgaacccgagagattatattcgtttattgtgcaaatataagagagtagaaataattgaaggtcatatgatgccagatcatgtgcacttgttagtaagtattccgccgaagctaagtgtctcgtagtttatgggatacttaaaagggaaaagtgcattaatgatgtttgatcgacatgcaaacttaaaatacaaatatgggaaccgacattttttggctgaaggctactatgtgattacagttggattaaatgaatccacgataaagaagtatatccgagatcaagagaaacgtgatatatcaatggataagctaacaagtgtggaatattcggacccttttaagggtaagtgaggtagtacaaacaccgcttaaagcggtggcaaagtagtcagagcattttggcttgagcaaagcgaaagccagcgccttgagacgccggcttttattatcggcttatagccgatgtgcaaaccacccgtttgacgggtggttatgatttgtgtgcgcctggcatggatattagctaggcggtgaaagtccgctatgggccgtagtagtcggaaccatgagctgatgacaagggtgttcattgtgaagtagaatctgaaggaagtctaaggcaaagtactgcaccgatgaataagaagtagctataaggctgaaggtaactggataaggttgcacaacaagctgaagtccaatactactcgaagttactctcagtaaagctaacggtgacatggtacgaaagttaatgttcttacccggggaggcctgacttacacgcttccgacaagaggaataagataaatttccacagaagcaagcggtagcccaagtattaacgcccatctttgagcagattttctcggatagtagctttggatttcgcccacatcgtggcgcccaagacgcaatagcgaaggtagttgatctttataatcatggttacaaacgtgttgttgacctagacttaaaagcctactttgacaacgtaaaccacgatttactgatgaaatacctccagcaatacattagtgaccgatggatattgagactaattcgtaagtttcttccgagcggagttctagatcatgggctttttgcgtgaagtgaaaaaggagcaccgcaaggtggaccgctctctccactattggcaaatatttatctaaatgagttggataaggaattgaccagacgtggtcaccaatttgtacgctatgcggacgactgtaaaagccaacgagcaggggaacgagtgatgcaaagcattacgcagttcctagaaagacgattaaaggtcaaagtaaatccagataaaagtaaagttggtagccctttaggcttctcattaggtgtaaaccagaatggtgcttacgcgcgaccagctaaagaatcacaaaggcgagttaaacacgcgttaaagcaattaaccaaacgtaatcgaggagtctcaattactagaatatttggggaaattcagcgaaaaatgtgtggatggctccaatactattcaattggtaaaataacagcgtttattcaacgattagactaatggttaaggacacgcatccgacaatacatctggaaacagtggaagaaatttaaaacaaaagtcactaacttaaagaagttaggcatgtcataccacgacgcgtataaattcgctagtacccgcaagggatactgacaaaccgcgcatagtaagacactaacttactctcttgaaaatgaaaaactggaacaactcggactaatgaatatgtccaagatgctctagtcaattcaatgtgattaagttgtcgaaccgccgtatacggaaccgtacgtacggtggtgtgagaggtcgataattgaactagtcaattatctcctactcgatttgacagattgataatgatcgaacgataaagaaaggcagaggagattggtacatatgatcattatttcatttataaaaagtgaataaaaaagagggtatgctgctttaatcttcctcaacggttgatataatagcattgaatgttaaattttctgatgataaatcagttgaaaaaaactgttaagagtgtagaatgacaattgaaagttattactaaaatgttgatattaaaagatggcgattaatcatcatttaattatcagctttttaataaaatgaagttttttaaattgctagtttagccacttgtttaataaaagattggttgtaacttgccagcaggtatcaccattcatctgatcgacagctacagatgaaatgccacctggtagtgatctttatggttgctatttatctcaaggagtactttaccttttatttataaaatggtttattgaatgacttaacttactccaaaagatagtggtaagtagtgccaggtggcttgggataatttcccttaaaactggcggatataggctattatgataacctaaaagaggcgacccccgatgcctatttaggctaattataatagtagctgtcgcttgactggatagtggtaaagccaagttattaagtgttaagcaacaatttttgtgcattgtttgttgcgactactactccctaatagatataaggtttatagccttatatagtaggtatcataaatggttgaacgctgtttagataaatttgtcaaacggtagaatgataatgcttataagaacccccgaatacttaactttaagcatgagtagcaatatctcccccagataacttaaaagtcttattgtctacgccaacagcaataagcagataacagtttagttttatcatataagtgtatttgctactaaaagttttttactgttcatgacaattgtgctaaacaacgattcaacagtacacctagtactagtgatacctgaaaagtcggcacagaaattacaacagtatggtaaatgtgctagcctactgtagtaagccgcttggtggtaggttttaaatgttgaatggtggatttatcaccaaagttagttgtgcgtaaactaaccaaaaattcaattgataaattaggaaaagtgtaataagataattgcaaaatagaaaacacgaatgcattttaagtaggttgttcagagaagcagcggatggtgagagctgtcgaccgaaactccggtgcaaaaatatgtgggcaggtaattctgcacggatagtagccgttatctacttcgaagggtgactaaagatagtcaaacttgggtggtaccgcggaactagagccatttcgtcccaaaatataaaggatggaatggctcttttttatataattaggaggaaatacgatgttagatattaaaaagattcgtcaagaacctgatttttataaggaaaagttagctacgcgtggtgtaaaaccagaagaaattgatgaagttattgcgttagataaaaagcgacgggaattgctccaacaaactgaaacaatgaaggcgcaacgtaatgaagcatcaaagaagattggagaagctaagcgtaatggtgaatctgccgatgctgccattaaggaaactcgtgaacttggtgataagatcaaggaattggacgctgaacttgaagtaaataatgctgaactccatgataagatggctcatcttccgaatgttcctcacgatggtgttccagttagtttaacggaagacggtgccgttgaattacggagagtgggtaaggttcgcgactttgattttgagcctaagcatcactgggatattggtgaaaatcttggtattttagactttgatcgcgctggtaaggtttctggtgcgcgttttgtctactacttagggcttggtgctcagcttgaacgagcagtttacaacttcatgcttgatgaacacatgaaggaaggatataccgaagtcttaccaccatatatcgtcaatgctgattcaatgtacggtactggtcaattccctaagttcaaagaaggagtttaccaagttaacggtgaggatatgactttgattccaactgctgaagttccattgactaattactaccgtggcgaagttatcccaactgaagaattaccagtttacgttactgctttaacaccatcattccgttctgaagcgggagcagcgggtcgtgatacccgaggattgatccggatgcaccaattcaataaggtagaaatggttaaatacactaagccagagaactcatgggatgaacttgaaaagatgacggctaacgctgaaaatatcttgaagaagttaaacttgccataccatgttattaccttaactactggtgacatgagctttactgcatctgaaacccatgatcttgaattgtggatgccagcacaaaataagtatcgtgaagtttcaagttgttcaaactgcttggacttccaggcacggcggatgcacacacaataccgggatgaaaatggtaagttacaatatgttcacacacttaacggttctggtttagccgttggtcggacagttgcagctatcttggaaaactatcaaaacgctgatggttccgtaacgattccagaagtattggtaccatacatgcatggtgttactaagattactaaggaaaatgcggttcctttccgtaataaagttaataaataagatatatagaagacagtttttaaaaagaagttcggattgctaaatctgagcttctttttttgattaaaaaaatctaagaaaaagtgaaaaataaataaattatacttaataaaattaacttatcgctggtcgctctctttaaaaattattgtttaaaacgctaacatcttggataaacacaaactttgatgaagaatatttattttgttttctagcgatgataaagtagtatcaacgttaaaatttgattaaaaaggagtcggtgcagatgcatagcagcaagataaaaaatatgatcatcaccattgttgcagttcttggaattgtagtggggtggcaaatggtcgagcctcagcaggtatctgctgccgaaccgacttatacgtttgcaactaataacacctttgaaccctttgaaattcaagatagtaaaggtgggtactcaggaaagaatcctgggattgaaattgaaatgcttaagaaaattgctaagcatgagcattttaagtatgaactgaagtcaatgagctttaatggtgacttacaagctcttgaagcaggacaagttgatgcagtaattgccggaatgagcgttactgatgaacgaaaagaaaagtatgatttttcaacaccttactatactagtggggttgttatggctgttgcaaaagatagcaatattaagtcgatgagccaattaaaaggcaaaacagtttcagctaagtcaggaacgagtgcggcattatttttgaagaacaaccaaaagaaatatggttacaaaattcgctactttgattcctcaaatacgatgtggaacgatgtgaagactgggaatacagcagctacttttgatgatggccctgttcttgaatacggaattaaagaaggtgtcccacttaaggttgtgacaaagaagccaattgatgcgcaaccagttgccgttggatatcaaaagggcaagaacttagaattacagaaaaaaatgaatgatgggatcaaatggctaaaagatactggtcaaatggatcaaatcattgataaatatactaagagtgacaaaacaacgaaggacagtgcgactgatcggacaatcctgggattaatccgcgccaattatcctgccttgcttcgtggattatggatgacaattgaattaaccgttgtcggcattatttttgcgatgatttttggggtaattttaggtgtattaggtattgcacaaaacaaatttgccaatgctgtttctagtaccctgatttatatcttccgtggtattccaatgattgttttagccttctttatttacatggggattccaaatgttattggccataaagttccattattcttggcaggaatcttaaccttgacttttaacgaaggggcctatattggagccattgttaaaggtggatttgaatccgttaatattggacagtgggaagcagcgcggagcttagggttgccatatagcaaagccttgattaaggttattgctccccaaggatttaagttaatgattccttcgttagttaaccagtttattattaccttgaaagatacttcaattctttccgcaatcggtgtaatggaacttacacaaacggggactgttatcatttcccagaacatggaaggatttaagatgtggttaattattgggacgatgtatatcattatcattaccctgttgacttggttatcaaactacgtacaaaagaggatggcttaatatggataaaaactataaagtacaagtaaaaaatctgcacaaaagttatggaagtaatgaagtgctgaagggtattagcttggacgtaaaacccaatgaggtggtttgcatgattgggccatcaggatcgggtaaaagtacctttcttcgttgcattaataagcttgaagaaccaaatagcggccatatttatattgatggctacgatattgctgatccgcaagtaaatattaataaggttcgggaaaatatcgggatggtttttcagcactttaatctctttccaaatatgaatgttttggagaatatcactttggcacctattcaacttggcaagatgaccaaggaagaggcagaaaaggacgcgatgcactatcttgacttagttgggctggctgataaagcgggggcagatccaaccaagctgtctggaggtcaaaagcaacgggtagccatcgcccgtgcccttgcaatgaaaccggatgtaatgctctttgatgaaccaacgagtgcccttgaccctgaaatggtaggggatgttttggaagtaatgaaacggttagcgcaagaaggaatgaccatgatcgtggtaactcacgaaatgggatttgctaagcaagttgctgatcgggtggttttcttccataatggtgatattcgggaacaaggcaccccagaagagatttttgataatccacaacatccagatacgaagaatttcttggataaagtgctaaatatttaattatcgactgacttttagtaatttaaatttgacaaagctagaataatcattataataatgagtaacttctaataattggttgacagagaatctagcatttgctgaaagctggatccaattaaatggcatgagcgtttgaaatggagtagtttccttatcaaccgagaggtagtttgcaaatgtgagctataaagatgggtggaaccgcgttaaaaaacgtccctggtagatgattaccagggacgtttttatttgtttaagaaaacgtttttgttattaactaaatttttaaggaggcatattatggacgaaaaacaacaacagaagttagaacgatcgcttaaaagtcgtcatgtgacgatgattgctattggtggagctattgggaccggtctttttcttggatcaggaacagccattcaccaagcaggtccatcaatcattctttcatacctgatcgtcggtatcttttgcttctttatgatgcgggcgttaggggaacttattttagctgatacttcaaaacattcatttattgattcggttaaggaatatcttggtgaccgaatggaatttgttgctggatggatgtactgggcatgctggctaacattagcaatggcagatcttactgctactggtatttacttgaaatattggttccctaatttaccacaatgggttggtccattaattattgttattttattgatgttagtaaacatggtaaacgttgggctgtttggtgaactagaaagttggttctctatgattaaggtgattgcaattttagccttaatagcagttggcgcggtcttacttgtgatgcatggtcatgttgaaggacggccggtaactctttcaaacctagttaaccaggggggctttttctctactggtccgatgggcttcttaatgtctttccaaatggtagtttttgcctttgtgggaattgaaatggtcggtttgacagctggagaaactaagaatccagataaagatattccgaaggcgattaataccttaccagtccggattggtttattctatatcggatcaatgattgcgatgatgtcaatttacccatggttccatattaagactacttctagcccgtttgttcaagtgtttgcagcaatcggtgttccaggagcagctgcgattttaaactttgtggttttgacagctgcaatgtctgcaactaacagtgcgatctttagtactagtcgttccctctactcattagctcgaagcgggaacgcaccaaaacgttttggtgaattaagcgcgaaggcagttcctaatcatgcattaactttctcttcattgattctttttatcacagttatcttgaattatattatgccagcgggaatattcgatgtgattgctggaatttcaacaattacctttatttttacgtggatcattattttggttgcacatattaagttccgacaacaaaatcctaagggagttgcaaacttcagaatgccaggatatccgattactagttggttaacaattattttcttcttggcagttctagtgattttactctttattgattcaacacgaattccattaatcctttcaatcgtaatttttgcattgcttgcttatggttatggatttttgaagaagaaaaattaaaaacttggcagagactcgaaaattttgagtctcttttcttttgcatttgataatgaatagtttaagagagagctaaaaagtaatagaaaagaaggttttgtttaatagttggaggagatctaaatcccggtgtgacgcggtttaattgtatttttgttggggagggattatactgaaagtgtggaaagatagaaggccgaatttaacaaacatcttcttataataaaactactttgaagtacgttaattagactttttgcataaaaataccaacaccccactccacatgaaacgctttagtttccgtaaaaagtatgttagctaaaagtaattagtggctatatctacaacgaacctataatgataagcttaagttcctcgtattaagcagatagataagttaccaaaaattaaaaataataatactcggcctttcttcccacttcttcatggttgagaagcccggaatgttattttgataaacgtcccgggcttctgccagtttaacccctaaatattttatgttatttcctgggaaatactaaagttagtgaaactgtaaattacttctctaaatatttgaacatttgctcaattgattttaattgagtataatagagaaacttggcagaggcgacggaaagacacatagcaaagacgattcgccacgtgtaactttccgtttctttttactaacatatgataacgttttcatgagttctgaaaaaactttgtgaaattttaaaaagctgaaaagttaataaaataaatgaattgtaaaattataatttaaaaaatgataaaaattcacaaatcgtctacaaaacagcgctttacaggaaggaaatttaaagatattcttaagtagttaactcgccacaactgcaattatattatcttaatttggaacggctgttaacgaatattctatttaaggagggtacacagccatgtctatgtatcttattatcaacattattgggttgattgtctttcttggaattggatggcttttctccaagaatcgaaaggaaatcaactggaagactgtaggaatcatggtagtattgaacttacttttagcatggttcctagtaagttcagcagctggtcgtgctggggttaaagcggccgctgatggttttgcttggattgttaacgtctctgcaaaaggaactgtgtttgcattaggtgattggtatacaccaaagaaccttaacttcatttgttctgcattgatgccaatccttatgattgttccattgttcgatatcttaaactatattggtgtattaccatggattattaagtggatcggacgtggactttcattcattactggtgaacctaagtttgaatcattctttgccgtagaaatgatgttcttaggtaacaccgaagttttggctatttctggtatgcaattacgtgccatgaacaaggaacgtaatttgacgattgccatgatgtcaatgtcttgtgttactgcttcaattcttggtgcatatattgaaatgatgccaggacaatatattctgactgctgttccaattaacattattaactcattgattgctgtaagtatgttaaaccctgttaaggttccagctgaagatgacaccatcgaaaaggttggtgctgaagttgactctgataagcgtgaaccattcttcagtttcttgggagactcaattttaggtgctggtaagttaatccttatcatcattgctaacgttgttgcctttgttgctttggcagccttgatcgatgctatcttagcattattctggaaggacctttcacttgaaagtatcttaggtgttatcatgttcccattctcatggttacttggtttacctgttcaccaagcatggatgctttcccaagatatgggtatgaaattgattactaacgaattcgttgttatgggtaaagttactggtgaaatcaacagttacgcacctcacttgcgggctgtcttgactgtcttcgtaacttcatttgccaacttcggtactttaggtatgattattggtgccttcaagggattagttgacaaagaaaacaacgattacatcgcttcaaacattggttacttaatgctttctggtattttggtttcattattatcagctgcatttgttggtctctttgtttggtagaaatgaaaaagcagctgggaaggctgcttttttcaacattaaattcgaaaacgcttgcacgataaaaaggagataaaattatgactacaaagattattatggatactgatccaggtattgatgacgcagctgctttaacaatggctattaatgacccatcattagacttgaaattagttactacagttgccggtaacgttactgctgataagacgactgctaacgccttgaagattattcacttctttggtaaggatattccagttgccgcgggtgccaagcaaccattgattaagccttttgaagatgctgctcgaattcatggtgaatcgggaatgcctggttatgatttcggtgacgactatggtaagccacttgataagactgctgttgaagcgcttcatgacgcaatcatggctgaagatgaagtcattctggtgccaactggttcatacactaacattgcattactctttagcgaatacccagaagtaaagagtcatattaagcaaatcgttgcgatgggtggttcgttctccggtggtaacatgaccagtgctgccgaatttaacgtcttcaccgacccagacgctgctaaaattatgtacaatgcaggtgttccaattgtaactgttggattggatgttaccttaaaggcgctcttgactgctgatacaattgaaaaactcggtagccttaataagactggtgaaatgttgcatggattaattacgcactataatgatggtaatgatcaaggtcgtccaatgcacgatgttaatactatcttctaccttcttcatccagaagcatttactacaaaggatatgtgggttgatattcaaacggatggtccggccatcggtgctactgttggtgacattcgtgctgcttatcatgatggtaagaccaacgcaaaagtttgcttagacattgatgctgaatacttcaataagtggttcttagaagaagtaagcaaaatgaaataagatactgggagctgagagcttgctttcggctctttttattactttcttgtgtaaacgcttcacagtataataacagtagttaaagtaaggaggaaatgcaaaatgaagaatattatgattgctggcgctggtgtattaggtagtcagattgcatatcaaacggctttatctggctttaatgttagtgtatataaccaccatattgataccgctgaacgacggattaaggcgttgaaaagtgattatgaacgtgacttgcatttgactgataaggaatttcaacagggccttgataatattaaagttattaccgatgatattgcgactgcagttaaagatgctgatttaatgattgaagctttaccagaatcgttagagttaaaggaacagttttacgaagaggtttcaggattagcccctgaaaaaacaatctttgctagcaactcctctacatttatccctagccaactagctccttatactgatcggccagaaaaatttcttaatatgcactttgctaaccaaatttggaaatttaatgtggtcgaaattatgggcacctcccaaacaagtccagaggtgattgaagaagctacaaagtttgcccgggaaataaagatggttcctgttattcttaataaagaacaacacgggtatattctgaattcccttttgattccgttacttgcatctggtcttagcttatgggctaaaggagttgctgatccagcgatgattgataaggattggatgatttcgacaggtgcaccaatgggaccatttggcattttagatatggttggtttacggacggcagcgcaaattgaacggaatgcctatgcccagactaaggatgaaagtcataaggaaattgccgataagatggaacagatgattcaagaagggcacgaaggaaaagaatcgggacaaggattttacaattatcccaatccagctttcatggatccagattttctgaagcattaagattataagtattgaaaacttagaaaagggagcaagataaaagtcactcgtgactgctatcttactcccttattttgcgctccaattttcacgtaatccggttgcaacaatggcaaaattacggtacagtagtagaagacgtgaaacaaaaaatgtttcacgaaaggagacctaataaatgaatcctgaacaatttcaacaagcattagctgatcatggtatcaccttatcagcagaacaaatgcaacaatttgctgactattatcaattattagttgaaactaatgaacatgtaaatttgacacgaattactgaaaaggatgaagtgtatttaaagcatttttatgactcaattacaggagcgtttgctgaaccacgcttagagagtgaagaactgacattatgtgatatcggtgctggtgccggctttccttccttaccgttgaagatcgcttttccgcaattaaaggtaacaattgttgattcgttaaataagcggattgcttttcttgaagccttagttgccaaactcggtttaaccgatgttactttgattcatgatcgagcagagacttttagtgccaagaacagtccatatcgggagaaattcgatattgttactgcccgtgcagttgcccgcctatcagttttaagcgaattatgcttgcctgccgctaaaattagcggggaattcattgcttataaggcaagtgcagctccggaagaacttcaacaaggtggggcagcaattaaacagcttggtggaaaagttcaaaaaacggtgacattgactttactggaaactgatgaagaacgtaatattattgtgattgataagataaaggcgacccctaataaatacccacgtcgtccaggattaccaagcaaaaaaccaattcaataagataaggagttgaaagtatggctttttcattatttggcattggaaaaaataattccgataatacaaaaaataaggtcgtagaagtaaaaattgatcaaattattcctaatcgttaccagccacggaaagtatttgatcaagacggtatccgtgaattagcacaaacaattgacgaacatgggttgttacaaccaattgttttacgtgaatacgaaccagcaaaatatgagattattgctggggaacgtcgataccgggcgatgaagctcttgaagtgggaaaaagcgccagcaataattgaaaagatgagtgatcaagagacggcttcacttgccctcattgaaaatctgcaacggtcgcaattgagtccagtcgaagaagcgcaggcctaccgacaattaatggatctgaaccatcttacccaatcgcaattagcaaagggaatggggaagagtcagtcctttgttgctaacaaattacggttgctgcgtctgatcaccccagtccaaacagctattttagatcaccggattacggaacgtcatggtcgagcattattagatttagatgaaaaacaacaacgtgatatgttaatgcggattgttaatgaacggttaacagttcggcagacagaagatgaagttgctcgcttattagggcgtccgttaccttcagaaattgcagaattaaaagcagccgctaagcgcaaagaattagcttctattgaggatcatgctgaagaaacagcagacgttgaagaggtaccagtagaaaagcctgcagaaaagaggcgctctcctaaacgaaagacagctaagaaggcccgaagcaaaaaaactcagcaggctaatgatgcgcgtttagctttaaatacgattaaaaagtcaattaagctggcgacaaatgaaggctttgaaattaaaatgcatgagaaggaaaacggcgatacttatcaattaacaattgagattccgaagaaacagtagggaggccaaaaaatgggttctgtaattgcccttgcaaatcaaaaaggcggtgttggtaaaacaacaacgagtgttaatttgggtgcatgcttagctgagactggccagcgcgtcttattaattgatcttgatcctcaaggaaatgcaacgagtggtttgggcgttgaaaaacagaatattaagcaaagtatttatgatgttttaattaatgaagtgccattagaggatgttattcaaaagacaagtcacgagggagttgacattgctccaacgacgattgccttatctggagctgaagtagaattaactaatttaatggcccgagaaacacggcttaaggattcttttggggaaattcgtcaaaaatatgattttattttaatcgattgtccaccatccctggggctcctgacgattaatgcatttactgcttgtgactcaattctgattcctgtccaaagtgaatactatgcattggaaggtttaagtcagcttttaaataccatcaagcttgttcgtaaacacttcaatccgcaacttaagattgaaggggttcttttgacaatgtttgaccggcgcacaaatcttggacaacaggtaaattctgaggtcaaaaagttttttggtgaccaggtttatgatacgattatccctcgtaatgtccgtttatcagaggcaccaagtcacggcttagcaattattgattatgataaaaattcaacgggggcacacgtctaccaacaattagcaaaggaagtgttggctaaccatggcaaagaataaaaaaggtgggcttggtcgaggtattgaggccctctttgcggaaaatgaagtaactgagcttacggatgaaacggttcaagatatcaagttatcgttaattcatcctaatccctatcaaccacggcgaacgtttgataaagaggcgttggcagagttagcttcatcgattgaaaaatcaggggtgtttcaaccaattattctgcggcaaacggatccaaaaattaaccgttatgagctaatcgctggggagcgacggtttagagcttctaagatcgccaaacagaaaactatcccagcaattgtgcgtaagatgagcgatgaccagatgatggaaatcgcggttctcgaaaatcttcaacgtgaagaccttacaccacttgaagaagcgcaagcctatcagatgttaatggataaattatcattaacgcaggcacaggtggcaagcagattaggaaagagtcggccttatattgccaattacttgcgattactagggttaccaaaaatgatcaaagagtttcttaatactggcaaactatcgatgggtcaagcacggacaattctcggtttaaaagataagacaaaacttgttccgcttgcccaacgagctgtcgaacaaaatcttacagtgcgacaattggaagagattgtaacgcagactaatggaacggccaaaaagaaagaagaacggcggacacaacgaaaaccaatctatattcgagaagctgaatcacagttgcagagtaaatttggtacaaaagttgctgtcgcgcaaagtcggaaaaaaggcgcaggaaagatcgaaataccttatacgtcaaatgaagactttactcgaattcttgaattattaaatataaccttagattaaggaggaataactcatgacagcatatgataaaggtgacattgtaatgatgaaaaaggctcacccgtgtggaactaaccgctggaagattacacgagtgggtgcagatattaaaattgaatgccaaggatgtggtcatattgtcatgatgacccgtcaaaaatttgataagggattaaaaaaggttatcgaaaaagcggatcaagatgattaatatttttaatgattgatgatcacaaataactaattgtagattaaaataataaatgattaattgaaaaggaaagtgaacaatttatgtcattaactgcaggaatcgttggcttgccaaacgttggtaagtcaacactttttaacgcaattactaaagctggtgccgaaatggctaactacccattcgcaacaatcgatcccaatgtggggatggttgaagttccagatagtcgccttgaccggatccaggaattaattccagcgaagaagatcgtcccaactacctttgaatttaccgatattgccggaattgttaagggtgctagtaaaggtgaaggactaggaaacaagttcttggaaaatattcggcaaactgatgcaattgttcatgttgtgcgggcatttgatgataatgatattactagtgtttctggtaaagtggatccaattgaagatatcgatactatcaacttggaattagtaatggctgacttagatgctgttaataagcgcttggcaaaagtacagcgggctgctaagggtcgtgataaggatgctttagcggaattagaagtactcaataagattaagccagttcttgaagatggcaagggtgttcgctcaattgactttagcgatgatgaacaaaagattgtcaaagggcttttcttgttaacaagtaagccagtcttatacgttgctaacattgctgaagaagatatggcagatccagatagcaacaaatacatggatgcaattaaagaacacgtaaaagatgacggagaagttattggcgttgcagcagctgctgaagaacaaattgccgaaatggatgaagcagataaagcggatttccttgaaatggaaggcgttactgaaccagggttgaaccggttgattcgggcagcctacaagctcttgggtcttgaaacattctttactgctggtggtcctgaaacgcgggcctggacttataagaagggcacaaaggctccacaagcagcaggaattattcactctgatttcgaacgaggatttattcgagcagaagtaatgagctttgaagatcttgatgaattaggttctgaatcagcagtaaaggaagcggggaagctccgtcttgaaggaaaagattatgtaatgcaagatggtgatattgttgaattccggttcaacgtttaaacctctgaagctaagagaggagtagttttatagtgagtgaagaacaaccacggaatgcacaagctggtcaacgtcaaaaacaattagaaaaagaacggcggcaagcgaatgggaatgcctttagcaactatgatctaacacgaaaaaatgaagattttatgtatcaattaaataaacagttggatcgtctcggtgttccttcagataagaaagactcgatgctaaaggaaaccattgataaattgctagcaggacaaaagaaggggcaaactgcgcgggcattatttggtacgccaactgaatatgctaaagaattgaagaacccaaagccaactcctgctgaagcaagtaagcaatcaattaagttgttagcaattgataatatgctgattttcttgagtatctttacttttatgtttggcttaatgttctggttatcaccagctgcaatgcaaacaaagaatgctggaagcagtggtattactgcaatcttaatcgtggcgatcactggaggattgatttttggttatgtggctacccaagttcaaccgcaaattgataagaacggtaagcgggtaagtaagaagccattatggcaacgaatccttttgatagttgctggattagcagcttggttgattatttacatgcttgtaagtatgttgccaaatgtaatcaacccacggcttaatccatggatctacattggcgttggggttattacgttcattggggatatgtacttcaggtccaaatttcatgttacaggttccctttacggtaatcgtgcgccacgacgttaaccagcaaataattttagtaacggaactatttgccaggttatcttattaaaataaataagggtgagaaaaaggtgaaaattttttctcgcccttttattttgctcttttttgaaataaatttctgaaaatctatggacaaatgttcaacggattgttaagatatatacgtaaacttatgaaaacgcattcaaaattgagaggagatcatattattatgaagttaacgcaagcgcaattagcaaaatacatggatcacacaatgcttaaaccagaagctacccccgaaatgattgataagacagttgaagaagctcgtaaatacaatacagcttcagtttgtatcaatccttactgggttaagcgagttcatgaaggattagaaggtactgatattaacacttgtacagttatcggcttccctctcggtgcaacttcaacagaaagcaaagtttttgaaactaagcaggcaattgaagatggcgccgatgaaattgatatggttatcaatatcggtgaattaaaagcaggaaatgatgatgcggttgttgctgatatcaaagcggttgctgatgctactcacgaaaagggtaaacttcttaaagttattattgagaatgctcttcttactgacgaagaaaaagcacgtgcaagtaaacttactgtaaaaggtgatgctgactttgttaagacttcaactggtttttcaacttcaggagcgaaggtagacgacgttaagattatgcgtgaagcagttggaccagactttaagattaaggcagctggcggaattcacagccttcaagaagcttacgatatgattgaagctggtgctaaccgtttaggtgtttccgcttctgttcaaatcttagaagaagccgcaaaacaataagaataaagtttaattactaatcttaatttacagaaataggaggagtcagaaaatgtcatataaacgtgtttttgttattgtaatggactcagttggtacaggtgccgctcatgacgccgcaaagtttgatgatgttggatcagatactcttggccacgttggtgagtattacaaaggtgccttgaagttaccaaaccttggtaaattagggattagtaatttacgtgatactccgattgaaggtgttctagttgctgatccagctattggtgattacggtaagatggaagaaatttctgccggaaaagatagtatggatggtcactgggaaatgatgggtttaccagtaatgaagccattgtcaacgttccctaatggttttccacaagaaattgttgataagcttgaaaaattctcaggacgaaaggttattgttaacaagccatactcagggacagaagtaattcatgactatggtgaacgtcaaatggagaccggagaattaattctctacacgtctggtgattcagtaatgcagattgctgctcatgaagatgttattcctgttgaggaactctacaagatttgtgaatatgcccggacacttgttaatggtccagaatatactgttggtcggattattgcccgtccatatgttggtcccgataaagatcactttacccggactgctaatcgacatgactttagtttgaagccaattggtgagactgatatggatcgtcttcgtgcagcagggtacgatgtaattagtgttggtaagattaatgatatcttctctggtgaagggatcgataaaggataccataacgaaagtaacatggacggaatggatcatgttgatgaagtaatgaagcaagactttaccggtttctgctttacaaacttggttgattttgatgcaatgtacggtcaccgtcgtaatccaaagggctttggtcaagcattaatggactttgataagcgtctgggcaaagttcttgatgaaatgaagccagatgatcttttaatggtaactgctgatcacggtaatgaccctggctttaagggaactgatcatactcgtgaaaatgttccattgctggtttactctccttcaatgaacaagccaaatcaatcccttgggttgcggaagacattctcagaccttggtgcaactatcttagagaactttaacgttgaaccagtaaaaggtaccagcttctacaaggaaattagtaacgattaagattaattaaggaaaggggcgaaacacgatgcgaatggttgatatcattgacaccaaaagaaatggcggagtcctaagcgatgagcaattacaattctttgttgatggcgtcgttaatggaacgattcctgactatcaaatcagtgctctccttatggcaatctatttccaggatatgaccaaagaagaacagacgagcctaacaatgaagatgatggagtctggtgaacgattagacttgagccgaatccctggaattaaggttgataaacattcaacaggtggtgttggtgataaagtgagtttgccacttgcagcaatggtcgccgctacaggaattccggttccgatgatttcaggtcgtggtcttggtcatacaggaggcacgcttgacaagttagaagcaattccgggatttcgagtagaactttctgaagatgaattcattaatcaagttgctaaagaaaaattagcaattgtaggtgcgactggtgaggttgcgccagcagataagaaaatttatggattgcgggacgttactgatactgttgactcgattcctttaattgctagttcaattatgagtaagaagattgcttctggaacagatgcgcttgtaattgatgttaaaactggtactggtgcctttatgaagacgcttgatcaatcaagactactagccaaagcgttagttgagattggtaaacaagcaggattaaagtgtatggcagtaatctcagatatgaatcagccgcttgggaataaaattggtaatgcccttgaaattgaagaatcaattgatgtcttaaaaggaaagggaccaaaagatcttactgaattagtcttggcgcttggtagttatatggttgtaatgggtgaaaaagtacaaaatactactgaggcacgaaagatgttagagcaaactattcaggagggatcagccctggaaaggtttgcggcaatgatagaagcacaaggtggagatcctgctgttgttgataactaccaattaatgccgcaagctaaatacaagattcctttcaaggctgatcgggatggcgtattgacaaaactttcagcagatgaagttggaactgctagcatgttattaggtggaggtcgtcaaaaggcagatgacacccttgactatagtgtaggaatcgaattgcaccataaactaggtgaccatgttaaagatggcgaaccaattttaactatctatagtaaccgccaagaaattccagacgtagaacagttattaaaagaaagtattaaaattagcgatgatggcaaagtaccgacgctaattcatgaaattattgaataaaaagacaggaggatatttcaatgagtacacatattaatgcaaaaatgggtgattacgcagacactgtattacttccaggggatccgctacgtgcaaaatatattgcagaaaacttcctggaaaatgttaaacaagtaaattcagtccggaatgcctttggttatactggtgaatataagggtcaccgtatttcagtacaaggatctgggatgggaattccttcgatgtcaatttatattaatgagttagtacgcgaatttggtgttaaaaccattatccgggttggttcttgtggcggaattgctccagatgttcatgttcgcgatgttcttcttgcccaagggtcttcaactgattcagcggtaacggtaaatacatttggatcaggattccattacgcaccattagctgatttcaagttgttagatactgcctatcatgtagctggtaaattaggtattgaaacaaaagttggggatatctttgctgccgatcgtttctacaatgatgagcttgatatggaaaagcttcgtgactatggaattttaggaacagaaatggaatctgccggactttacttgttagcggctaagcttcatttccgggcactttcagttttgactgttagtgacttaatctttggtgacgaaaaagcaaccgctgaagaacgtgaacgaacattcaatgatatgattaatatttcgcttgaaacggcaattgctggaaagtaacttcttgcataagctagagagtgcattttataataaaatgtggtttagataatgaaagtgagtgggaattaaccttctcgacaaggcggtgggctaaggatagaatggtgattagcacggcacgggttgattatcgttcgaacttagcctctagccttgtggttaatttccacgatatcgtaacaatattagtataaaaaacgaggctgttgaaaaaacaaaagttttttctcagcctctttaatatggggaaaggagggaaattagatgaatgataaagataagattgaattagcgctaaaagtagcaaccttatattatcgtgatggatggaaccaaagcgatattgcaactgaactaaatatttcccgggcaacagtgtcacgattattacaatttggtcgggatcgaggattagtaaccattaaaattcataatccggttgctccgcttcaccagttggaagtagacttactcgctaaatatccatcattgcataaaattattattgttccaggcacggatgatccacttgaagaagttggcgcagcgggtgctaaatatatcgaacaagtcgtagaagataaagacattattggcttaggctggggaaaaaccgtctatcaagtaggattgcatttaaaacctaaagacgttactgatattactgttgttcaaatgaaaggcagtatggcaaatactaatacgcgaaattatgcgtttgaaacggttaatatctttgccaatgcttttaataccgttccacagtatttgccgttaccagttatctttgatcatgcaaagacacgtgaattagttgctaatgatacccacatcaaacatattttgaaattaggggagcagtctaatatcgctgttttcacagtggggacagtacgtgactcagcattgttatttaaattaggttatttcaccaagcaggagcaattaacgttgcaacatgaggcggtaggggatgttttctctcgtttcattgatagcaagggccagatagtaaatgaagatattaatcaacgaacaattgggattgcgctcccagagttgcgaaagaaaaaacacagtattttagtagcagcaaatgttgctaaggtaccagcagtgcatggtgttttaactgctggttatgcaaatacattggttattgatcaggagagtgcgaatagcctagttaattttttaaattaatttaaatatttagattgacctcagtgcgaaatcctagtagagtatacctaattaaaaatcaaaggagttgcactacagatgtcaaattgggacacgaaatttgccaagaagggcttaaccttcgatgatgtattacttattccagctgaaagtcatgtattaccaaatgaagttgacttgagtacacagttagctgataatttgaagcttcatattccgttgattagtgccggaatggatactgttactgaaggaccaatggcgattgcaatggccttacaaggtggcttaggggttgttcacaaaaacatgtcaatccaagcccaagcaggagaagtagctaatgtaaagagcgtagtcgtacctgcaggagcaactaaggctgcagttgatgagaataatcgtttattagttgctgcagcagttggggttactagtgatacttttgaacgtgctgaagcccttttgaaggcgggtgcagatgctatcgttattgatacagctcatggacattcagcaggtgttcttcgtaagatcgcagaaattcgcgaacacttcccagacgcaactttaattgccggtaatgttgctactggtgaagctactcgcgctttgtttgatgctggtgttgatgttgtaaaagttggtatcggtcctggttcaatttgtactactcgggtggtcgctggagttggtgttccgcaaattactgctatttatgacgctgctagtgttgctcgtgaatataacaagccaattattgctgatggaggtattaagtactctggtgacgttgtaaaagctcttgctgctggtggtaatgcagtaatgcttggtagtatgctttctggtactacggaagcacctggcgaagtttttgaagacaatggcaagaagtacaaggcttatcgtggaatgggttctgttggtgcaatggctcaagcacatggttcctccgaccgttacttccaaggtggggtaaatgaagctaataagcttgttccggaaggtattgaagctcgggtagaatacaagggcgatgtttctgatattgttttccaaattgatggtggccttcgttcaggaatgggttatgttggtgctggtgatattccaacattgatcgaaaaagcccaatttgtccaaattactaatgcaggacttattgagtcacatcctcatgatgtccaaattactcgtagtgcacctaactataaataattaatttaataaggaactgctatggctttattcatgaagatatagtcacagcagtttttatttcccgagaaataatggagggtaaactttttgttaaggctatcctagaatgatcgcttttttcgcatagttagttataatattcaataggatattatgctgcaaaaaggagtacctcttatgaaaattctagttgttgatgatgataaagaaattgttcaattacttgaaatttacatccgaaatgaaggatatgagccaatttctgcttacgacggaaaagaagcgttgacaaagctaaatactaatcctgatatcggtctgattattcttgacttaatgatgccagaaatcgatggaatggatgtaattaagcgggtgcggaaagattctgatattccaattttagtgctttcagctaagacggcagatatggataagatacaaggtttaatcactggtgcggacgattatgttactaagccatttaatccgcttgaagtaatggcacgagttaaatcattacttcgtcggagccaaggagaagtgacaaatgatcaaccagatattcttaatgttggtccattattaatcaataaagattctcacgaggttaagacgattaaaggggatgtaattcaattaacagcccttgaatttggtatcttatacttactcgccagtcaccctaatcgtgttttctcagcagatgacatttttgagcgggtatggcaacaagaaagtgtcgtatcagccaaaacagtcatggttcacgtgagtcatttgcgggataaaattgaagaagcaactaacggtgaaaaggttattcaaactgtttggggtgttggttataaggtggaagaccactaaagcctagccttaaggatgtggaggaaaaattgtgaagttaacggggcgtgaaaagagttcgcttattttagaaggggtagtaacggttatcttattgttattgctgaatatggcgattatcgtaattattcaagatgccattcagtcaaatccgggagtaaccaatggaatctttatgattaagcaatcattgaagattggtcctcttcaagcacaaatatggagctatcagcggatcttaattgcctttttagtaattattgatgtgtgggtggtatggtggcgattgcgtcgccggtaccacctttatcagatggatcatattatcgcggaattacactatattgcgcagggacatttggatcatcggattccgtttcggctaaaagggaatcaacagcatgttattactagtgtaaatgcattagttgatagtgcggtgcgttcaatggatgatgaacggaagattgaaaagtcaaaagatgaactgattactaatgtgagccatgatttacggacgccattgactagtattattggctacttgggattgattgaagataagcagtatcgtagtgaggaagatattctaaaatacacccatactgcttatgagaaagctaagcaaatgaagaccttggtggatgatttgtttgaatatacaaaagttcagcaacatggggcaccggtaaatattatgaaaatcgatcttaaccagttaattgaacagttaacggcaagttttgaattagaagcccagcaccgcggaatcgaaattacttcctcagttatccctaatcctttaatgattgaggcggatccggagaagcttggtcgagtttttaataatttagtttcaaatgcctttaaatatggcaatggtgcaagttacattcggatcgatgcccggcaagaaaatgatatggtggtcgtcaaagttgctaatgatggtacaccaattcctgaaaaagcacttgaccacctatttgagcgtttctaccgcgcagaagcttcccgttcacgagctactggtggaacgggattaggtttagcgattgtcaaaagcattgttgatcttcatcatgggagcgtcaaggttacttcaaatgaagacgaaacagcatttattgttacattacctttaaaacaagaagttaaagaaaccaaccaaaaatgagaaaaaagtctaaaatcaaatgattttagacttttttctttttcaattatattcaactaattttatatgtggtagactaaaagagcattgtgtcacttgatattataaaagatacaaattattggaggaaattctgtggctaaagcacaaataaatccagaaaggacacgctggcttgaggtgcttggtgtctcaatgccattatgtcttagttatattccgattggattggcctgtggaatcttactacacgcagcaggtttaaactttataatgattttattggtgtcggtattagtgttctctggtggggcacaatttattctggcatcgttattagcaagtaacgctccattagggactatctttatctcacttttcttcttagagttacgatatgcattgttaggatcgagtttatctaaatatattaaggataaatcagcacgtttcatcctcatcttttctgcatcaatgaacgatgaaaattatgctgttaactatatgaagtttgcaactgataagaaatgggatcccgatgacgcgttgttagtggagtattattcacttgcagcatggtcgacttcaaacatggttggtggtttgatcggtggtgcaatttcgattgaccttgaagtggttgattttgcattaacggccttatttttatatatgatcgtaatgcaggttcaaaaccacttgaccctagttattggcatcttggcagctgttcttggtgcatacttccaggcattgactaaaagtacacttgggattattattgcaaccttaattgcttcctttgttggattcttgattgaaaatacagttcgtcaccatagtaagcatccaaactcgaactggttcttgacaaaaatgtttaggccgaagatcacaaagactacgatcgaggataaacaagctcaacaaaaagaagttaaggaagttgaaaaactggaaactaagattgaagatgttgttgaacaccatgatgagaaacatgaagagaaaaaacatgatgatcaacatcctgatgagggctagacatggaacaactattaagtaataaaatcgtttaccatattatagtgattatcttggcagctttagcggcatttattccccgttatctaccagtattattcttctcaacgcgaaaaatcccagaatggtttaatgaatggatgaaatatgtcccagttagtttatttgcgaccctggttgtaaaagggatcttcttaactggttcttatcattttactctattcggttatccagaacggattattgcagcattgatcgtgattgtgattgcgtactttactcgatcaatgtcgatttcagtaattgctggattggttgctgtttggcttctgagtttagcgttataagagtagttttgttataattataaacagtggattggtttctagcttgcgaagaagccaatcccttttattttaggaagtgagtacgttggattttaagcaaacaattgcatttgttaatcttgctaatactttggattatcaatatgcagcaaaaaaatcagggataacggttgatgaattggttcacacaattaaggcgcttgaagaagagcttaacatcaagcttattagacctgaaggcggcgtagttgaattaactgaaatcggggcgttttaccgttgatcactgagattgctcaaaaacatgctaaattattatcggtagttacggattatcgaaaaaaggaagcggaagaagcgatcaaagttactgtcgtcccaggctttgccaattatcaagcagccccggttgttaaaaaattagcccagcaacataaaatgaatcttgttgaagatgttgatccaatggcacagctacaacaaggggaaagcgagctggcatttattagttatgccggcaaacttcccgatgattttgaggtgctttcagtgggaactgatgacttagtagcttatatcccagcgcggaacccactttctaaacaaaaggaattaacgcttactgatctaaaagcagaaaaatttttaacactaaaccatcaaaatccatttgcagtctttgttcaacaggtttgtgctgcggctgggtttgaactatattctgtttttgaaggagaaaaaggaagaacattagtaaatatggttgctttagggatggggataaccttgttgatggaacaatcaataagtgaaaacttagatagtaaagtggttaaagtgccgattgttcccaaagttactcaaaaccttgcatttgttcgtcgtaaaaatgtagaatacacggcagagcaagaagagttatggcaagctctaaaagaatcctttgaaaaatagaaaaaaggtttgacaatttcgcaaactacgcttattatcataaataacaaaaatacctttaacttagtcccgtgaggctaggaaggatttaattgagcgtttaagtacaccttcttagctattgctgagaaggtttttcttttaagcagtagcaccaagaatacgccagtaaaatcaataggtattttgaaacaaccgaccatttaattgtttccagagagagcagaacggtatgttgtttttagcctacttatatcctaaaagcaaacagtgatgcctctcgaaatttaaatgggaagttatcactgttttgttgtaattagactggaaaaggagcgctattgatgattagtacagaaagaattcaaccaaatttagtaacagttgccgacatggatgcagcagatgcaattgatttaattcatgaagcccaagcatataaagctggaaagcaagcggttctcactgcaccggcatacgcggttaacctcttctttgaaaactcaacccgaacaaagactagtttccaaatggcacaaatgaagttggggatgaatgtactagaattcgaagcgggcacgagttcagtgaaaaaaggggaaagcctctatgacactgttaagacaatggaatcaatcggtgtaaatgttgcggtaatccgtcatcctgaaaatgaatattacaaccaattgattaatcattcagaccttaagatcggaattgtaaatggtggtgatggtagcggccaacatccatcgcaatgtttacttgatatgatgacaattaatgaagaatttggcgatttcaaggggttaaaagtactaattattggtgaccttagtcactctcgagtagcgcactcaaatgcaatgatgcttaatcgtctaggagcagaggtttattttgctggcccagaaaaatggtatgatcctacgctggaacaatatggaacttttggtgactttgacgaattgcttcctcaaatggatgtagttaatttactacgagttcaaaatgaacggctaacgactgctgacggtcaagcttttgacgctaatcaatatcaccaagcttatggtttaactttagagcgagccgcaaagatgaaacagggggcaatcattatgcatccggcacctgttaaccggggtgttgaaatcgatagctctcttgtagaagcgcctaattcccgcattttccaacaaatgacaaacggcgtatatacccggatggcaattcttagtcgagttcttcgttaccaaggattgatgtaaaaaggtgattacgatgagtaaggcagttttactaacgaatggccgacgagtttataatgatgaattggttaagactgaagttttgattgtagatagcaagattaaggcaattggcgagcatatccaggcaccaagtgatgcagaaaaagtcgacctggataatggcttgattacaccaggactaattgatgttcatgtccatcttcgcgaaccaggctataccaataaagaaacgattgctacaggaagtaaagccgctgcacatggtggctttacgacaattgctgcaatggccaaccttaatccgacatgtgacacaccagaaaaatttaaagaacaggttgatcggaacgagaaagctggactggtaaaaatcctccaatattcaccagttacagttggtcgggctggaaaacaagcagttaatgttgctgagcagtatgctgcaggtgcccgtctttttagcgatgatggtgcgggaattcaagatgctggagttgtataccaagcaatgcaacaactagcgaaagttaacgctccgttatgtgatcatgcgcaagataatcaacttgcacaaaatggggtaattaatgatggggcaactattgctaaaaaactagcactaccaggaatgccagcgattagtgaaacagcgcaaattgctcggaatttggtgattgctcaggcaactggggtccattatcatgtttgccatgtttcaactaaagaaagtattgacctgattcgtcatgccaaacaacaaggaattaacgttacatgtgaagtgactccccatcatttacttttagccgatgctgatattaaagaggatgatgctgaatttaagatgaatccacctcttcggcagcgtcttgaccaacaggcttgcttaattgggctattggatggcacgattgattgtattgctactgatcatgcgccacataccgatgcggagaagcagcaaggatttcttaaatcaccaaatggtattgttggctcagaaacagcttttgccttactctatacacactttgttaaaacgggtatctttacgcttgcccaattgattgactggatggccgttaagccgcaagcgatttttaaccttgataacgctggattattaaaggtaggggacccagcagatattgctgtatttgatatcgatcatcaagatgtaattcaaccagaccagtttttctctaagggtcacaatactccatttgttggtaaacaagtatacggaatgactaagcgaacttatgtcgatggaaaactcgtatatctggagggagaaggataatgcaagaaacacaacgattagcagttgaattgccgggattatcactaaaaaatccgattattgcggcaagtgggacttgtggatatgggcaagaagcagctaaaaagtataatcttaatcatttaggctcccttgtgttaaagtccactaccctccatccccgccaaggtaatccacgtccgcgagtttgtgaaaccagtgccggttggcttaatgctaatggtcttcagaatgtgggcattaccgcagcaactaatgaaaaaattccgtggttacgaaaaaattatccgcaactaccgattattgcaagtgctgctggtttttctgaagacgaatacgttaaagttgttagtgaatttgctaatacggctggggtgaaagcaattgaattaaacgtatcatgtccgaatgtaaaacacggcgggatggcaatgggaactgatccagaagtgcttcaacgattagtaaaacaagtagttaaagttgccctaggaattcccatctatgtaaagctaacaccaaatgtaactaatattgttcccctcgcgcaagcagctgagcaagggggcgctaatggcctgacgatgattaatacgttaacgggattaagcatcgacttaaaaactcggcgcccggctttagctaatgtaacgggcggtttatcaggtcctgccattaaacctttagcattaagaatgattcaccaggtccgccaggtttcttctttaccgatcatcggcgtgggtggaattgaatcagctgaagatgttcttgaatttatgatggcgggtgctaatgctgttcaaatcggggcagctagttttcatgatccattggtttgcccgaaaattgcagctgatttaccaatcgtaatggatagatacgggattaagaaacttacggatttatgggaggtaagattttgaaacgcttcgtaccgatggtggctatcgatgttgcaactaagcaggaagcaattgacctatttgataaattaatggtaaaaccgcagccgatcgtaaaaattggaatggaattatattatggcctgggacaagtaattgttaaagaggcgaaaaagcggggatttaaggtattccttgatttgaaattatacgatattccgaatactgttcatcgcgcaatggcagctattggccgattgggaattgattttacgacaattcacgcagctggaggtagtgaaatgctgattgccggattagccggtctagaagaaggagctaaggaagcaggcgttgaaccagcaaagttattagcaattacccaacttacttcgattgatgaaaaaattctccatgaacaacagcatgttgatttgtcgttgattgagtcagtccaaagttacgcgcgcttagcagaaaaagtaggattggccggcgtagtatgctcagcccatgaaatcaaggcaattcgtgaagtgacgggggatgatttcctatgtgtaacgccaggaatccgcccaactcatgcaataaaagatgatcaaaagcgagtggttacaccagcacaagcaagaatagatgggagcaatgcgatcgtagtgggacgaccaatcacccagagctttgacccagttgctgcttatcaagaagtccaaaaagcattcttaaatgaggaggaagaaaaatgacatattcacaacgcgttgcaaaagcattattagatattcatgctgttacccttagcccagaccaaccatttacctgggcaagcggtctaaaatctccaatctataccgataatcgattgacgatttcttatccagaagttcggcaagcaatttttaatgggatggttgaacaaattaaacttcattttagtgaggccgatgttattgccggaacagcaactgctggaattcctcatgcggcatgggttgcccagaatatggaattaccgatgatttatgttcggactaagccgaaagatcatggtcaaggcaagcaaattgaaggggtgcttaaagaaggacaaaaagtcgtcgtgattgatgaccttatttcaactggtggtagtgtattaaacgctgtgcgggcggttaacaatgcaggcggaaaagtaattggcgttgtttctgtctttacttatgatttgccagctgctgaacaaaactttatggcaaatggactaaaatactattcagtaacggattatatgactttgattaaggtcgcaaaggaaaatgaccaaattagtgcggaccacctcaagtctcttcaagaatggcggaaagacccgttaagctggagtaaagagcaagcatcataataattaattatcaaaaaagcctaagattgattcagaaaaaagttaatctgaattaatcttaggctttatcttattgtttatcttcccaaatcttttggagcattgggtagcgtaagtcaccaacttgtactacttgataatctgcatttgctaatgttgtagcatcaccaacgccaattgcaattgcatttatatggtgaatattttcaatatcatgagctgtcgttccaactccaatgcaattagctccgataagatttaattgattaacagcagttagatatgggctttctttatcattagtcctaacgatactatcgacataattatcaaggccaatttgtttaaggacattttgtacatctccattagcatctaacacggcaattttaacgtaatgatcatagagatttagtaaaagacgcttaatccctggaagttgatccttttcacttaggctatccgcttcttcgttaaggaatttttgccattctgcaatcattgaagccttttcgcttggggcaggattagcattaaaatgtgctaagactagggagagcccttgcgaaggagtaaggttatcgaattgggaagctaattttccaggtaatcccatcccaaattcatacattacaaaacgttgccatgcagtaaaggataacttatttgtattaacaaagatattattaaacgaaaaaatcgcaccatccatgattaaacatcccttcatagataattatgtctatattttaacgtaatcgaaaatgaaagggaatacattaattaagcatttactttagcgaggttagcggcataatcgattccctttacatctaaatactcaataatttgattgattgtaataaatggtacatgaactcggttagcaaggactgacagactatcacgacgagccatcgtgccgtcacgctttaacacttcgataataacagcaactggtgcctttcctgctaaataggcaagatcaatagctgcttcggtgtgaccgattcgatctcttaatccatgaggttgggcgtaaagaggttgaatgtggccgggatgattaaagtcagatgcttgggcagttggcttggcaatttgccgaatcgttgctgcgcggtcaaaagcggaaacaccagtagtaacaccggttgcttctaaggtaccatcagtagtaaccataaatggtgtttggtgtgggtcagtgctatgctctaccatgggcttaaacgctaaatgcttagcaatatcttcgcttactggcacacacatcaaaccatttgcctcgttcaacatttcatagatagtatcagcgttgacattttcacctaaagctactaaatcaccttcgttttcacgatcttcattatcggctaagataatataaccaccatttactaattggtttaatgcttcttcaacagttgaaaattgactttgcataatttatatactcctttgaaattctgaaagtgatagaacagttacattcgaatgtgttattataataacgaacgttttaatttaaatcaacctatttttaaactaaaacacgaataatattaaaagatttcaaagggtaagtttgctaaagagctggagaaaataaagatttctcaccagctctacgctctatctttagagtaacaaaaaagtccagaacgagatatttttcgtcctgaactaatcttaggttgttctattttgtcatgtaatcacgagtcattggtaagtttttacctgaaggacccttagttatcaagtattgaataacatcaatatttccagattcaaatgatgcagcacatgtttgaagatataaatcccacatccgtgtaaaacgttcacccatcatatcaaggatttgagcacgatgttcattaaagttcatgtcccaaatttcgagggtgcgttgatagtgacggcgaagcatttcgatatcagcgatttgcatatgattttcttcaatgtgaccgatcatttcttcgagaccaggtacataaccgccagggaagatatacttgttaatccacccattatatgcaccgccttgttgacgagtgataccatgaatcaaggcaacaccatcatcagcaaggcaaccttggatatctttaaagtaaaaacctagattttcttttccaacgtgttcaaacataccaacggatgtaatataatcccacttttggtcaccaagttcacggtaatcaacaagtttaacttcggcaacgtcttgcaaaccttctttttcaatccgttccttaacaaagcgatattgttcttcgcttaaagtaaccccagtaacttttaagccatattcttttgcagcagttaacattaatgttccccaaccacatccaatatcaagcaatgttttgccaggctttggatcaagcttctttaagatgtgatgaaccttatcaacttgtgcttttgtaagctcatcatggttgccatcagtaaaataagcacatgagtaagttagcgtatcatcaagccataacttgtagaagtcgttcccaacatcataatgactttggacatcattttcgctctctttttctgagtggccttgtttaggcaaaaatttgcggaacttagaactccgcataaaactatcggcactttcatatgctgattcgatcaatttttgaatgctaccctggatctcgattttcttatccatgtaggcttccccaagtgcaattgaggcgttcttggtaatatcacgcattggaattttctcattaaaggtgatagttacctcaggagttccgtcaccatagataacacttgatccatcccaaaatacgatctttacgggaatgttaaatgagtgctttagtagtgacttgtagaacgtcttttctaacatgaaacgcatccttctttctgcaataataatattcattataacacccttaaaataaaagtgtttcaagacaattaatgaaaacatttcataagaaagcgataaactaattgctgaaaaaatgaaagcttgctactatgctaattagtaggaaaaatagggagatgattgaatgacgaatgcctggaagcattttattgagaatgtaaaactacggcgtttcactgtcttattattaatcattgtcgtactctggctaatgaaatcaatgatgaatttaattttatttacatttattcttacttatcttgttgttagttgggtaagactcgtccagcgatggttaccacgaatgtcgacaagtttaattgtaatcgttacctatgtattgttaattgttctcttatacttaggggtgacccgctatttaccggttttatctcggcaagttgttaaaatggtcaattcagtagttcatttctatagtactcatcaagcgacgatgatatatcgttatgtcagccattacataagtaccgccactattatgagtcaggttcggcatgggataacaatcgcggttagtactttgacaagtattggtgcaattaccgtttcatttgtaatgtctttaatcttgagctttttctatacgcttgaattaaaacaaatgaatgaattttctcatagctttttagatagtgattttggctggtttttccaggatattgattattttggtaaaaaatttgtcaatacttttggggtagtattagaggcccaattttttattgctatttgcaatacagtgattaccacgattggcctattatttatgcggatgccgcagatttttgccctatcgttaattgtgtttatctttagtttggttccggttgctggagtaattatttcaacaatcccattggcgatggttggttactcagtcggtggaattcgcgatgtggtttacattatcatcatgattatcatcatccatactttggaggcctacgtcttaaatcctaagtttatgtctagccggacagatctaccaatcttttatacttttatcgtattactgattggtgaacatctttttggtacatggggattgattgtgggggtaccaatctttaccttcttacttgatgtattaggcgtaaagcccattcgcggtgcaaaaagaataaaaaaagaagtgtgagtgagaattagccttgtgacgacgcgaagctatttccataatgtcttgctactattcatggaaacagttaaggctgggagaaaaagttttctcctagttttttgttatccgaacaatttatgttaattcattggataaagttaattaaaatcgaacttattttgcaaaattgctgaaaaagtcttgagttagtgtataataaaattaagataggtctaaagaaaggaagctgatattcatgacagacatcgagattgcagaccaagcgacactggaaccaattacagaaattgccgagaaactcggactttcagaagacgaaatcgaacaatatggtaagtataaagccaaaattgatttaaatgtaaagcctttacctgataaaaaacataagctaattttagttacgtccatcaaccctactcctgctggtgaagggaagtcgactgtcctcattggcttaggggatgcattaaatcagttaaattatcagacaacgattgcaatgcgtgaaccatcgatggggcctgtttttggaatcaaaggtggtgcaactggtggtggatatagtcaggttgttccaatggaagatattaacctgaactttaccggtgacttgcatgctcttacaagtgctaataatactttggccgctttaattgataactatattatgcgtgataatgcaatgaaccttgatccgcggcgaattatctggaaacgggtagaagacgttaatgatcgtgctctccgaaatgtagttaccggtcttggcggtccaatggctggtgttccacgtgaaacaggctttgacatcacagctgcttccgagttgatggcaattttatgtctatcaactagtcttcatgacttgaaagaacggattagtcgaattgtagtaggatatacatacgataaagaaccggtcacagttggccagcttaattttcaggatgcaattacaattatcttgaaagatgcattaaagcctaaccttgtccaaactttagaccatacgccaacaatcgtacatgggggaccatttgccaacattgcccatgggtgtaatagcgttttggcgacgcaaactgcccttaacctttctgactatactgtgacggaagctggctttggggctgaccttggtggggaaaaattccttgatattaaacaacgtgttcttggtaagcatccagatgcaattgtcatcgtagcgactgttcgagcgctagaatacaatggcggtgccaaacttgcagacttaaatgatgaaaatcttgatgcgctgaaaaaaggaatggcaaaccttaatcgtcacattaagaatatgcaattatatgggttaccaatcgtagttgcaatcaaccattttgtcagtgataccgataaagaaattcaaatgattaaggatgactgtgctaagcaaaatgttgaagcaattttgactgatgcttgggctaagggcggtaaaggtacccatgatttggctaataaagtagtcgaacttgctgatagtccaagtgaatttactcatatctatgacgttcaagttgatgaccttcaaactaagttagagaagattgctaagcagatttatggtgctaaagaagtatcatttagccgtaaagcacaaaatcaattgaagcgatttgctaagtatggatggaatgacttgccagtatgtattgctaagacccagtactcatttacagatgaccaaaaacaactcggtgccccaactgactttactttccatattcgggaattggtaccaaagatcggtgccggctttgtcgtggcattagctggtaatatgatgacaatgccaggcctccctaaagaaccagcggctgtaaacatgacgattgacgataatggtaaaattaccggattattctaaataaccaacacaaaacatcgattgtgcaataacgtacatcgatgtttttttcacaaacttttcaaggctagcgggttgaagttattgatatactgctatgtgaacttaatcgttttcttgtgaaattataaaataaggactacagtagaggtatatcgttttataagtttaattaggtagaggtgaatgactaatggaagagaaactacatggcgcagatattgttattgatagtttgagaaaacacggggttaatctcgtctttggtattcccggagcgaagattgatcgtttgtttgaaggactagatggtcaagacagtgaagatgcacctaaattaattgttacccggcatgagcaaaatgcggcgtttatggcccaagcttatggtcgcttaaccggaaaaacaggggtcgcgatcactacatctggcccaggagttggtaatttagcaactgggatcatgacagccaacgcagaaggagatccaatgttagcgattgggggacaagtacaacggaaagaccttcaccgctcaacccaccaaagcacgccttcaactgaaattatggcaccgattacgcaatatagcgctgaaattcaagaccctaataatatttcagaaattatggccaatgcatttgaagcgagtcaggatgcacgtaagggagcagctttcgttagtcttccacaagacgttgatgatgctgaggtaactgaaaagccattgccaatttatgaaacacctaagacgggtcctgctgatccaaatgacttacaaaaactagtcgaactaattaaaaatagtaaaatgccggttatcttagtcggtcaacggggcgcggatgaagaaattacgactgctatccgcaaattattaagtgattattcattgcctgttgttgaaacatatcaagcggctggagtagtatcacgtgacttagaacaacagtcatactttggacggattggccttttccgtaatcaagtaggagatcagcttcttcaacaaagcgaccttgttattgctgttggttatgatccgattgaatatgaaccacggaactggaacaaggaggggaatctgcgaattgtaaaccttgataccttgccagcgcaaattgataaccactatacgccaatcatgcaactagttggtaatattgctataagcttaacggagcttgataagttactaaaagggtatgaatatcctgttgcagccactgagcaactcgctaagtataagcaagaacttgaccaagataaaaagattcaagtaccaacaagcaatgatgccagccatccgttagcagttgtgcatgcaattcaagaaaatgttactgatgatatgcacgttgcgctcgatgtgggttcccactatatctggatggcacgacatttccgctgctaccagccacgacacttgttaatcagtaacgggatgcaaacactaggcgttggcttgccatgggcgatggttgcagcgatgctttatcccgaatataaatcagtggcagtttgcggggatggaggcttcctcttctctggggcggaattagcgacagccgttcaacaccatcttaatgttgtaacgattgtatggaatgatggcggtcattacgacatggttaagttccaggaagagatgaagtattcgcaagcagctggtgttaaatttggaaatgttgatatcgttaagtatgctgagagttttggtgcaactggactgcgagtaaataagccggctgaccttactaaggtactcagtcaagcgtttaatattgacggcccagttgtggtagatgtgccagttgattacagtaataataaagaattagctgccaacttgattgattcacaacttggctaagaggagaacaaagattatgacaacattatatgaacacggaacgttagctgcgttgatggcaggaaattttgatggcacaattactgtcggtaatttgctaaaacatggttcgatgggaatcggtacttttactggcttagacggtgaggttgttatcctgaataatgaagtgtaccaggccgtttcaagtggtcaagttaaccacattacagatatggatgctacaatgccatttgcttcagtccattttcctgctgaacaacaggatataacattaaggaatataaactttgctaaactgaataatgattttgttaaagaacatcagcttactaatgtttttgcattcttacaattgagtggtgagtttaagcacgtcaaaattcggattgctccgaagcaagaaaagccatacccgactttactcgatgttgcgcaacaccagcctgaatttgcggctgataatatcgcagggacaatcatcggctactatgcgccagaaatctttggaacaataacggcagcgggatggcaccttcactttatcagtgatgatcgacaatttgctggtcaccttctggcgtttgatgccccagaattaacaggtagctttgaaatttttgataacctggaacaacatctgccgattcataatcaagaatttcgggagagtacagttgatatggcaactttacgtgatggaattgctaaatcagaaggaaatgcagactaaagaacaaatgaagcagcggtataaataacgccgaaaaagggctccagtgctcggtaacgaactctggaaccctttttgtgatttctaaaatatcattttaagttgtcgtttttaatgagttgattaattagtagtcgcttggaaaaataatatttgcagatttacggagacggtatagagtcatattaacaattttagctagttcaatccatcgttgataattatcctgctgctgtggcgattcggggttagtaaagagttgtgcaaaatcgtttaactcgtcaaacatggtgttatctaagtagtggttattgataacttgaatactcccctgattattaagataagtcactttcttagtatcgaaaatactgtcaattattagcgtgtcgcgaagcctatatttattgccaaatgcttctgcggtgctaagcttacgggaatacacaacagtaagttaatatttccaagtatcttgtgctgcatgaatcatctagtcaaaaatagtatgggttccaataattcctaatcgtaacataagctagatttcctggttagccattttgtagatttataccatgtcatcataataaagaactttctgatcccttgtgcccaccggtagcattaggacatgattgtgacatttccatttctgcttggcaggtatttcaatagtgctttttacactaaatacctaaaccctgttttaaaaaatcgttcagttgaagttttggtgattcaagaatctaacccgaccggcaaaaattcattaccttactccaccagctaacagatgtggcggaccagcctgataagtaattttaaatccgcaatctcctttcacaagcttggttgacactaattgctgaaattaagtttcaagaacaacaccagcaattgacggttatcccacgtgaacgcagcaaaaatattttagcgtatttgcacaaacactatgcggaaaaggtaacaattaatgatagtgcaactgcggtcaatattagtcccaaagaatgtattcggtcatttaagaaaaacattcaccaaacgccaattgaatacttattaaattaccgggttgagcaggcaaagaaaatattgcggcattcggagctttcgatcacggatattgctttgcgggcgggatttagtacgagtgcctattttagtaaaatatttaaggaacgggtaggaatgacactacgggaataccggcagcgtcaagggtagcttactttaagtttaaaattttacttatcaatgtttccatgtctgctgggttaatgactttttcttggcgcggcgtttggtctactaacgcttggacaccatcgctaagctgatctcccagaagatcatgtaactgttgaagagcaggaagcccgatttgactaactttttggttggttagtgcgtggtagacggtttcagggaatttatatggactggcagttgacacgataactgtgggagttgtgtcatggctttgttgctgatattgatgtgttacatgtgatgccactgcagtatgcgggtcaataacatatccatcatttaaatatactcgtttaatttcggcttcaacttcatctggggtcgcaaaaccagccacaaattgctcctgaagcttatttaatacggtggaatctacctggtagtgaccgtcagtagctaattgcttcattaatttagcaactgttacgcagctttcatcataaagatcaaagaggagccgctcaagattacttgatactaaaatatccattgctggtgagttagttaggtaaaagttgcgtcgccgctcatattttccgctcttgaaaaagtcggtcaatacattgtttttattagaagcacacaagagcttgttaattggtaagcctaattttttagcgtagtaaccagcgaggatatcgccaaaattaccagtcggcacggtgaaattaactttctcccctagttggatcccgcctgtatgaacaagctgtccgtatgcagcaaaatagtacacaatttgggggataagccgcccgatattcattgaattagctgaggaaaagcagttattattttgcgcaaggcggtcattaaatgcttgatcgttgaaaatatgtttaacgcttgtttgggcatcatcaaaattacccttaattgcgattacgtggaggtttgatccaggctgccccagcatttggcgtaattgaaccggactaaccccgccagcagggtagaagacgattacctgtgtgtctttttgattgctaaaccctcgcattgcggctgttccagtatcaccagaagttgcggtgaggataacgatttgtttttctagttgggtgttttgtgcagcacgtgacactaattggggtaacatttgtaaggcgatatccttaaatgccagtgtcggcccgtgaaaaagttcaagataataattgctggcgtgtttgggcgttaatggggcaattaaacggttatcccactgactaccataagcggtatttgcatttttcagtagttggtcgctcgtaaattcatcaaaaaaccagttaagaatagttgcagcaagttgttggtacggcaacgaaattaaggttgcaaggttataagttggttgaggaaaatgaagcggtacataaagaccgccgtctggagaaagtccttgtaagatagcagttggtgattttaaaatcgttgataagtctccctgagtgctacggtagtccatgataattcctccaatttcaaaggtgattttattttaattgtatgtttcttatatgctatggtacaatgctgaaaatgaaaaaacaatgagaaactgaggcgggaaaatgaaaaacattaaactgggactgctcggtctgggtacggtcgggtcaggagtcttacagatggttcaacaaaatgcagataaaattctcgatgttactgggtgcaagttaacagttaaaacagctttagttcgaaaccttggtaactataataagtatgctgatgaaacttctttaacaactgattttgatgaaatcttgaatgatgatgaaataaaaattgtcgttgaacttatgggtggtattcatccggctaaagaatatattacaaccttattaaaaagtcataagaacgtggtcacagcgaacaaggatttgattgcgtcttatggcccagaattgatgactgtcgcgcatgaaaatcactgtgacttaatgtttgaagcgagtgtggctggtgggattcctattttgcggacgattgctaatagctttacggcagataaggttactgaagtaaagggaattgtaaatggaacaacgaattacatcttaacgcaaatgagccagcggggatggtcataccaccaagcacttgcccaagcacaacagctgggatttgcagagagtgatccaaccaatgacgtgacgggtaaggatgcggcttacaagatgattatattaagtcaatttgcatttggaactcaactagatattaaggacattgcggtagaagggattgaccgattgaatgacgctgatgttcaacaagcagcgtcatttggatacgtaattaaattactagggattaccaagctggttaataatggagtatttgtcgaagttggcccagtgttaatcccccgtgatcatcctttagcaacaatcaataatgaatttaatgcagtaatggttacagcccaagcagtcggtgatacgctcttctatggccgcggtgcagggggcttgccaactgctaacagtgtgttaagtgatattacaacggtaacgaaaaacattatcctgggaactaatgggaatctctttaataattaccaacaaccttatattccggcaaaacttgctgatataaaatatccatattatttatcgttaaccttgccggatgttcctgggcaaatgttgaagctaacccagatgatgacggatattaatgctagttttcgtgaaataacccaaacaaaagatggcaaaattgcgcacattgcaatcattactcaccggatgagcaaagaacaattacagacattactaactaaagtagctaatgatcagtcaattaacttgtcggcggcttataaagtgatgggataggaggaagtataatgattattcaagcacctgcttccagtgctaatcttggcccgggatttgactcgattgggattgcagtctctttgtatttaaaattagaagtccttggtccaagcgataactggcaagttgatcaccagcttgggaagctccctcatgatgagacgaatatgattgtaacaacggcattaagtgttgcaccggatttgctgccacagcacctgcaggtagtcagtgaaattccgatagcacatggattaggaagtagttcaagcgcaattgttgctggaatcgaattagcaaatcagcttaagaacctgaaccttagcaaggaagaaaaagttgagattgccagccagattgaaggccatcctgataatgtcgcaccgactattctagggggattagtagtggggacacatattaatgggcatttttctgcgattgaagcgcccttattcccctatgcttttgctgcatatatcccgccttataatctaaaaacagctgatgcgcgagctgccttgccatatcaactagaatattcccaagctgttcatgcgagcgcggttgctaatacctttgttgctagtttgtttgctaaaaactatgatgtagcgtttaaattaatggaggcagatcgctttcatgaaccatatcgcaaagagctagttccagaattagatcaaattcgtgaattaggaaaaaaacatggagcactagcaacatatttaagcggcgccggaccaacagtaatgacagttatcgataatgacaattacggattatttgaacaggcagtgcatgctgcggggctaaagggaaaagtagtccgtttacacccagatgttgaaggagttaaactaatataatttaggaaagaggctggaaatggattcggccttttttcttttttatgaattttaacgaactattttatgttttaactttattaagttcgatttttacattgaattataaaaaaatctttgctatccttaaagcagatttgaggaggcattgttatgagtgatattagtgtagtaatgggcagtaaatcagactggccaactgttaaagaaacttgtgatattttagatgaatttggcgtttcatatgaaaagaacgtgatttctgctcatcggatgccaaatgaaatgttcgcgtttgcgcaaaatgcggttgataatggggtcaaagtaataattgcatgtgccgggggagcagcccatcttcccggaatgattgcggcaaatacccccctgccagtaattgggatcccaggacagacaaaagctcttggtggcatggactcgcttttatcaattgttcaaatgccagcgggaattccggtggcaaccactgcgattggaaaagcaggcgctaaaaatgcagcgttattagcattgcaaattcttgggatcacagataagcatatccaacaacaaattatcgaatatcgacaggcgatgcatgatcaagcaaaagaaagtgggcagtatcttgaataaatttattccacaaggctcaactattggcattattggtggtggccaattgggacagatgatggcattggatgccaaacagacggggatgaaggttattattttagatccgacaccaaattgtccagcggggcaggttgctgatgaacaaattgttgctccttatgccgatactaaagcgattgaaaagttagctgataaagcggatgtattaacctacgaatttgaaaatgttgatttaaacgctttggaagatgtacaggatcgcgtttatcttccccagggaactaatttgctttacacgaccaaaaatcgtttacgggaaaagaatttcttacgtcaggcaggggtaaaaacagcacctttcatggaagtgcatacttctgctgaattaaaagatgcagtaaagaaaatcggttacccagcagttttgaaaactagtgaagggggatatgacggacacggtcaagaagtattacgtaataaggatgacctcgataagtgtgcgtctattttagccactggcgactgtatcttagaaggctgggttccttttaaccgcgaatgttcagtaatggttggacgtaatgaagatggagaaataacggcttttcctgtttcagaaaatattcaccatgatgaaattctacatttaagtattgtcccagcaagaatctcttctgaattacaacaaaaggcgcaaaaaatagcggtgcagattgcccaagcgattaatttgcgagggattttaggggttgaaatgtttgtaacagatgatggagagatctatattaatgagcttgctcctcgtcctcacaattctggtcattattcaattgaagcttgtaacttttcacagttcgccatccataatcgagcaatttgtaactggccactcccacaagtagagttattaaagccggtggtaatggtaaatgttttaggtcagcatgttaatggagtccgacaacagattcagaaaaaggcaaattggcattttcatgattatgggaaagcagaagttcgtcataaccggaaaatgggccacgttacaatcttgactgatgatattgaagctactttagcagaaattgacaatacaggtatctggggtgcataaagttcggctttacgtaaccgcttttcctgtgcgataatacatttagaaaaaatagagaggatttttaactgatgattgatcgttataccagtccagagatgaaaaagatttggagcttagaaacacaataccaatgttggttagatgttgagattgctgctgatgaagcgtggagtaagcttgggcatattccagcagaagatgtggaaaagattaaaaagaatgccaagttttctgtggagggaattgcagagattgaagcagtgactcatcatgatgtgattgcttttacccgtgatgtttctaaatcattggggcctgaacgaaagtgggttcactacggaatgacgagtacagatgtagttgatactgcacaaggcttgcgattaaaaaaggcgaacgatatccttcgtcaagatattgataactttatggatgtccttaaagaattagctgaaaaatataagtacacagtttgtatgggacgaacacatggtatccatgctgaaccaacaacttttggcttgaaagctgctcggtggtattcagaaatgaagcgtaataaagaacgttttgaacatgctgctaagggtgtcgaagcgggtaaaatttctggtgcagtaggaacttttgctgaaattgacccatttgttgaggaatatgtctgcaaaaaacttggcttacgtcctcaagaaatctccacacaagttcttccgcgagatttacatgctgaatatattgctaccattgcgcttattggaacaagtatggaagaaatggcaaccgagattcgctctcttcaacgaacggaaatccatgaagtcgaagaacactttgccaagggacaaaaaggatcttctgctatgccacataagcgtaatccaattggctcagaaaacattactggttgtgcgcggatgctccgtggctttatggtgcctgcttatgaagatgtttcgctttggcatgaacgggatatttctcattccagtgcagagagaatgattttaccagatgcaacttcattacttgattacatgttgcggcgttttggtcgaatcttaaagaatctcgatgtattccctgaaacaatgaagaagaatatggacaagacattgggcttaatttacagtggtcgggttcttttgaagttggttaacagtggaatgactcgggaagcagcttatgatttgattcaaccatataccgctaagtgctgggcagaacagattccgttccgtccattattggaagatgacccaacaattcaaaagcaattaactaaagaagatcttgatgatgcctttgattaccactggcacctccgccatgttgatgacatttataaaaggttgggattagactaatttaagttagtttaagaggctagacgaacaaaaaagtttgcctagcctttttattatgctttgtttagtaaaacacgaacaatttgaactgaaaatcatataaatatcgtaattcgtattgacaatcgggagggggaaagagtatattgttgtcatgaaatatcgaattaattttcggatattaaaataaatgttcgttttttactgaaaggaagttccgtaaatggagaagttattgtataccggcaaggcaaagcagatgtggcaaactgaggatccagcggttttacgagtagtttatctggaccaagctaccgccctcaacggaaaaaagaaggatcactttactggtaagggtaaggctgccaatgctatttcttccctcgtttttggttacttaatgaagcaaggaattgagacccactttattaagaaactatcaactaacgaagaccttgtaaaaaaatgtgagatgttcccgcttgaatttgtaacgcggaatgtaattgctggccattttgcaagtcggtatggactttcagaaggggaagagcttccttcaccagttgaggaaacgttctataaaagcgatgagcttaatgatccctttatcaatgaatccgcaacgattgctcttgagattgccagcaaagaggagcttgcgcaaatgtgggggatctgtcggaaggtcaataacttacttaaaccattatttgccaaagctaatttacggttggttgacttcaaactcgaatttggccgtttaagtgatggcaagattattcttgcagatgaattttcgccagataactgtcggttatgggatctgacaactatgcagcatatggataaagacgtatatcgacgcaaacttgctgatttaacccaaacatatgatgaggtattggaacggttagaagcagtgatgaaggaggaagcataaatggttaacgttcggattttcgtaacatataagcaatcagtctttgatccgcagggagaaacaattaaggatgcgatccattctctaggtcatgatgaagtaactgccgttaaagttggaaaattttttgacgttaccttggatacaaatgaggatgaggtagcaacggcagtaaaagaaattgccgatcagctccttgttaatttcaatatggaaacttatacataccaagttatggaggaagcctagatgaaaattgcggtggttgtttttccaggatccaattgcgatgtggatttatatgaagcccttcattccgtttgtcatgcagatgtggagtatgtttctcaccggcaaaaaagtttagctggttttgatgctgtgatgttaccaggaggattttcctatggtgattatctacgagctggcgcaattgctcggtttaccaatatcatgcctgcaataatcaaaatggcaaatgagggtaaaccagtctttggaacgtgtaacggatttcaaattttgacagaagcaggtcttttgccaggtggactcaaacgcaatgatagccaacgctttgtttgtaaaactgttcctttagaagtagtgaactcgcaaactctttttactagtcattaccaggatcacgaacgaatcgcattaccaattgcgcatgccgatggtagttactatgcagatgaaaaaacattagatgaactggaagcaaataatcaaattgtttttcgttacgcgactgaaaatccaaatggtagtttacgcaacattgctggaattactaataagcacggaaatgtcttaggcatgatgccccatcctgaacgggcagtagaaactattcttggcagtacggatggcttacggttatttgaatccttgttagaaaacggcagaattaaagtggaggcatagttaatgaagcaagcaatgaccccagaagagattaaagaaaagaaaccatacttagattggagcttgacagaagcagaatatgattacattcgtacccagctcttggggcgattaccaaattatactgaaactggcttattttctgcgatgtggagtgagcactgttcatataaaaagtcaaagccggttctgcgtctcttccctaataaaaatgagcgagtattgcaaggtcccggagaaggagcaggggttgttgatattgatgatggacaagcggtggtattcaaagctgaaagtcacaatcatccgacaactgttgaaccttatcaaggagcagcaaccggtgtcggtggaatcctgcgagatattttcagcatgggggcacgaccaatcgcttcccttgattccctccatttcggtgaattagataattcgacaacgcggatgaaagtaactaataccgttcggggaattggtgattacggtaattgtatgggaattcctacaattgcgggtgaaacaacatttgatccatgctaccagggcaatattctgtgtaatgcaatgagtgtcggcttaatggaccagaaagatatccagcagggtcgcgctgccggaattggaaatgcagtgatgtatgtcggcgctaaaaccggccgtgatggaattcatggcgccacctttgcttccgcagactttaatgatgaaaatacgacgcaacgttcggcggttcaagttggtaatccttttatggaaaaactcttattagaagcctgtcttgaccttattagaaatcatccagactggttagtaggaatccaagatatgggggcagcagggattgtttcttcaagtgcggaaatggcttccgaaggtaaaagtggaatggagctaaatttggatcttgttccgcaacgtgaacccgggatgtcggcttatgaaattatgcttagtgaatcccaagaacggatgctactttgcgtaaaaaaaggtcatgaagaagatgtcaaaaagatttttgatttttacgatcttgaagcggtcacaattggccggattactgcgggtcatgattatgttctctttcatgatggtgaagaagtatgtcatatcccagtgtcgagtttaacggatgacgtactagaagaagaaagcctcgaaaaaaagcctgcgcggattgaattagccgagcagcagccagcgtggattccagatgttgataacgttgctgaagttttaactgccttgcttgctcagtcaacgattgcggataaaagtagtctttatcagcaatatgattctcaagtacggacaaacacagtggctgggcccgggagtgatgctggagttctgcggattcgtggaacacataaagggttagcgatgacaactgatgggaacggtcggtttgtttaccttagtccagaagttggtggacaaattgccttagttgaagcagctgccaacataattgccagtggagctgagccgttagcaattactgactgcttaaattatggtgacccaactgatccagaaattttctgggaacttcatcaatctgttcaagggatggctgatgcttgccgtgaatttaatactccggttatttctgggaatgtttctttatataacgaaaacaatgggcaagcaattcatccgacgccgatggttggaatggttggtctaattaaaaatattgatcgcgtaattccttcgtttgtccaatacccgggagataaggtttatctagtgggccaaactcgtgatgattatgcggggtctgagttgcaaaaaatgatgaccggcgatattagcggaattgttaagtcatttgaccttcaccatgttcatcaatatatgcaacgtttactgacgacgatggagaacggccttgtttccagtgcccatgatttgagtgaaggtggtctcggagtagccttagcagaaacggtcttcaaaactgatttagggttgaaagttgactttgctgatcagccagcagttcgcctgtttagtgagactcctggaagatttatcgtgacggttgctcctgaaaaggcaaccgaattcgaacaggcattaggaaaagatgcacacctaattggagaagttacaaatagccactggttaatggttaaactggcaaatggtgaactcaatgaaagtgttgcaaaattacaaaaaacatgggaggaggcaattccgtgccaactgaaatcaaaggattaaatgaagaatgtggggtctttggggtttttgatgcggctaacgctagtcaattaacctattacggcctgcatactcttcaacatcgcggccaagaaggagccggtattgtctcaactgatggaacggaactttatcagcaccgtgaccgaggattgttggcgaaagtgtttgctgatccggctgagcttaaacgattaaaaggaaacgctgcgattggccatgtgcgttatgggacaagtggacataactcgatttccaatgttcaacccttcctttttcactttcatgatggcgccgttgcccttgcccataatggtaatttaactaatgctgttacccttcgtcgtgaattggaaaatgaaggggcagttttccagtcagattctgatacggaaattttaattcaccttatccggaaatatattaatgaaggttttattcctgctttgaagaaaagcctcaaccttgtccatggtggatttgcctacctattactgcaaaaagatcggttgattgcggctttggatcctaatgggattcgtcctttatgtattggaaggttagaaaatggtgcttatgttgttgctagtgagacttgtgctttagatattattagtgctcaatttgtgcgtgatgttttgccaggagaattaatagttattgataaaaatgggttacatattgaccattacactacccaaactcagctggcaatttgctcaatggagtatatctattttgcccgtcctgattctattattcatggggtaacggtacataatgcgcggaaacgaatgggaaagttattagcaaaggaacatccggttgatgctgatatggtgattggagtacctaactcatcgttgtctgctgctagtggatatgctgaagaaagtggccttccatatgaaatggggttaataaagagccaatatgttgcgcgaacgtttattcaaccaactcaagagttacgggagttaggcgttcatatgaaactgtcagctgtccgcggagttgtaaaaggaaaaagagtggtagtagtcgacgattcgattgtgcgcggaacaacttctaagcagattgtccaaatgctaaaaagagctggggctaaagaaattcatatgcttatttcctcaccaccatttaagtttccgtgtttctatgggattgacgtatcaacgcgttcagaactgatggctgctcattactccattgaagaaatgcggcagttaattggtgcagattctcttaactttttgagtattgatagtttaatcaaagcaattaacgtaccagatgcaggagatgctcctaatggtggacttaccgtggcttattttgatgggaagtacccaacgccactttatgattatgaagaagggtacttaaagtcgttaagcgaacaagagcgattagcaagaaaggggtaagaggatgagtcgttatcaagatgcaggggtggatgtaaatgccgggtacgaacttgttcaccgtattaaagatgcagtcaaatcaactgatcgcccaggggtgattgggggaattggcagctttggggggatgtttgacttagaaaaattacaggtacggcatccggtccttgtctctggcactgatggtgtgggaacgaaactcttaattgcccaacaaatgaataagcacgatacaatcgggatcgatgttgtcgcaatgtgcgttaatgatgtcttggcgcagggagcggaaccaataacatttctcgactacattgcgaccggccataatgatccggctaagatggcagcgattgttagcggagtagcgactggttgccgagaagctggagccgctttaattggtggagaaacagcagaaatgccagatatgtatgcagccaatgagtatgacctggcaggaacagtaacagggatagcagaaaaagaagaacttcttaccgctgctggaccgcaaaaaggtgatattttacttggcctcccatcaagtggcttgcattccaatggcttttcccttgtccggcagatcttatttaaggataatcacgtcaaattaactgatcgcccagaagccttgagaggaaagacggtaggagaaacgatcctgactcctactaggatttatgttcaagcggtcttgccattagtccatcgcaaattggttcatgggattagccatattactggtggaggattgattgaaaatgttccccggatgttagaagataacttgcaagcggtgattgatcctggtcggtggccacagcttccggtctttgactatttgcgggtgctaggaggccttactaaggaagattgtttcgaagcatttaacatgggaataggaatggtcttagcagtagcaccagatcaagtagcacaagttcaagagatactatcaaataaaaacatgacaagttatcaaattggttatcttcgtcattgtttaccagatacaaaaaagattgttatcaagtgagggttgtaaatgagagtcgcaattttagcatcaggaaacggaacgaattttgaagtcttagcacagcacttcaaaaataatgatcttcctggtgaattagcattattattctgtaatcatccagatgctccggtaatgaaaagagctgcccgactggggattccggcagaaagctttacggtcaaatcttgtgggggaaaacaggaatacgaggaaaaattattgggagtgttgaaaaagtatcaaattgactttattgcccttgctggttatttacgagtaattgggcccactattttggatcattatgctcaccaaattattaaccttcatccagcatggttgccagaatatccgggactacattcgattgaacgggcatttgctgatcaacaagcccagacaggcgtcaccgtacactatattgatgcgggactcgattccggcccaattatcgcccaggaacacgtcccaattttaccaactgatactattgaaaccttagaagcacgggttcatgaaactgagcaccggttatatcctgaagcactaaagcaggcattagaaaaggagcaacattaaattatgaaaagagcattagtaagcgtttctgataagcaaaacctggtcccattcgttaaaggattagttgaaaatggttttgaaattatctcgactggtgggacgaagcgggttttagatgaagcgggaattgaaacaattgggattgaggatgttactcattttccggaaattcttgatggccgcgtaaagactcttaacccatacgtccatgggggactattggctcgccgggacttaccggaacacatggcgaccctcgaaaaacttaatattacgccaatcgatttagtctgtgttaatctttatccatttaaagagacgatcgaaaagccgggagtggaattagccgatgcaattgaaaatattgatattggtggtcctagcatggtccgctcagctgctaaaaactatcatgatgtaacaatcgtggtggaccaagccgattacgatgaagtcttagcccaaatcaaagaagatggtgaaacatcattagcaactcgagcacgcttagcagcgaaagcctttcgtcatacggcagcctatgattccctcatctctcaatacctcacaaaacagacagggcttgaagatccagaaaaattaactttaagctgggatttaaaagaaacaatgcgttatggtgaaaatagtcaccaaaaggcttggttatatgaagacgcgcttcctaaggctttttcagttttacaggctaaacaattacatggtaagaagctttcctacaataatattaaagatgctgatgaagcattacggtgcattcgcgaatttgatgaaccaacagttgtagcgatgaaacatatgaacccatgtggcattggccgaggggatagtttggttcaagcttgggatcgtgcctatgaagctgaccctgtttctatttttgggggagtgattgctcttaatcggcaagttgatttagctaccgccgagaaaatgcacaaaatctttttagaaattgtcattgcacccggctttgacgatgatgcatttgagttattggcaaagaagaaaaatattcgtttgttgagtctggactttagtaagaaggatgaaccaactaaacatgaagttgtttcagtgatgggtggaatgttgttgcaggaacaagacacgcttaaggaagattaccacgactggcaatgtgttactgaaaagcaaccaacagaggaacagcttaagacattaatgtttgcctggaaagcagttaagcatgccaaatcaaatgcgattgtcttagcaaatgatgagcggacattaggggtcggagaaggtcaacctaaccgaattgattcattgaaaattgccgtaaaacatgctggcgaggcgattgatgaccggacagtgatggcatcggatgctttcttcccatttggtgattgtgttgaatatgcgggtcaaaatggcattaaggcgattgttcagccaggaggatcaattcgcgatcaagaatcaattgagatggcaaataagtacggaattgcaatggtcacaacaggcattcgtcatttccgccattaaagctaggagggtatcatggaaaagcaggtcaacgtattagttgtaggtgaaggcggtcgtgaatttgccgtggcgaaaaaattacaagaaagtccccgtgttaagcaagtttattgtgcgccaggcaacgtggggatgtcgactgtaggagtagttcccattgcaattgcggaaactgactttgctaagctgattcaatttgctaaagaacataatgtcgcgtggacattcgtgggccctgaggattgcttggttgatgggattgttgatgaatttaaggccgctggattaaaggtttttggtcctgatgcgcgggctgcccaattagaaggctcgaaagactatgcccttaattttatgaataattatcacgttcccactgcccgccatgcgacatatagggatcaaacagcagcgattaataacgttgggcaatttggctttccagtagtaattaaagaaaatggtttagctggaggaaaaggggttgtcattgcaaaagatcgtgcagaagcaattaagacaatcaaagaaatgtttgtcaatggtcaggcgcgccttgtgattgaagaatgtctatcaggtcctgaatattcaatgtttgttttgattagtaatggccactaccgaattttgcccatggctcaagaccacaagcgagcatttgatgacgataaaggtcctaatactggggggatgggggcttatagtcccttgccacaactttcctcagccgttcgtcaacagatgattgatgaagtacttaagccaacaattgatggtttggtggctggcgagtatcactaccatgggattttatatattggccttattttgactgataatggtccaaaagtgattgaatataatgttcgtctaggtgatccagagacccaggtgattttgccccgcatgaaaaccgacttgttcgaacttgtagacgcagcaattaatgatcgaccattaccagaagttgaagaaaatgaagatgcttgttttggtgttgttttggcatcgaaagggtatccaactaagccaatccacggccaaaagctgggaacatttccagttgatcctaatgttactattgattacgcaaatgttgctggaacaattaatgacttaaaaggtgcaggtgggcgtttgctaatggtgatcgggaaagatgattctcttcaaaaagcccgcgatcacgtttatggctacttgcgccagcttgatgaacctgaatgtttttatcgtcatgatattggtgcaaaagctggactgcaataatttcttcatcactattggcatttgcaggggaatggattaaaataatatggtaatgctgtttatagcgattttaagaagaaagaggtcaattgaacatggctaaattagtattaattcgtcacggtcaaagtgaatggaacttatctaaccaatttactggttgggttgatgttgatttaagtgaaaagggtgttgaacaagcaaagaatgctggtaaagcccttaaggaacacggcattgaatttgactacgcatacacttctgttttgaagcgtgctatcaagactttgcactatgctcttgaagaatgtgaccaattatggatccctgaatacaagacttggcgtttaaacgaacgtcactatggtgcacttcaaggccacaacaagcaaaaggccgctgaaaagtatggtgacgaacaagttcacatttggcgtcgttcatacgatgtattacctccattgctaagcgctgacgatgaaggttctgctgcaaaggatcgtcgttacgctaacttagacccacgtgctattcctggtggtgaaaacttaaaggttactttggaacgtgttattccattatggcaagatgaaattgcgccaaagcttttggacaacaagaacgttatcatcgctgcccacggtaactctcttcgtgcattgagcaagtacatcgaaaacatttctgatgaagacatcatgaaccttgaaatggctactggtcaaccggttgtttacgacttcgatgacaagcttaacgtattaagcaaggaaaagtactaaaataaacttacgatattaaatttgaagaggcgggaaagttagattcctaacgccttttttttgtagcttttttgaagaaatgttgaagatattgatgaataaattgagcttatagtgagttgtggtatgattaacatcagaatctaataaggtggagagaatttaaatgaaaatggaaaaacaacgaacactcccaatgaaggaattttacctttcattgaaacaactggtaaagcctaactatttaaaggcaatgtggccagttgcaggggtatcaattatttttattgctttagcagcgatcttagcactccttaattcaaacattgctgcctcattgagtatgacgatgatgatggtaatgtacgggatggcttccccggttgcaatcttgttctcattattagaaattgtagggattgtcgcaattattgctgcgttagccttcttctatactttctttgcagttgctacccaatatacatatcaggataagatggctcatccagaacaaccagttagtgctggatcaatatggatgcactataagcacttgcgaaaaaaccaagtatggcggattattctttacattggattgtttactttcttatggagtttgcccctcaacattgttaacgcattactcttgccacatttatccggagtagccgctgtttatacggggtgggcaattcgcatccttaatgatattgtcgtattatggaagagtattgaatattctcaatcatacttcctttatcgtgaaaagcagccacaattccttagccaatcaatgcgttatgctttaactgctagtcggcggttcatgactggtcgaaagtggaactactttgcaattctgtttattttagaattccttccaatgtttatctggactttaatttttggtggattggcattttacggcgtttatacggcaacttatgtccttacttatatcggaatcgttttagtggttgttggtatttcctgctaccttccagtggtatatgcaattcttgctttgtactacaacaaggctcgagcaggaatggaaatggatgtgctttttaaggatacttttaagccagtagccgaattaaccggtgaagcttatgttcatgaagtatatgtagaaaaacaaccaaaagaacaaccatcaccaactgttaagcgtgatgatgaaaagaaacacgaagcaaaaaaagatgaatagtgaagcgaaaagctgaagggtaacgaaaactcttcagcttttttgtattttaaatacttcttgacagtaatcattaattccatgtacaatgacggcaataaccaaagatgaagaagtaatcttagtagtaagcggttggacatttaggaagcaagtggtaactgtaaactttgccaatgccgttatacgaattacacttacggagtctttcagtatttgaacggatcgtctcgttatcgactagagtggtagctatttagctgcaaatcaaggtggtaacgcggtaaatcgtccctgacttcattatttgaagttggggattttttgtatccgagaaatttatggaggtaaacatggatattcttaatgaactagaatggcgtggggctattaaccaagttacagacgaagaaggcctacgcaaattaacatcagaagataaaattgctctttactgtggaactgatccaaccggggatagtcttcatattggacacttaattccatttatgattttgaaacgatttcaattagctggccaccatccagtaattattattgggggaggaactggtgcaattggtgatccatccggtcgaaagtcagaacggcaacttcaaaccatggatcaagttcaccacaacgaagaagcattaactgctcaaatgaagaagttgttcggcactgaaaacttcacgattgtaaataactatgaatggttatcaaagatcagcttgttagactttcttcgtgactacggtaaactatttaatatcaacaccatgttaaataaggaagtagtagcaagccggttagatgctggtatttcatttactgagttcacttatcaaattcttcaatcagtcgatttccttcatctttaccgtcacaatgatgtgcaattacagattggcggctccgatcaatggggaaatatcactgccggaattgatttgattcataaggttgaaggaccagatactaaggtttacggacttactattccattaatgctcaaagctgatggaactaaatttggaaagaccgcgggtggtgcaatttggcttgatccagaaaagacctctccatacgaattttatcaattctggattaaccaagatgaccgtgacgttattaaatacttgaagtacttcactttcttatcaaaggaagaaattgatgacttggcagaaaaagttgagaaggaaccatggaagcgagaggctcaacgtcgcttagcccaagaagtaactaaatttgttcatggccaagaagcagttgaagaagcagaacggattagtaaagcattgttctctggggatgttactgacctttctgttgcagaaattgaacaaggctttaagaatatgccttcagtagatgtagaaaataagaaagaaaatattgttttatggttaaccgataatggcattgaatcttcacgtcgccaagctcggcaagatgtatcgagtggagctatcaggattaatggggaaaaagttgatgatgttgacgccgagattgatccccaagcacattttgatggtaagtttgtgattgttcgaaagggtaagaagcactattacttagctcgcgtaaaataaattagaccaattgttagcaaatacgttcttaaaagatgatttaagggcgtattttttatttttagatataaaaaaacaaattttttctatttcgaataataaaaaggttcaggtttaaaaaataaattaaaaaagttgaaaaaaggtgttgacgaaagaatgaaatccatgtatagtagttatcgttgtcaaaacagctaagtgctgttgagatggtttaacaaaaaagttaaaataattgttgacatcgacttggcaacatgatatattaataaagttgctgattgagttatcgatcaaaagaaattaaaaaataatttaaaatttcttcttgacaagttaatctgatacatgatataatgaaattgttgattggctgcttaattaaccgacaggtagacctttgaaaactgaacaaagtttcgacgaatcaaatgtgtagggtcttcaatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcgaagaaactttgtttagttttgaggggtttaccctcagagcttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaatattagagttaccaaagtgcgacgtagtcgcaacagttgggaagctgtgccatagagggtgagagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattacatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgcgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgttcccatgccgaacacagaagttaagcttcaacacgccgaaagtagttgggggatcgctccctgcgaggataggacgttgccatgcgatcaaaacgtgaaccggttaaacgattcgcgtcttttctttaataatagtttctggtataattaattaggaattgttattatgctgacttagctcagttggcagagcacgtcactagtaatgatgaggtcggaggttcgaatcctctagtcagcataattaaaacttacaaagtttattaatccttgatatatcaacgttttacgaagatgtattagggattatttttgtttatttaagaatgttatgcacacggctgtgcacacaaaataatcgtgtgcatgagcttgcatcggagaagtgcgtaaaccattgatatattaggctttatagattattttttgtgtgcatttaactgcttttgctatgatatagtgatgaggtcggatattcgaatcttctagtcagcactagatagtgtaggatagcctattataacgctgtttatggacgttataataggctattttatatacaaatatgttatcagtttctcacttttttctcacgtgaacactaaatggttgttttgaatttttgagaagtagcgctaatgcagttatatcaaccatttaagctgttagagtgtgtgaaaaagtgtgaaatgaagattaaaagtatatcgttaaaataatataaataattttagatattaagtatattgttttcttcagaaaatatagagaaaaattcaataagatgaagggctttgattttctaattaaagccttttaattataggttgaagaagaaagtttttaggatcaaatttggatagtatataaccatttttgaatattattcttatttaagcagatcacaatatgttataaaattaaaataagggtatgttatgagtgcaaataggagtaaaaaatggttaataaaaaagagttgtctgaagaagatgtaaaaacaagatatattactcctgctattgaggacaaaggatggactcctcaagactggcgtatggagtatgagtacacggatggaagaattactgttgttaacaatacaaccaaacgtggagaacgtaagaaaatagattatctattaaattatcatgaaaatgttcctttggctattattgaagctaaagacttgaaacatacatacgatcatggtatgcagcaaggaattgactatgctaaagggttaaaacatgctgaatccttacaagtaccttttgtgtatgctagtaatggagaggcatttcttgaacatgatatgctaacgggtaaagaacgtaagttagcaatgaatgaatttccaactaaagaagaattatgggaacggtttaagcaagaaaagggattaacccctaaacagatcaaagtaattaatgaaccatattattcaacacgtgaatcaagaaagccaaggtattaccaaagaattgcaattaaccggtcagtgaacgcaattgctaatggtcaacgtcgggtaatgttagttatggctactggaactggaaagacttttactgcctttcagatagtttatcggttattacaatctgggattaagaagcgtgtattataccttgctgatcgtaatattctggttgatcaagcaatgacagatgattttagcccgttgctaagtaaagcaactaaagtacgaaatggaaaaatggatagttcttaccaaattcattttgctttatatcaacaattagcaggtcgtgaagaagatgctgggcatgaacctttccgtcaattcaaacgtgatttctttgatttagtagtgattgacgaagcccatcgtggctccgctaaaaaggacagtcagtggagaaaaatattagattactttgatggccctaatgtgacccattttggtatgactgctacacctaaaaatgagaagggtgcatctaatattgattattttggtgaacctatctatacatattccttgaaacagggaattgatgatgggttcttagcaccatatcgagttattcgggtcaactttgatgttgatattaatggcttccggcctactaaaggtgaaaaagacgccaatggccaagtaatagaggatcgtcagtatacatcaaaggactttgatcgtacaatgataattgctgatcggactaagaaagtggctaaatatattagcgattatttgaagaaaaatcatgaacgatttaataaaacaattattttctgcgaagatattgatcacgctgaacgaatgcgaacagctttagtaaatgaaaatgctgacttagtacagcagaatcctaagtatgtcatgaagataactggtgatgataaggttggtaagggtcaattaagtaattttgaagatgttactagtaaataccctgtcctagttactacatctaagttattaactactggggttaatgtaaaaacttgtaagttaatcgttttagaccaaaatattaattcaatgactgaatttaaacagattattggtcgtggtactcggttagatgaagcacatggtaaaacattttttacgattatggactttaagggtgcttcacgtctgtttgctgacccaaagtttgatggtgaacctgaagataccgttatagatgatgatggtcaaggcggagtggactttaacaatgacgataagaagacagataaaaaagaggagtctgatatcggtgataaagttagtgaaggtaggacaaaatacttagtaaataacaaacaggttcaaatcgtcaactctcaggcagaatatttggacgccgatggtaaattaattactacatcattgcgtgactacactaaaaagaacgtgcttggacagtatgctactttggataaatttattgaagagtggcgtaaatctgataacaagcaagagcttttaaatgatatggaaaatcatggtattttctacaaagaaattattagtgatgagaatctaaaagatttagatccgttcgatttactagttcacttggcttataaccaaaagccattaagtaagtcagagcgtgttgctaatgtaaaaaagtctggattattagacaagtatcagggtgaagcaagaaccattcttgaagcgttacttgataagtacaaaaacgatggaattgaagaacttgaaagtcgcaagacgttaagcttaccagagtttgaacagtatggtgggccagttaagattattctgaaagtatttggtggtaaaaaaaactatcaaaatgcagtttcagaaatgaaagagaaaatttacagttaggattaggtggcaatggcgaatacacaatttgtaaaacgaattcaggatattatgcggaacgatccggggatcaatggtgatgcccagcggattgaacagctatcatggatcttgtttctaaaggtctatgatgatcgagaaatgatatgggaattagacgatgatgaatatacatcaattattcctgatgggctacattggcgcgagtgggcacaagataataaggatggacaaagccttacgggtgatgagttactagactttgttaataatcggttattaccttccttaaagaaaattacagttacttctgatactccaattagtaagtcgattgtaaaagatgcttttattgatgctaataattatatgaaaaatgggattcttttacgccaagttatcaacgtggttaatgatgttgactttactgatcctaaggatcgtcatttatttaatgatatttatgaaggtattctaaaagaactccaaagtgctggtaattctggggaattctacacgccacgagctttaactgattttattgctaagacattgcagcctaagttaggtgaacgagttgccgatttggcatgtggtactggcgggttcctagttagcaccttaaatatcctgaataagcaagtaaagacggttgaagatcgtgagaattataaccgcgcagttttcggtatagaaaaaaagggacaaccatatatattagcggttactaaccttttgcttcatgacgttgataatcctgacattatccatggaaattcattagaaaaacgggtcgcagattatactgacaaagataaatttgatgttatcatgatgaatccgccatttggtgggtctgaacttcctgttattaagcagaattttccaactgatttacaaagtagtgaaacggctgatctatttttagccttaatcatgtatcgcttgaaggataatggtcgagttggtgtaatcttgcctgacggattcttattcggtaatgacgatgccaagattaaccttaagaaacggatgttaaatgactttaatttgcataccattattcgcttacctggtagtatctttagtccttatacatcaattgatactaatattctcttctttgacaagactggtccaactaagcaaacctggttctatcgtcttgatatgccagaaggatacaaacatttctcaaaaactcgaccgatgaaattagagcatttcaagccagttgaagaatggtggaataatcgtcatgaaattcaagatgatgccggtaattacaagtccaaggcttatactccacaagaattagctgacaataactataattttgatctgtgtggattcccaacagaaactgaagaagtcttaccaccagaagagttaatgggtaagtataaagaagagcgggcagaactaaatactaagattgatcagacactcagtaagattaaagcattgttagaggaggatgattaaatgactcctgaacaattgcgggcttctattctccaacaggcaatggaaggcaaattggttaaacaagaccccaatgacgaacctgctagtgaattactagaaaaaattaaagcagaaaaagaacaactggttaaagcaaaaaaaattaagaagactaaagccttacctaaaattacggaagacgagaaaccgtttgatattcctgaaaattgggaatgggttagattaggtactgtttttaatttacaagcaggaaagaatagaaaagcttctacaattaatgaaattaaaactgtagattatgattatccttgttttggtggaaatggcataagaggttatgtatcagactttaatagagaaggaaaatatgcattaataggtagacaaggagctttatgtggaaacataaattttgctaagggaaaattttatgctacagaacatgctgtcgttgtagaaatatttgctggtacaaattataaatggagtggatattttttaaaggctctcaatttgaatcaatattcaacagcaacagctcaaccaggcctatctgttactaaaattaaccgtgtattaattccattaccgccattaaaagagcaattgagaatagtagcaaagattgaaaagttaatgccattaattgatgagtacgcaaaagcatataatcgactaaaagcaattgatgatgattttaacgataagatgaagcaatccatcttacaatatgcgatggagggcaagctagttaagcaagatcccgatgatgaaccggctagtgaattgctgaagaaaataaaggatgagaaaaaacaattagttaaagaaaagaagattaagcggagcaaatcattgcctagaatttctgaagatgaaaaattattcgacattcctgaaaattgggaatgggtaagattaactgaagttggatcctggggagcaggtgcaacaccatctcgatcgcatcccgaatattataatggtggaattccttggctaaaaacaggtgatttaaatgatggggttattagctctacttctgagacaatatctcaagcaggtgcagacaattcttctgtaagatttaaccaaccagggaatattcttatagcaatgtatggcgctactattggaaaattaggaatagcaggaatttcgttaactactaatcaagcatgctgtggatgtaagacttttgatggaatatataattggtatctcttttattatttattagcaatgcgacctcttctaattgatcaaggatcagggggagctcagccaaatatttctaaaactaaaattgaaaagtttccttttgcactaccaccatttgaggagcaaaagcgtattgtaactaaaattgaaaaactaatgcctttattggttgagtaataaatctataaggaaaaattaacaggtactgcataaagtctgacgtgtacccttaaagttggaacctgtatgttcttgctttaaaattgaataaatatttttctaggcaactagattctgctcatattgaagtggagtttggttgcctagttttgtctgaatacggcgttcgttgtaaaagtgaatccattcattaattgcttggcttaattcttcttgattgcgataactggtatcaggaccgatttctgctttcagtttactaaagactgtttcacaggcagcgttatccagacaggttgctcgatgcgacatgctttgcctaatgtttccctgacgaagtagtttgcgccaagcacgatgttgatagtgccagccttgatcagtatgtaaagttaattggtatcctgtatgaggtaactgcttaagtaattgctggagtggatctaatgcgaattgaagatttggatgttgactgattgaccaagtgagaagctggttagttgccaagtccttaataatttctaagtacacttttcgcccatcatgagcctttaattctgtaatgtcacaaaccattttctgatatttacggttactcataaaacgccgatttagcttattcttagctttcttgccatttggtcccttagaggaatcatacttacggactcgccgattatatttgatacatttaagtcccatttcatgcattaagcgctgaatgcgcttatgattaggtgtctttttaccaattaagcgatagtagtctcgaatttgagtgcttaaacggcgtacgccgtattcagcttggtagtagttaaagagacctttaataacggctttaagttcttcttcatcctcatccggatgttcaaaccgattttgccaatactgataggttgacatggaaatgggaagtgcatcgatcaaatcctttaataagtatttagccttgaggtcataaattacttgtgcgagttcttttttggatgctttctcaaggctgtcaatttttttgaggcatcgagttgtatctttaacaataagttttctctttgtaaagcttggttctgtttttggagctgaagaagcttgtcttgattcttgtcgtgtcgtttgaccatttttaggtttccttccccgacgcaatctcagtaaagcctgtggcccttgcttgttatagagacattcccactgatacactgaacctggggaacgatatccaaagtgaatacaagtttctgaaattgacgtcaaattttcttgtttccactttacctaaccgaaaatccccagttactttgggtggattgagtaatggtcctttaccaaatcttgcataaattcccacccaaattttgaaatcatgttcagcaatcccgtatttatgcctaactgatgctaaagtaacattaccgttggcatattcttcaacagctttaagtttagttttaacgctaattttggtcatataaaatacccccagagttgatttccaactctgggggtacacgtcagaggattatcctcaaggcctgtttttatattgagagaattctaagacagtagtatattgatattaaaatttaatgagaaagaagatgggagagtagtggctaaggagagaaaagaaacgatctttacgaaggatattgttttagtaatggcggcttcattcttcttcatttttagtaatatgtattgtaatccgctgattaatggctatgctcaggaattaggagcctccagtgctttcgccggaattattgtggggatgatgagtattgttgcgatgtttcttcgtccagttgcgggaaacatgacggatcatttttcaaagtatacgctggcgtttctcggtggtgttttaagctttattggggttatgggttacgttattacccccaatagcggcctgctcctgttctttcgactaattaacgggttagggtatgttctttgtacagtttgcatgacaacctggttatcatatttagtcccgtttaatcatgtcggtgaggcaatgagtttttatggattaatgaatgctttggcgatggcttttgcaccagcggtatcgatcaacctttaccgcgtgatcggttaccgatatgcaatcattatttctgcattagcatcattaatgatgattattactgtgcagtttattgataataaagctaaaccagatcctcaaccgaaaaaagaaaagactaagggcttccatctgaaaattattcagaaggattcgttgccaattgccttcttgactgcattgtttgctattccatactttgcaactcaggcagatattgttacctatacggaacaacgtcatttgccaattgcagttggctcttacttcttaatttatgcggttgttttgttaggaattcggcttttcttgcggaaccaatttgatacggttaagttcggaccatggctgattattagtacaatcgcaacggtcttttatttaattatgttggcagtaatgcatactaactttgaaatggctcttgccgcagcagggatggcctttggatacggattgatttattcagtttgtcagtcaactgcgatgatgttggcaccttctaatgaacggggcctggcaagttcaacattcttcttagggttggatgttgggatgaccctcggacctgttcttggtggggtcattgattcaacaatgccagtaaaatggttctatccagtaatgctagtaattattccatttattttgctaatttatgtattcaatcggcgcaagttaaatagtgcagtacaaaatcattaaataatgtcaaaactgggaaccaactcgagccttgttcttaataagggttcaggttgattcccagcttttttattatcagaattttagtttgttctacatgaaacacatttgatattctagtcaggtttaacgatttcttgtttccagtggtggaggtgttgttttgtgatcacacaaaggccatcttcacctaatgccttcattttatcggtacacataatcttaatatcaggattatcggcaacctgttgttcaccccagtaatttaagtaacggagggcagcataaagtttttccccttcagcggttaaacgatattcaacgtgtggaggaatggtattgaaactcttccggtcaacaattcctgcatcgacaagttctcgtagctgatcgctaagaactttgtgggaagttcctaattgcttcactaattctccggttcggcggggatgaccggcaagaaggtaaagaatgaccggcttccatttaccaccaatgattgatagggcatagtctgcaccggtattaaacattttagccataaaaatcctcccttcagtactttcattatatatgaaaagagtgaagagaggagtagagttattatttaattaacttaaagacttgatcttctggaaggtaatctttatcaccagctggagattcgattgagccaaatggcatttctgcgcgtaacttccatgattcaggaagatcgaatgcttcatgaatagcatcatcaattagcggattgtagtgttgcagactagcgccaaggttgttttctgccaaggcagtccagacagcttgttgagcaccaccaattgcttgctcagaccaatccgcgaagttagcggcatagctagggaattgttcttctaagttatgaacaatatcagtatcggttaagtaaaggattgtcccgaaacctgcacggaatgttgcgatctttgctttagttttggcaaaagcagcaggatcctttacaatcttctggagagtttcttcaacaatatcccaaactttgtcagagttcttgccaaaaagaacaactgcacggacagtttggctgttaaaggcacttggagagttacggactgtttcctttaccaggttaaaaatttcttctgggcttgttgttatgttatcgccaagagcataaatggaacgacgcttggcactgagttcattaaattttgattgcattgtgagttcctccttaatcaattctttgttatttcacttactaatagtaactaaaatatgagacatggacaagatgagaaataaaattcacctagttacaaattcttccctataataagatttgataatggcagattgcaagaaataacttgaacgaatttaatgacgtagattaagcaggaagatctcgattggtgtatgccaattaagacatttaagtggccgtgaattcagataccaattgatttgaaccagttggtaatcacttagttcttcaatggcttgtcccttgggaataaaccgtcgcaaaactcggttacggttctcattactaccgcgttcgtgcggtgaataggcatgggcaaagtaaacctgagtacccgttagctgttcaattgcctgataattagcgaactctttaccatgatctacggtcagcatcttgagtttgtcttgaagttgactagctagttcaagtacggcttgagtcatggactgactgtcgcgaccatggagccgtttaacaattgtcaggcgactcttacgctccacaaaagtagccacagcttgacctttacgcttgccagaaagcacggtgtcagcttcaaagtggccaaattcctggcgagtttcgactttatgaggacgctcctcaatggagcggccgtgactgaacgtaccacgcttttctttagcacgatgacgacgaattccatgatcaggcaaatcgggtaactgtacatcaagccagccttgatcaatccagttatagaccgtcttgtaggcaatcccaactacatgggcaacttgttcaggggaccacttctggacttgaatcttttcctcaatcaagtgcttaaggcttttagtgagcgaagacttccgcccccgttgactaaccttttgttcaaagtcagtttgcgctagctcagcctggtactcactatttagccggtgaagttcgttaatgatggtggtcttactaaagcctaagtagttagcgatgtatcgcaaggaacgtccttcattatgaagcgtttcaatgacaacacggtgctggaatgataaaatagtggtgcccatcaaggtccttctttctaatggaatgttgaggtaacaccattaaagaccttgatgggtttttctgtccacttaaatgttcaacttaaattttacaatctgccatatgcaaaagctactaacacgaaaagggaaataattaaatatggcttaattaaaattgaattaaataaaaatgttgactttctaattttagggtgttaatcttttgataatcaatttaacaaaaagatgttgatcaagaaagattagtaatacttacttaagagagccaatgtttggtgtaaattggtggacagtattataaaaatctatcacttgtgagtcgtatatcgaaacttaagtagaatatactggtaggcgcccattattgtgtcagctaattgttgctttgcaactgttggtgaaggtagttatttcactacgaaaaaaggtggtaccacgtgaaaacgtccttttcaatctcagctttggggttggtaaggctttttttatttaaaatttaaaggtggtggtgtaaatgtcagatagcgacattattaatattaaagaaagtatactaagaaactctattaatcatagaaaggtgtttccttttttgattaatatttaattcattgtttaatttatgacgttatataacgtcttatttaataaaaattggaggacttacctatgaaaaagcttaaagcacaccgtctattttatgtattaactcttctaggaacacttttgcttcttttaaccggatgtggaaagtcaaataaatcatcacttcaacaaattaaagagcggggtactcttagagtgggaatgatctctgctaatccaccatacgaatcacagattcaaaaaaatggcaaaacgcaaatgcagggcgctgatgttctactagtaaagaaaattgccaaaaacttaggtgttaaatatgaattaaagacaatggatttagatggacttttgcctgctttacaagctaagaaagttgatatgttagttacatcaatggctccaacgccagaaagacaaaaagcggctaagtttactgacacgtattacaagagtaccaatgtcttggttgttccaaaagctaatctagctcaatacaaaaatgccaataatttcaagcatgctaccattgctgtagttaacaattcatctcaacaaccaatgattcataaggtattccctaaagctaccactaaggatctatcaaaggttaccgatttagctttagcagtaaataatggaaaagctgatgccttctgtattgacaaaccgactgcaattatccttctgaagaagaatccagaattaactatgacttcatggcgacacaacgatggatcaaaaggtggtgctattgctcttcctaaggggacttcggatgaccttgtaaatcgcttgaatgaagtaattcaccaaaacaaggcacaatatagcaagtgggttgatcaatatgcacagaaaggaaccaactaacaaagattagaaggagtgattttatgttttcaaattactcatttattacagaatattggccattatttatacatggtcttgtaacgacaattgaacttgcagttatctcaattgtcttgggtctactattaggtattaccttggctgtgatgaaaatgtcaaaggcaaacttactaagcttaatagcaaaaacgtacattggcttcattcgtaatactcctttattggttcaaatatatatcgtttatattggccttccacaattactgggattctccgtaaatgactttgtaacaggtatagtggcgctaaccttgtattcaggtgcttatattgcggaaattattcgatctggtatccaatctttaccggtagggcaaacagaggcagcagaaagccttggtattccatcatatcgtattttattggatatcatcttaccacaagcattcaaaaatattcttccagcactgggaaatcaacttatcggtaatgttaaagattcatcattggtatcagtattaggtatcaccgatgttatgtttgccgcccaaacagttcgtggttcaacagccttaggattggaacccatgattattgcttctgctctttacctggtaatttgtctgattctgaatcagattcttgctttgtttgaaaggaggatgcgtcacgatgcttgaattacgtcacgtcacaaaaaagtttggaaataacactgtcttacatgacattaatcttaaagtccataatggagaggttgtagtgatcattggtccttctggatcagggaaaagtacgttgattagacatatgaatctcttggaacagccaactagcggtaaagtacttttccaggataaaattatttcagggagtatttctaaaaaagcccaacaaagggtccacgaaaatattggaatggtctttcaacattttgacttatttcctcattttactgttagacaaaatatttcgtatgctccaagagtggtaaagcatttatcaaaatctcagactgatcgacaatcgacggaattactaaaggaaatggatttagaaaataaggctgatgcctatcctgatcaacttagtggtggacaacagcaaagaattgcaattattcgatctttagcaatgaaccctaaggtaatgctttttgatgaaccgacatctgctttagatcctgaaatggtagaagaagttctgaaatcgatgaaaaagctagctaagagtggcatgaccatggttgttgttacacacgaaatgggatttgcacaggaagttggcagtcgcgtagtttttgtagatagaggtcacattttggaacaaggcacaccagatgagatttttcatcatgcaaagcacgaacgaacaaagaactttatttctaaaattctatatacctagaatagagagtgtatctaattatgttagaaaaaaatattaagacaccattatatgagcaaattgagattgaattaaagcgcttaatcaatgatgataaatataaacaaggtgctttaattgcttctgaatcagaacttggcagagagtttggagctagtcgaatcactattagacgggctattagtgatttggttgatcagggttatctggttaaaaagcagggaaaaggaacttttgtccaagcaaatatggttgaacgtaatttattacatctaggaagctattcaaattttatgaaaaacagtagtaagcatccttctgtacaaatagttaagctacaagaaatagcaagtacagataaaatagcagaattactaaatattttccctggagaaccagttataaatttgaagcgactagttaagtttaataaggaagtaagtggcttagaaagtgcttactattcttcaaataaattcccaaaattaagagaaaaaatcaccccagatatttcaatggctaacctattatctactcaatatggatataaggaacagggtagtaatcagctattgagctatgtaccagctactagtgagttagctcaatatatgaataaggttccgggagaacctctattcaaattacgtcgtcaagtaatggataaggaagttatttatgtgacttttaactattacgacgcatctactaccaactttgccattacatctggaaatcaaagaaaggaatgattctatgagggtcttggccattggcgataatgtaatggacatttatctcgatagtaagagaatgtttcctggtggcaatgcggttaacttcagtgttatggctactcgaataccagaaattactagtgggtatcttggcaattttggcagtgataatttggctggattaatgaaaagtacattaaaaacatttaatgtcaacattgatcattgtagaaatttgaaaggtgaatccggatattcgctggttaaagttgttaatggcgatagaagatttctagctagcaatagaggcggcgttctgaatcaaggaattaagatttcagatgacaaggactatattaatgcaatggatttaattcatttaagtgttaatggtaatggaaaagaaataattaattacattagtaaacctaaaattgtctatgactattccgatttctctaatgagaatgaaataactttgactattgataatgtagatcttgcttgtttctcagtggggaatgtaagtaaagatagagtagttgaacgagcaaggcagcttcaaagaatgggaaattatcatactattctactatttactatgggaaaacaaggggcaatggtttttgcaagaaaccgttgctattaccagccggctcaactgactaatcatatcaaagacaccatgggtgctggagattcttttattacttactttagtacaggcttgctaagagaaaattgggatataagctctattcctaatattttgaaatcagctagtttatttagtgctaagcaattaaaaatagatggatcactaggagtaagttttaatatccctggtttgcaactaaaagaattatgtaaggagaggtaattatggaaaaagaaacaactcgtcaagaagtacaagaattagtaaaaaaaattgttgatactaaagatgttaagtctttagtgtttatgggatgtggagcatcttattcagaattatttggcgcatattattatgcattacaaaactcaaaggaacttggtagttatttgcttgaagcaaacgaatttaattatgatgttcctaattattttggagaaaatacagtagctgtcatagcgtccctaagtggtacaactaaagaaactttaaaagcagtacataatgctaaggaaaaaggcgcaacagttctagcattgacctttgctcctgattcaccactaactaaagagtccgactatgttttacagcataagttttttgaaagttatgccacaaagtcttctaaacagaaggtagctctaacctttgcggttgaattattgcatgcattaggtgaaagtaataattataatgaaatggtacaaggattatcagtagttgatgaggttgccaatgatgcagctgctagtgtggataatgatgcacaaaaatttgcagaaagatataaggacgaagacaaggtatttacattatcatcaggttctaatagaggagtagggtattcaactgctaactttatctttatggaaatgcaatggattacaggagttaatcttgatagtgcagaactatttcatgggccttttgaattagcagtggaagaagcaccattcctactatttatgtcagatggaagaacacgtcatctagactctcgagcactagaattcttgcaacgttttggcactaagtatacggttattgatgctaaagactattggctcgatagtaaaatggatgcttcagttgttgattactttgatccactggtgcttacctcagtaatgagaaagtttgcagagtatctgggaaaagctcgaaaacatccattatcaaagcgtcgctatatgtggaaactagaaaattattaaagtaaaagaagtaccacataatagttagaaaataatctaactattatgtggtactttgctaagttacaaaagaggagatgaattaatctacttagtcaaaaagagaaatgggaaaattgaataaatattttttctaagtggcagattgcaagaaataacttgaacgaatttaatgacgtaaattaagcaggaagatctcgattggtgtatgccaattaagacatttaagtggccgtgaattcagataccaattgatttgaaccagttggtaatcacttagttcttcaatggcttgtcccttgggaataaaccgtcacaaaactcggttacggttctcattactaccgcgttcgtgcggtgaataggcatgggcaacttgttcaggggaccacttctggacttgaatcttttcctcaatcaagtgcttaaggcttttagtgagcgaagacttccgcccccgttgactaaccttttgttcaaagtcagtttgcgctagctcagcctggtactcactatttagccggtgaagttcgttaatgatggtggtcttactaaagcctaagtagttagcgatgtatcgcaaggaacgtccttcactatgaagcgtttcaatgacaacacggttctggaatgataaaatagtggtgcccatcaaggtccttctttctaatggaatgttgaggtaacaccattaaagaccttgatggttttttctgtccacttaaatgttcaacttaaattttacaatctgctattatttgaaaagttaagcaaatcgattctgtaaaagcaatgataatggacttaaaatgcatttttgaaagcttttaaaataattgttgacaaatccactagctagcgataaattaaaatacaattaaataatgattataaaaacacgttgaaaagaagagtagctattagcagatggcaagagagtccccgtttggtgtgagaggatgatttacttatagtgaaaatcactttgagtgccaggatgaaagatagtaatttctggtgggagtagcccattatagctaccgtgtttaatacaaagagtattgaacatttgaggctagtagtgtgaactactggcgaataaaggtggtaacacgcagaagcgtccttagattaagcaattaatctgagggcgcttttttataatcattaaatttagaaaacaaggagttgcgttattatgaaatttacaatcgttggtgctggagcaatgggactccgctttggtgtattattacaagaagctggaaatgaagttgattttgttgaaggctggcaaccacattacgataagatgaaagaacagggtggtgtttacgttactcgggaacaccagaacaaacatttagttcctgtaaatgtatatacccccgaagaatacacagcgacagacgcagactttgtattctttgaattgaaacaaatgcaacttgatgatatgttgcaacgttgtaagcatttctttaaggatcaatatgtcttaacagcaatgaatgggatggggcatgttgaaaagttgttgaaatacttccctaaagaaaaattagttgcggggaccgcattagttgccactattttaactggtcctggtgaagttgaattcgttggtaagccagggatgggaactaccaactgggctaactatactgaaaagcctgatgcaaagactgaagagctgatggctgaattgaagaaagccaacttcaatccttcattaaaagataatttcatgggtactttgatggctaaagtagtctttaactcagttgttaataccttatgtacaatgtttgaaatcacaatgggtgaatatgctaactttgataaggcagatgaactttctcgccaattaattgatgaagcatacgatgtctgtgaacgggctggtgttcaattggttaatacccgagcagaagaattggaaagtgttaactacgtatcaaaagttggcaaccctcaccactacccatcaatgtaccaagacatgagtcataatcgtcctgtcgaagttgactacatcaatggttactttgctaaattaggtcgtaaatataactacgaagctaaaacacatgcttttgttactaaccttgttcacttggctgaagcaacaagagaaaagaactaagactaaaccgttaataatggtagccaagctactgatagcaacgctactaacaagccaaccattgttttgcctactaacggtaaggaaagtggagcagctactcaaggacaatacatcaacgttgttcctaaggatagcgttgcagcacaagcaggcattcaagcacctgcagctccagaaactaccagtgtaacatttggtactaaggaaggtaccatgatgactcgtgaagaatacaaggcacaacaagctaacttgccacaaactggtaacgaaaacagtaaagcggttgttgctttgggcgtcttggctggtatgtttggattaggcttagcaagtaagggtaaaaaagaattttaattagtatatatttgttctgacataatatatccgttattaaagcaatgggacttctgcttgatgttctttcacaggaatcccattgtttttttatttagaaaaaggattacgtttatgttgcaacgtaatccttttgaattattacttattctttttcttgtccttattttccttttcttgctcttcaatgcgtcgcaggaaagtgcgataatcttcatattcgcccgcactaagatgtttcacttgctcgtcaataaggtctctcatataaccacggataaacttgtgccctgataccattactaatgccttaatctcgttctgaacgtcgatgtcgacgccaatgttaccgtgttttttggttattgttttatacattgttattacctctccttattttttaaaattatccttaatctcaattgcgttaagaatattcataaaattgtttttatcagtaggatttaaatgtgctacttctttatcaacaattttgcttaacagctgtttttgagttaccttttggatactagataacgcaattaatttgtttcgtgtgacgttgctaacactaactgaagttgtgtaattttgattcttcttagtcatatttgttttcctcctttactatgttctaataaaaaaattttttgaaataatttttttattctatgaagcttagctaaagtaggagatactaaaaaagctattagcagagactaaacgaaaataagctatgaacgttatttgatatgttcatagcttattttttatgattttattttattgttactatttattttcttgagccttacggttactttccattacatgccaacaataattaattgccttagtatattcaacccctgtacgattgtagatattagtaggtaaatcatatccataataggtgcataggttatctatagtgtcagaagcatccccagcaactctaaagggatcggctaaatcatcgattcttttctttgataagtcaatgccttgtttttctaagaaaaaagtggatgaattgaaggtaattagtttactggccttattaaatattgactgtatctcgttcttgtaattgctaaatggttgctcattataggtttcctcaggcttgatgccatttaagtcagaataccaccaatctacaagcttggtattaaatgtatgattgaataatacattatcgttagtgtccatgatagtaagcctgactatttcatctagagctgcaggtccagtaagatctacccaatatactagttctctattcttcattgcaaatcacctcgactggcatcataactctgtggcgtattaataggctgctttctgttattgatttgccttttaatcctgtaaagagtagattttgaaaggtgaaattttaattgagttgcagcatatgtgtgtgattgcaggtattcgtaagcttgacgataaatgggcgtgataacgcgtttatggcgtcctcctgtattcagcattgattgatacttagccttcttaattgccttagaagcacgtttctggcgcaaataatgtagatagtcaaggtgggctaactgtgatgcaatgatccaatcactgctatcactatcactgcttaaatccatatcgctagattggatgataatacctgtattttccactatgtacatcaaacaacatagttctctaatgttgctatatagacaagttagggtagggactactagtacatctccttcttgtgcgactgttgttagaaatttaaatagctggtatcgctctttattgttttgcctaaagacatcagcaaaacagtgatcgtatggtatacccatacttaataagatttttgcttgatattcaaagccgtcttgtttgatgacgctatcttttagccagcctgaaacatagccatattttgtcatatcatttcactccttatctatttgataagagtaatctaactaaaaaaggctattcaatttcattttgagattgaatagccttttttagttataaataccaataatatggactgatgatgtagtatgttttcatttccttgtttgtgctaaggcagtcttaatatgagaaagtgtcattgaggtgtcaaataatgagtgaaagtaccatacttttaattgaaaaaaattggagaaaagcaagggtgttagtaggtggtatgaggttgtgacagaaatgggtcagatttgggttggatattgacccctatttatggcaccaaggtaatccttactgggagtaagaataaagtggtttattaattgtatttctaaaagaaggtgtcaagtagggaaattgccgtaaaaggttgatttagagggatctataaaggtattgtgtcagaagtgccaattttattctatttttttaagttctaactaagtatcttaataaaataacaattaatttattcattttgatttaaacgatagatattatttaaagatcctaaatgaaaattggcacagatgacacacaaagcacataatccctacttactattgactttacaaccacaaccataaactaacaccaggggtcagcttttacatcaactattttcaatttgtttctttattctttgcaatgttgaaactgaaatgttaaaagccctggccgtatccttataagtatggtttgaaaggtagtcatatgccgcttgatagtgaggtgtaatcaacctttttggacgaccttcatggtagtctctcttatggagtctagcataacgttttccttcttgagttctatccactatcatgtcacgttccatttctgcaacagctaaaagaatagtcttaaccagcttaccaattgtagagttttcaagtatgcctatgttgagtacattaaatttaatgcctttgctcattagtggatcaagtacatttaacgcctctctagtatttctagctaatctatcaagcttggttactgtaatagtatcaccatttcttactttattagttagttcgtcaaacttaggcctgtttgttgttgttccagtaaatttctcagaataaatattacttttgtctatacctatttccattaattgacttacttgatcgttaaggctttgccctttagtcgatactctggcatatccatattcagtcatttctattaatcccttttctgaataaactttatgaccacaggataactccgttgtttagggattggaagtcttgttcaaatactcaaaagttgatgaacaattaacgtcacgtacctactttataaaaaaacgaaaaaaatcaaaaaaaatatatacggtaaaatgtataaaaatccattctatattaataaaaaaacgtgttcaaacaccgttagatgaacacgtttttgaatttatttaaatttcagcaaaagtgcatacttattgcatatataagtaattatataacatattatattcgttgtcaatagtaaaagcaaaaattaatttgatttcaataaaattatgtgttttaataaaaaatgaagcgaaggaaacaaaccatcaaaaaaacgtttccttcacttctgtcaaaatgtaataagtaatcatgacgaaaacttatcttaatttgcaataagaatgtaacgcttcatttaaataccctttatataaaaaacgttctacattcatactattagtatactctaattttcgagaaatagcaaataattaaagataggtcccgtcattgaattacttattaatcaatggagggacatttttatgttatttaataatcatggatatgtaggtcaatcgcgaagtgtaaggtctcaagaagctattgaagagcatgaagtacctttaaatcaaatcacccgtgacttgattaatgaagttattgaagaacttgttgacgaggagacaattgataaggaacaagaaaattggctaaaagccattcccgtatatgtttggaaaaaccaaagcccaaccagctggcatcatacaggtaaatattatcacgaaacctatcattatgatcttccactctatgctgaagaatttatcgatgatcctgaaattgttgatgaaagcgtcaaagagcataaacgagaactatctgaacgtaggcaagcattgcttaacgaatctactgaacctgaatatgaagtatattattattctaaggatatttggggaggaacacgccggcatcctaagattgttgatatcgaacatggatacggtgttgcaaagaaagagagcagtcgtttatatcccgtttcggtaagtgatgaagattggccaaataactcctattattcgataggtggaaattatattactgttaagcaatatagtggatatttagaattagtcgctaagcatcctgaattcaaaggaactaaaaggaaactaaataaagttctcaaagcattaggagtaacccctttaactttaaaacaagaattgtcgaaagttggaggtaataactaatgcctaggcgaaagcatcatcataaaaaagataaagtatttttctttaaaagtacccctcaatttttgaaaatggcagaacttgctcacttgaacaaggaatttaatcacaaaactaatagtaaagagtcaattaagctactgccaccccagatttctgatacagttattaccaatgggggatcccataagagtcagcaggatcgcttaaattttactaataatgggatttatgcatacagtaagtgcttagcccaagacgttgtacaaatagatgttcattcattgctcccaacatgggcctttaacttacggctattggatcataaacataaacaacttttcttgagaaaaaaagaaatcgaagcaacacctaattatatagataataaacgcctggtaaatgaacgaaaaagagataaagacaacctcaaccgcttttgctcagagaatggaaaaacaaagaatgaacagtatgttaatcgactgagatgtacgtatagcggaatgaacatgatatacgatatgcttcaattctggggtttagaaaacgtgattaattgtgttaatgatggatttattatcagaataaatacacgaaactttgataagaagtatcaacaatttcaacagcgttatcaaagaaaggttagtcaattaactttttcaatgaaaaagtggaactatgctttaataaaaaacgatcaagaatacttgttatttaattctttaacagattataaatgtcgaaatcattgttttgatgttggagctaattattatgaaattactggtgaaagtctaagagaagcaaagaaaaataaccatgttaattctttaattttagctaaagcagaaaaacaagaaaaggaggcagtgtatatagtggaaaagcaagtatttgaccaagatccttttaataaagcaacaaaagaaaacatggaacgacttgatgaagtaaaaaagataatgaatgaagctggaattcaggacatcaatcatggtatcttgcaacctcattattataggtttgaacttgataaaaatgatagtcagcagagtaaagaatacataaataaaattacaaagagtatgttgagcaaccaaatttttatgctcgaaaatccccctgctagtactgttaatttattcggtcaagtaataaaggcaactgaaattaatgatatggagcagtatctcagagatcataaagatgtaactgttaatgattttgtgcctccaattattagaccagcaatagtttcaattgatgactggattaagcagttattgaatgacaaagagattaaacataatctctacctatataatagtgtagcaattgtgttgcaagtatgggcaaatgaaaatagccgtgatcctaataccattatcaagaagttaaatgatgcgttagttaaagatagatttagcaatctaagtattgcagataaagtgtataacgatcctgcaactatccttgttgataatcaattaatggcattaaacgagcatcatgtgtacactgcagattctaaagcggtaaatagcattattgacaaatatattgatgcaagcggaaaaaggtttattcgaaactctcgtaataacgtgtacgaactccttaataataataagtataaaaatggcaaattagatatcggatttaaatctgagaatcagacaatctggattgacaataaaggcgtccacacagaaaatccactgcttaagaaggttggcaattacgtaaatgttgattatatcaattatgaagcagataaggatttatttaactcagaagaatatagtcaagttgaagcattcctaactcatataagtgatggctactataggcaaattacatgtatgcttgctctaattgttttacaagaccctaatattgttccaacacttcgcagggctttcatattgtatggagtgcctgggtccgggaaaactgttttagctaaactattatgcaagatttttgatgaaccaaataagccgtcaagaatactatgctctgaaccaaatattaataaagtgtttacggatcctaatcttattgatgctaatgataccaaaaaagggaaattagtattgtggtttgatgattttcagtctgatggtaggtcgaatgaaattaaaaggaatgttggaacggtaataaatgcagtgactagcaatgaggcgaaaacgggagctgcaaaattccaacaatatcacgatattaaactgccttcattgattgtactttcaacaaatgatgtcccacaaataaaacatattgggactgttgataggatttttgtcataaaatcatcaaaaaggttaacagacgaccctaatattagttttagttccaatatagatgcgtggataaataataagaaagttcaagaagcgttcttctgcataatattaaataccgctgttgatatcttaaatatgagcaaagatgaagcaaagtctatttttgacaaaagtaattccgctcaatcagcactatcaaaccttaattcgtctattgaagctttttttgaggaacaaaatattacaagtctttatgatcttgttggaatgcaagcaaagaaactttttgacgtttatttagaaggagaaaaaaattttgcttatgcaaccacttatcgtgctttctgcgatcaaattgagggattaggtttgaatttaagacgaaagcattttaatcataaaaactatcaaaaagttatctgctcgaaaaatgataatttaacgcaagaaaagttgaatttaatgttaaaagaaaatgaactatctcccgatcaagttgaatattgggataatgagattcatcgtcaacgaggaaaggttagttcgtggcattgtggttatgatgaattaaaagagaagtataaaaatgatcagaaattatttatgccatttgaattttgaattaacgattgaaggggatttacgtgaataataaaaagaactttaattggcaacaggctattaatatgaacaaggatatttttttggaatattttgctcaagcaagtggattaagtaaggctaaacgtcaaccaattaacctaatggaagaagaacataggattggtgtttacttttcatccgcagcatatcttgaatggttgaataagattaatgatatgaaacatgaaattatgattttaaagactaaaaagtaggaggaacttattatggaagcaaaagacttaatcggcaacactctaatcaaaaagattacaaattctaagggcaacacttggaaaccagtattgcgtcagcgatgggttggtaaatttaaaggattaaaagaatatagtcgctcatcgctgaaagataattatctaattttagaagtaggcggttactttgatggccttatttttaacccggacccatttattgtagtggatggaaaacgaatttatctgagttacgaaaattctattccaggcttatgtcgaatcgtactagtggatattcgagctttggaactctcaaaaaagtatgattttaatgacaaatatcaaggattcgactctgaacgtgataaatatcatattgctaaattcaagtcctttgacgaaatgaaaaagattgcgaagaaacaatactcaattaataatgagttgccgacgtatgatattaagatggtctgggaacaggataaaactagtgagacatatggtacacggcattattccgtcacgacaaatgtaggactttctgaagaactagatgaagaacttttgaaagcataatattcattcagaattgcaatgtgcagagttataatccaatccataaggaggccattattcatgtttggcaaagaaattttaaacggaaagcagctgtgtgaaaaactaggcgtaagtaccacaatcttgtatgaattattagataatggactaccatttcatcaattaacaacggcaagtcgaaaatactataacctatcagaagtcgaaaattggctgctaaatgcaggatatcgtcagaaaacgatttggacaaagtaactatagataataatgatgggggtcatgctttgtgctgaccccattttttgaaggtgaaaaaatgattaagaaaatgacaactggtaagcacaaaggagagtaccaagtgcgcatccagccgattaataagattactggtaaaagggaaagctggccagtagattacgcttctaatcgtaaaactgctaagtcattagaaagacagatgtgggcagattatgaggaagggttgcaattagctgacggcagtgcgatctttgcagatgaatttcaaaaatatattgatgaacgaaagaatacgatatcacctgttacttaccgtgactggcaaaattcagcaacggaatttaagaaatattttaaaaagactaagataaaaaatattactgaacgattggttgagcagttcgctcacgactttattaaacaacataaggctactgtaggacgtgctactgtaattgatcatcgcctgacccatatgcgaagtttttttaaggaattggaaggtaaggtagtaaagaaaaatccagtacccgagcaatatttggacaagttttttcgcaaaaacgaattcagtgttggtaagcaacgatacttattcacaagcactgaacttaaggctattaaggctcaaatacaaacggagttaaacaatactacaattgctaattggggcacccgtttagcgatttggattgatttggaaaccgggatgcgtccaggtgaaattcaagccttaaaatttaaaaatattaccacggaagatggatattctacctttaaaattaatgatagttggtcagactatgcgcgtaaattcaatgggacacttaaagcacgcccaaagggatactcacgatattgtttacctatctctcaagaattagtggatttccttgtcacataccagcaaagacaaaaagaatttctaaagtatcatgatttaacgaatcctgaggggttgctctttctcaacctacacgattataggaagtgtgtaaataatattcccatcactcagaagagcatgaacgaaatgttaaagaaaatttgtaataaattaggtattcatagtgatggatcacaattatctatgtattcttttcgacatacattatgtacaaagttagcgaataaaccaggaatttcatatccatgggcatctgagcgaatgggtaatagtctttcaatttttatgcgtgtgtacgttaaaacagatcgtgacatcgatcgaaagatgatggataattggatgaaataaaaagcaattagtaattgaacgtgaaaaaaatatctattttttcggtgcaacaaatgaattatcggtgcaaaaacagtcaattttgcaccgataatttttaaattgcactgataaattggagagattgggttaaaataataaagaataattttgataagaaaggagatgaaggaattgaaagtttttaactaccagactttaaatgatttaagattaactactaagatggttgaaaaactcaatcaaatctatgagttaaaagggaaaacagcccatgtatccttaaaatcaaaagatattatggataaattattagcggtagcaaaaattgaaagtacagacgcatcaaaccgaattgaaggtattgccacaagtgatgcacgactaaaaaaacttgtaagccaaaaaactactcctgaaaatagaagcgaggaagaaatttcaggttatcgcgatgttttagcaaccattcatgagaattttcaatacattaaaattacacctaacaacattctagcgctccataaggaactgtttaattttactgaaagtacgtggggcggtgaatttaaaaatattgataattctattgtgactacatttgcggatggtcatcaggagacgagattcactccaccaccggcttacttaactcctgaactagtccaagacttatgcacggcttacaataatgcaattaccaataattcttttcctcctttaatattagcagctgcctttatgcttgattttgtttctattcacccatttagagatggaaatggacggatgtcacggctattaatgttgttagaattacatcaattgggttttgaagtcggaaaatatattagtttagagcgcttgattgaaaaaacaaaagctgaatattatcgaactttattagaaagttcaggaactgcttggagtaataatgataatcattatggcccctatgttgattactttttgagcatcgttcttcaagcatatcgtgaactaaatacacgtattgatttcactaatgatactgaaaaagatccagaatcattagtgcttactaagttacgtaatagtttaaaacctttatcaaggcgtgaactgatgaacttaattccacagtatggtgagagtactattaagcacgtattagcagaattacgaaagaagaacataataaaactggttggtagagggagagcaagtcgatatacagttaatgactaatcggtgcaatttaaaagttatcggtgcaaaattggctggctttgcaccgataaaatgattattgcactgaaaaatgcacacaactagacacataaagtcaaaaataattggcttaatcgttgatatctcaatggttggagcaatttaacctccaagcttctagtcagcactagaaacatactaaaagcctataacaatacgtttttaccgtatttgttataggctttttatgttagtttaaggctatgatttctcacttttttcacatgttttgaactaaatgatatcctataatttttatgatcacgaaaatggttgatatgatagtatttgtagtcatttaaacgtgtgaaaaaatgtgaaatgccagaagaaggtattgtaagcaattatacttcttcttcccaacaatgcgtccagaaaaggaaactaaagatagcaagaagggcaagaagaaaaataagaagtagcctaaaaacttgctatgacggcttttaagcgacttcgtggatttaggctaaatcagttattagcttctaaaaagttagtaactgtggtgtgtgtacaccaaaaatacaccaaaaatacaccaaatttaaataaattaagttggtaaaaagctggcataaaaaatgaagggctacgattctctatttgggaatcgtagtcttttgtttaaagctataattgaagccttaaagtaatcagtaatatttgatgagaggtcaaataacccttgttttagcttactttattggttgaacgataaaatctgttactccattaaaaaagacctgttagggcacgacaaggcgaattacaagggctgcgctaatagatgcgaaaatgaaagcataagataatggcattttggcaatcttaagcctaagccaactcagcaaaagtaacacgtttgtttgccacggtgaaagcattcaatgtaaaaactgggtgtttttttattgagcagttaacgtttataggatatgaacaatgtcaatagtattattaaattcctattattttgtataattagtatagtaattatacaaaggaaaggaacggatttgtaatatatggctcggcttgatcagaaatctatagaacaattaggaattaataaagtagaggatgcactctggaacgttagagactgggctgatttcttttttagtgaaaatgataagactccgctgttagatggcaatatattaatttatagtaggcagattgcaagaaataaattgaacgatttattgacgtagattaagtaaaaagatctcaataggtgaatgccagttgagccacttaagtggccgagaatttaaataccagttaatttgtgttagttcgctgttactcaactcttcaattggctttcccttgggtataaagcgtcgtaggacccgattacggttttcgttactaccacgttgatgtggtgagtaggcgtgggcaaaatataccggtgtaccggttaatttctcgattgtgtgaaagtccgcaaattcttttccatgatcaacggtcagcgttttgagcttgccattaagttgatgagctagctcgacaattgcctgcttcattgattgactatcacgaccattaaggcgtttaacgatggtcagacgactctttcgttctacgaaggtggcgactgcttggcctttgcgcttgccagagagaaccgtatcagcctcaaaatgaccaaactcctggcgggtatcaacactagcgggccgttcttctatggagcgcccgtggctaaaggtaccacgcttttctttggctcgatgtctacggataccatgatctggtaagtccttgagctggaggtcaagtaatccttggtcaatccaattgtagattgacttataggcaattccaaccacatgcgcgacctgttcagctgaccatttctggaccttaattttctcttcaatcagttgtttgagattagtagttagagaagatttgcgtcctcgttgagtaaccttcttttcgaagtcagcttgggctaatcgagcttgataagcaacatctaaacgatggagctcattgaagatagtggtcttactaaagcctaagtagttagcgatatactgcaaggaacgtttctcgttatgaagtgtttcgatgacaacgcggtctgaaaatgataagatagtggtgcccataaaggtccttctttcaatggaatgttgtggtaacaccattaaagacctttatgggtttttctgtccacttaaatgttcaacttaaattttacaatctgccactactaaatgtgtactatataaacacgtatttctgatgtaaaaatgttactccagtaagttaaaaacagctattaagttatctaacctttaaataaaagggttgataaccatggactaagacgacagcagggtatcacgcaggaacagcttgctgagatgagtgacttatcacttaattttgtttcaaaaatcgaaagaaaacagaaacagaacattatcattaaaacattgatggctcttgcatcagccttaaatgttaaaccttcagatttgcttaagggtagcaagggcccagccagtaatcgtcgtaagcatgtggatctgcttagtaggcagctatataagttacctgaaggtgaataaaaagcttcctatcgggacttactgttcaacccagcattaaacttaatgcactcttttaacttcattaccccgctccttttaatattctcgttcaaatatttaatcgcaccattaagatactcccgtttaattaccgttttaagatattccaagcgaaatatttaaaaatattttcgcgtaaatatcatttaatcattgcgtttaaatttcatttaccaactgcgcttttcccgtttcaacttcaaaattaagttcaaaactttcccaattccgatctttgacacacgacatatttacagatatgcgcaaaagtttgtcaaaaacaaataaataactttaattaagcttgatatttcgccattatcgcgcagctaaacgcttatcatttttagcgcttcgtgattgcacatatttttagatatgtcgtatctcaattgccagattagaaaaaaacgcttgttaattttgttggcgggtcgctcggttacaaaggtaatcacacccacccataaaacgagtgctttgttctacggctataagccggtatgtacagctaacgcctcaaggcactgacttgtcttgttgttgacttgaccgctttacgaaattaggcagcctcgcgcccgctgaatctcgagccttagctgcctaatcgttgacatcattcaattttttcttgtttaatcaatgtggataaaaaggccgatcaatatgaaaagataatcaacggtctaaaaagtcgtcgtgcaattaaagaaaagcatcttcgggctgatagtaagcaactcgagcaattgagcaaacagattcgttattactcagcccgtcgggccaacttgctgacggaacggtatcgccaaattgctcggcagttgtttgctgagtatgagctaattgccattgaaaaactcgatgccaaagaaatgcgcaagaagaatcagaaagggtcaggggccactaatcggggtaagaaccgtaagctggcgaaaatcaagccttacgaaattgcgttgcttttagagcaaatggccgatcgtgaaggcaaaaccctgctgaaagttgatagttataagaccagtcaagttgaatttggcacacaataccaaaaagtggtgagcgtcaatgggtgtctaagcacactggaaaattgattgatcgtgatttgaacgctagtcgtaatattttaacttgggcccttgatcctaagaagcatattaagtatctcgaacgtcaagcagcaatcaaagctgctaaaaaagctggaatcactaaagacaagttgccaaaagcgattccagccagagtattagttacaacgaattaattaacgggcgggacagaacctcgccgtccgtccccaaaggttttgagagttactgttggcgtatcaccctgagcgtgcaaaacgggtgcgaaacagtaattaagatcaacttgatctcaacggcgcaagccgttgcattgcctaaacgttttctgagattgagcggctcttagcagccttttgatccagaagcgcggtcatttatgactgagtagttcacgccagcgaagttagcacggtgatcatgctatggattaaagggggaatggcagaatccagtgccgaattagcccaaatgttagcagtcattcgtgatcatcccctcaaagaaattgtcggcccggcccatgaataaatcccagaaaaccaaaaattaccgccaacaaggacggtgatcggcataagagagaaagagaattgattagaaggtaaatacttaataccttgtgactatatgttagcgtttacacatggatttgtcaataacttccccgattttatttaaaacggtttcattccttggcttcttgacttgcgcgcctggttatgacctagcgtaggcgaaagggcttgatcagggtccgcagtggggtgtggtccagcccccagactactacgtagcccagcaccaggccggcccagttggtaatcacatcgtcaatatcgaccacccgcaacgtgtgaaccaaccagtccgaagcaaactgggcgctttcaatcaccagccccggcacgagcccggccaaagcaacctgccaccacgaccagtgcggccgccaaaggtagcagtacacccccagtggcccggtcagcaaaatattggccaaaaattccgggtcgacgtggacgaacgggtggaggttatacggcaccatgtaaaaatacgacagggccttgtaagaatctggcaggatcagcccgaccggggcaaagaccagccaggccaccaccattaagtagcccaggctggtaaagactgtcacccgctgggccggcgtccggtttggtaccgccagtagccggtaataccccgctagcaaaatcagccaagccaccccaaacgtcaaccaccgtgtctgcaacatcaaattgccctcttctataaatagttctagcttaccgaacgcaaccggacctgaccaccgttgatccccaagcttaaccagaacttaatttcccagcatttcccgggcggtcgccaccaggggaccaaattcggcggcaaaggagctttcctttaagtagatcaaattcaagggatgctcgagcggaaagccggccagcggcaattcaaacaaatcgccccgggccaattcgttggccaccagggcccggtacataaagctgatcccgaccccctgcttaagtaattcaatgatcgccgtcgggctgcttaaggctaaggtctggcgaaaatcactcagctgggcgttgtgcgccgccagccaggtcgtcaaaatctcgcgggtccccgagccggcttcgcggacgatcaaaagctggtcaaacaaggctggcaatgtcgctggcgcctcggcctgggcggtcacgccgataaagggcgcactgcccaacggggcggcggcaaagtcctgccgcgaataattaccctcgatcaaggccgcatctaattgaccggcgagcagctgctgggacaggacagcggtattttcaatcgtcacttccagctggtagccggccgcgatcaccttggccagcagctgcggcagtaaaaaggcccccagcgagcgggtcgcccccaagcgcaacggcggggtctgggccaagcggagccgctttaagaccgcctgattgtcctgcccgagccgtttagcgtaggccactagttccgtggccgccggcgttagcttgacccggcgcccgtggtggaccaacagcgggacatctagatcggcctccaggctggccagctgctgggagacggccggctgggtgataaagagctgctgagcggcggcggtcaacgagccggtctgcgccaccaccattaaggtcgtcaaccggtggtccagtaaattttccatcgccctgcccctttcataaggaaaactaacttacaagaaagaaatcataatttttatttatcagtctagcatggtacattaagaatgtaaaaaaatccggatgtcaattcggaaaggagaaagtgaaatgctcaagaagatatttagctggccctttgcttgcgccgcgctcttaaccttaatttgttcgctggccggcagctacctggccaccctcccctacctcaaggtgattggtgccttagtgatcgccctcttgttagggatggtgatgcaagttggtcgcccggtcctggattacagccggccgggaattggcctgattgccaacaagttcctgcgtctcggaatcatcctgctgggctttaagctcaatttgattgccctggcccaagccgggatcaagacgattgccctggccgtcgtggtcgtgaccttcacgattttagtcacctaccagctcgcccgccgcttcggggtcgaccgccacttagcgatcctgaccgccagcgggaccgggatctgcggggccgccgctgtgatggggatttcatcgcaattaaccagcgatgacgatccagccaccaagttgcgccaccaggaaaatgaggtggttgccgtagcgatcgtggcgatcctcgggacactctttaccctgatcgaaatcgggctcaagccactcttgcacatgaccgccctgcaatttggggtgatgaccgggggcagcctgcacgaaatcgcccacgccgtcgccgctgggagcgccgggggcccggtcagccttgatacggcgatcatcaccaagctttcgcgggtcctgctcttggccccagtcgcgatcttagtcgggatctggtaccaaaaggcgacccggcaagccaacccgaccggtgaaaagcagccggtgccgattccgtggttcatgctcggctttatcctggccagcgtggccggcacctttatcccgggcctggccgcgttggtaccaagtctggtcaaattagcctacctgctcctagggatggcaatggccgccttggggatgaacgtgaacttctccgtgctcttcacccgcggcaagaacgccctcgtggccgccggaatttcttcggtgttgctcttgatcctggtcgcaactttgtccaagaccttcttttaatccgtaattaaacgctaaaaccgccgtcttccaactcccggaaggcggcggttttgtttaaatcatgcgtcattatctgacttcaactccgtaaattgagcatctaatttagcaataatttgagcgcgtaacgtttcgatccgtttggctactgattcccacataaatttaccattagatcctgatttttgtatgtacctcgaagaagatgatgaaacaaggtacagagctgagtcttataatttaggtcaattcaggctaagtatgtcctggaataaattgatacttaaatataggaacagaactattgatgagttacttgttgtattcatggatagtgctactttcatgacagtcactcctagcctaggttccataagtcccatgtctaacagtgatatgctcacattccaatattacctagctgattcgctagatttcgccgttgaaaaactaatactaaatatgaagagatcatcaattactcctaattataatcaacaatcaaaactactaaaaagaattattatttttaagaattataatcagctaaagcaaattaaatcagttttgcagaagcaggatgaatacatcaagggaaaatgcgctcctacaaaagaacaattagaattatgtagaggcgcactttcaatggatttcggaaaggatacccctgaaatgaatcaagggcatatcgaagttatgtgtgaagaagcaaacgtcagtcaattcataaataattatttacaatcagagatcattaacaataaacgttctcgttgattatcgtacaataccccttagggttgacggcactttaaataataaaagcgctgatcctaaggggtattgtacgactgacgaacagaggtaatttttactaagcgacgatcggttgttatcttttagagttattcacgtttaatgtagtttgaaaatgttttctttataacccggtttgtaaaattaagttagaaaaacaaaaaagccatttgtgatagacttttgagtatccctaatcaaaagaaaggcaatcataaatgacctacaaacatcttaccacacgtgaatcaactctcatagctgaattttatcgtcaagacactcgagcttatcaagttgctaaatcactaaggcgtagtgctgaaacaatttatcgagtttatcgttacttggatacgggcaagacaattgcgcagtatttaaagcagtaccaacggaataagcgccgttgtggtcgtaaaccaatgacgttacctgatgatgaagtaagttacattaccaagcaagttagtcaaggttggacaccagataccattattggtcggtcagagaagaaaatcagttgtagtatgcggacactttatcgcatgtttgcccgtggtcaatatgactttgatgttaagcagttaccaatgaaaggtaatcgtcatccaaatggctacgttgaacgacgtgggaaagctggccatcttggtcgcagtatttaccaacgttaccgcgattttccgcattaccaacatgaatttggtcatttagaagctgatacagttcaagggaaagctcaccatggcgctgtgatgaccctagtagaacgaatctcaaaagttgagattgtcttgaatgtccatcacaaaacggtcgaaagtgtgaactattatttggatcagtggctatcaaaacagcctcgtcatctttttaagtccattacctttgacaacggtaaggaatttgcgggctggcgtgagattgccaataagcatgatatccatacatactttgcggaagtcggtgcgcctaatcagcaagggttaaacgaaaacaccaacggtattcttcgtcgtgatggtctgagtaaaaagaaagacttccgtaattgctagggcttcttttagtaatgaccaattaccaacaaggttacattctgctttatccataaatttgcgggaatacccccacttctataagtaggggatgaatcgctctcttaaagcacgttagtgctttttcttttgttctatgatatatttagtatatatctataaaatgtggtgataacaatagaattagatataaatcagcattcagtatacttacttaattaccatttggtaatggtggttaagtatcgtcgaaaagtaattaacgatgaaatatctgaatatcttaaacatcgttttgtagttgtgggacaagcatacggcattaatttgcaagaatggaatcatgatcaggatcacgtacatgttttgtttagagcaacgcctcatacggaaatggctaaatttttaaatgcttacaaatcgtctagctccagaatggtcaaaaaacaatttccagaaatcaagcaatatctttggaaatcagccttttggacacaaagctattgcttaattagcactggtggagcgcctttagaagttgtaaaacgatatattgaaagtcaagggagaaaataatggttctaaaagctgttaaaatgcgcatctatccaaattcagcacaacgaaatcagctctggcaaaccttcggttgtgttcgttttgtatggaatcaaatgcttaatatgcaaattgaacggcgcaagaataatccggaagctaaatttgtgaatgcctttgggatgaataatctgttgaaacaacttaaggttgagtatccttggttgaaacaagcagaatcaactgctttgcaaagtgctaatcgcaatttagccgatgcttttcaacgcttttttaaaggtcaaaataagttccctcgatttaaatccagaaaatattctcagagctacaattcaaagtacgttaatggcaatattaaagttttagattgccatcatataaagttaccaaaactcggtatcgtctattttagagctggtcgattgccaatgggtaaaattaagaatgtcactgttcgtctgaacgttgctggtcaatattacattactgttttagtggaaagcgaaaaccaaactcttcctaaaacaagtaaatatattggtggcgatttaggacttaagtcgttacttaatctttcagatggatgcaaggaaccgatcaatcattttgaagacaaataccataaaaagttgtatcgttgggagaaattacgtagtcgtcggttcttaaaggctcagcaggaaatcgcctgggatcatcataataaagtgttagttccacggcaattagatgattttaagaattatcagaaagctcgtattatggtggcgaagtatcggcaaaagattgccaaccaacggttggatcagctacaaaaattcactactaaattggtcaaaaagtacgacatcattgtgttggaaaaacttaatactaagggaatgatgaagaatcaccatttagctagagcaatcgctaacgctagctggtcaaaattagtagatatgttgcaatataagtgtaactggtacggtaaaaagcttattcaggtcaatccgtcgtatactagccaaatttgtgctaattgtgggaagaataatcatcggttaggattgaataaatcggaatggttagcggtacgtgagtgggattgtccaaactgtggtaaacatttagatcgtgatattaacgctgcacaagtcatcttgcaaaaaggattagctatccgatagataaagttaggctcgggacgagccttggctaatagtcgtaacctctgcttgaaggttcgttcagaatcggtagggtaagtatgcgatgtttccagaatctcccacttcaagcattaaaccgtaggtttagctaagtgggagtagttcaagaaaattgcaataatgggcttgataagattacattaactggtgaagttcaagatatttttaaggattaatagttatttccctcatcgactacaagttagcgatgggggattttttaatttagggaaaaggctaattcaatctggagtggtgatttgtgataatcaattatagtaggtcgtttgaaaaacagagaggtgaaggttagtggaacaactctatgaccagtttcaacgaaaaattgattatttacgattatcaataacagaccggtgtaatttacggtgtgtttactgtatgccagaagaaggattgaagttcttccctaaagataaaattatgtcccaagatgaaattattcagttagtgcaaaatttcgccaaaatggggattacaaaagtccgcctaactggtggcgaaccattattacggcgggacttacccgagattatccagcgtattcggcaaatttctgaaattaacgacatttcaattacgacgaacgggacggccttgaagtatcaagcaaagaaattgaaggaagcgggtcttgatcgccttaatatttctcttgatacttttaatccagcagtatataaaaagatgacccgtggcggaaatattaagcatgtcctgcaagggatcgcggcagctgaacgagagggctttaagattattaaggtcaacaccgtagtcgtgcggggcgaaaatgaccaggaagtcatggattttattaattatacgaaagaccacccgatcaatgtgcgctttattgaatacatgccaatcggacaagagattagcgattggaaaaaagaatatgttccgctaaccagcatttttgataagtgtcgcgaggcggggttaacatatgaaccgttatcattgcccggtaatggtcctgccgataactatcagattaagggttaccgaggtagcttcggtttgattcacccaatttcagagcggttttgtgaatcttgtgaccgtttgcgaattacctccgatggttacgtcaaagcctgcttatattggaatgaagaactggatatccgaccggtcatcaatgactttgcggcatttaagaaagtagtgcagaaggcgctaaataataagccgttaaatcatgaaatggcaatgaaaaatgttcatcagattattaatccagcgccaacgtggcggcatatgagtcagataggtgggtaaaaatggcagctgatcaaaatactggcgctcctttttcgccgacggaaaaccgggtaatggatgctctgcagtcggtaattgacccagaattaggggtagatattgttaacttagggttgatttatgatgttcaagttgatgaccaacaattatgcgtgattaccatgacgctaacgacaatggggtgtccggttagtaacgtcttgagtcaacaaataattgaacaagctttggcaactgacggggtagcaaaatgtaagattaacttggtctgggaaccagtgtggaatccaagcatgatgactcgctatgctaagattgccctgggaattcatgaataagtaaaaatatggcgtgcagctttcgtgattgaaaactggacgccatattattatttagattgttggtcaaagatgaagtggccgcttttaccaccgtctttttcaacgagatgaacatcactaatgactattccccggtccattgctttgcacatatcatagatggtgaggagggcgatttgcacgacaaggagggcttcaatctcaacgccggtgacgtgcttggtcttaacggttgcctctgcagtaatactatcctgaccgttattgtggaagtggatatcgacaccggtgagggggatgaggtggcacatggggatcatttcagaagtccgtttagcggccatgattcctgccacttgggcgacagcgaggacatcgcccttttttatttggccatcttcaattcgttgcagggtggttgcttgcatatggatttgtccttgagccgtagcggtacggaaggtaacctttttagcggtaacatcgaccatgcgggctcggtcctggtcattgaaatgtgttagtttgtctgtcatgataaaaccccttttaattggtagattaactttaggatagcataatcgataagcaaaattattcagtgattttaccaaaataaaaatgacatcgcctcaacaatgtcattataaaaataattattcgtttcttagtgaagttacttcaacatcgttatcgtagtttggactccaccaaccttgcttattaatgtatccggatggtaagcaccagattacaaattcaataacatcaactacaaaggaaattgcttgtaagacattactatcaccactagctaaaataacggcaattagccagaagacaagcactccccaaccactgatgccagcgtcaatcttcaatattaacggaatacttttattaccttaagaaaagcttaacaatttagatataaataaaattataaaacccaaaatgtcaatttaagttagaaagaaaatagttgctcatcagtgacgtaagacatgaatacttcatatggagttcgatagcctagcgatttacagggcaggttatttcgcttactcatcagttaggttaccaattcatcaggaagattgcggaaatctagctgtttcgttaagccatcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgccgcgggaatttccgaagccactgacttaagtgttggttaatcgcatcagccgtcttttcgtgcacattgagtacaatttcgaccttcgattggcgttcggtcagggtcattgccgccccttggtgctttttgccttggacggtatcagcttcaaggtgcccaaattcagtggcatagtgcggaaagtccttggcacgctcgtgaatacttcgcccaattggccagccttcccgcggcgctcgacatagccattcgggtgccgcttacctcgcatcggcaaggaacggacatcgaagccgaactggccacgtttaaacatccggtaaagagttcgcaggttacaactaattgggcgctcagcgcgcccaataatggtatcaggcgtccacccctgggcaattttgtcgttgatataagtgagttcagccagtgacaactgagtacgttttcggccacaacgttgcttattgcgcatatagtgatcttgataatcagcaattgaggcaccggtttccaggtaacgataaacgcgataaacggtttcggcacaacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgatcttgtttagaggaattagtgagaaaacctactgactatagataaaaatttatgtccccgttaaaaaatgatgtaaaaattcggggcaagtcataaataatgatataaagccactagtaacacatattaaatgatactagtggctttattatttacattggttgtccagttgagatttcaaagccggctgttacaggaattacttctcccgtgattgcactagcagctgggctagccacaaaataaattgcagcggcgacttcttcgggttcaacaatccgatttaatggactgttttttgcgaatttttgtttatcttggtgaaaaagcggggtattagtcggaccgggtgcaacaacatttacgcgaatattatttttaccgtaatcaattgccattgcccgagtcatgttaataatcgctcccttggcggcattataagcaaccattgctcgatcaccagccattcctgagacagaggaaatattaacgatactaccatgatcttgttcaatcattgttggcaagaaggctttgctaacgaggaaagttcccttaacatcaacatcaaagattttatcccaatcttcttcactggtttcatgaacctcgccgtgaataacgattcctgcattattgataatcgcatcaacggttttaaatttattgagggttatttgcttagcatgttcaacctcacttgatttactaatatcggcttgaataaaagcaatttgtgccggggaatacgtttcgcctaattgtcgttcaacttgcatccccttttcggtatcacgaccgataagtaccgtattccatccatttttaagaaaaatatcagcagtggcaagaccaatcccagaggttccaccactaataacaactgtctgcatatataaaactcctctctaagcttttctctaattatggcatttttggtcagatttagctatttattagaaaagtccttataataaaataaggataaggagggaatataatgaatacagcaaccttagaagcacttcaaaattggcttcatggacgtggctatacattagaacaagtagacgcacaactaattcttaaatatcatggacaagaacgagcagtcattacgccacctgatcgctatcaagtgaaagaccttgacctgaattttaatgactgggttgaattcaataagtgcattcgcaatattcgccattctttagctagtaacgaatagaaagccttttctttggcaagaatacctcctcgtgatagagttattcatgaagggaatatagtccaaggagggatagtcatgataagagttggaataattggtgcttctggaatggcaggcagtgcaatctataaattagcatcgacaaaaaagatttgaatgtaactggaattgttcgaaatgagagtaaggccagaaagatccttggtgatgatgccaatttgatcagtggtgatatttttgccttaagtgataatttgttgtcgcggtttgatgtaattgttgatgcatatggtactagtccagagaatgcggatcggcaagtaagactggctgagaaattagtagttttagcccgaaaacataaaatccgtttaattttcatcctcggtgccggaagccttaaaactggtaaggataagcatctatttgttgatgatattgaaaagatgcctggtgctgagacatggattaatacaccccgccagcagttaaaagaattacagtatcttgaaactatttctgatattgactggctaggaatttcaccatcggcagtatttgaagctggggttgcgactaattatattcttggtcaggatgaattattatttaatgaacaaaatgaatcaaaggtaactgcaggaacaatggcaaagttagtggtcaatgaaattttagcaccacgccaccatcgtgaacgaattaccgttgttgatgcagaatagttattggaactataaaaggcatgagaacgcaaatcaattctcatgccttttaatattagtcaactaattttccaataattggaagttttgaaaccggtgaacactttttggctgcttgttgataggtgacatctgataaatcatggccgaaaacattaccgtggatttctgcgcctttccattctggaacttcagaaacatcataaacatttccacgcaccccgatatatactggacgaccttcttgcccgttatattgcgctaattcattgtgagtaaatgaccgcataataatccctcccataaagaagctgggaattgactcggcctcttcctgtatgagtgtaatgagatatgaaaatagatgacaagtttattcgttatcctatcaccactataacacgaaaatggtaatgacatcggaaattcaatttattcagttgctaagtttgcagcagggcttttgactgagactttcacgagcattcctgcaatgatagttaggatcgtaacgaggaatgggaaaaatgcccaaggaatgaaacttaatggattgatttgtaaggtactagcgatgaataccccagaaacactccatgggacaattgcgttgactgcggctcctgcatcattgagaatccgggttaaatcaacccgctttaagcctaatttgtcaaatgatgggagaaatgattgtccgggaagaataattgcaaggtagtgttccccaacaaggaggttaaccccaatacaagtaagagctgtggagaatgttaaccgaccaggtgtctttacaatcccagttaagtgattgatgatagcgctaataatattgaacttgatcaataagccacctaaagcaagcgcgaagataattaaggctagagaagtaagcatactagagataccgcctttagaaagcaatgtatcgattgttttatcaccggtatgggagacgtaaccagtcatgatggtattagtaatcgtagtgaggctggttttaggtgcatgaatccagccaagtacgaccgcgaagagtgagcccagaccaagggaagggatagcaggaacttggaaaatggctaatacgattaagagcagaactgggagaagagcccatccagagatccagaacccactttgtagcccggccatcatttggtgaacggcgcctaaactaacatttttggagtttaaccctaagaaagtgtaaagaataagacaaattgcccaggcaggaatatcggtggtgagcagggatttaatatgcttgtagatactaatttcaccaacactggcggcaaggtttgttgttcctgaaagcggggaaatattcgaaccacaaaaggcccctgaaacaattacccccgcagttaaaccggggttaattttaagagttgcgccaatgccaataaaggcgattcccattgttgatacagtagtaaatgaacttccacaagcaaccccaacaagggtacaaacaataaaaactgttggtaagaagaactttacagaaataatctcaaacccaaagtacataattgttggaatagttcctgagaaaatccaggtggcaattaagacgccgatagaaagaaagataatgagagggtcaacaccggctcgcaaaccatgacgcattccccccatcacggtatcccatttaaatccacgaattcgcccgtaaacagcaagcaaaacaaatgaaataaataatggggcttgtggttcttggtgcttaaaaataatagggtagcctaagatgcataaaataacgccaagaataagtaaactttcactaaaaccaatcactggctcaggactattttttgatttgttaatagttttcattgtgtaattctccttattttttaataaaaaaataccaactagatcagcggcatttacttaatctagttggtattacggtagtataaaaactcgcggaaaactacacgcccttactagatcaatgtacctagcaaaggactcattaaaacaaccctgcttaggtacgaacaccgctgtccgtacctaaatgagtacagacaattatgcacggtaagcatagttgttataatacttggttgaagttaatgagtgttgaatcatgttagtcgttcctttcaagttaagttataattattaaaacattctaatttgattttgtcaaactctaattttaaaattcgccagaaatatccttatcagaaaatgaatgagggtcggggacaaaagaaatatcagtgtcaattattccaaatttttctcgcattacattttcgatgtgctctgataattggaaacttttgaggatcgtcattttagcgttaaccatcacggaagcatcaagcgtgaccacatttccgttatagtgagcttttagttcgacaacttttacaacgtgtggaatattggtgattgtttggcggtattcctgttcagcccgcggatcaaagtagtcggttaagttaagactgctttcaaagaaaatttttagtccagaatacagaatgaagaaaccaacgacaatactagtagcaccatcaagccaacgaaggttaaagaggagagcaccgccaattgaaatcaaagttccaatactggtgaaagcatcactcaggctatcttgggcagaagcaagcaacgcggcgttttttaatttaagccctgtttggcgattcatataccaaacaactaacataataactgacgcgattccggccccaatcaatgcgactggttggggaaccacccgacttgcaggatcgaggagacttttaatgccatcgatgataacgcttaaggcaatcgcaaccataacgaccgctgtgacaagggaaaaaattgtctcataacgccaacgaacgaattgtactcgctggtcagatcccatgtgcgcttgataatttcccgaaggcagctgtgcgccgatgatatcatcatcatccacatcctgggcaatgtgtaagcccatcatcaataaaaaggtcgagataattcccgaaaggttgttaaaggcatcggctcgtaacgtctgcgatttacttatttcagctaaccagtactcgataattgaaataacaacataagcaatcaagttatagattaaatggtgttgggaagctcgaatctttgctagttcatttgcttgcgttttttcccagttattcatttcttcggttgtatgtcttttaaatttagtcattaatttaagaacttccttgattaataaaatcagtttaattgtaacgcaaaaaataaaagccgagaaaacgattttctcagcttttactcaaaataataatgaaaataattgctaggcccggttattaattacgtgggcgcatgttgcaataatcagtcccataaaacttactacagcgatcatattactcataattgacatcatattgaacaactcctttacataattaaaatattttttacagcacaactaattacagttgcctttttggaaaacaaattataatgattgttttcccctctccaccaagtattgtaacaggtcttagcaatagtgacgataataattagctaagcttttaatgagcttttctacgaaagaaaggagtgattataagcaaaatattataagtaactatcatatgaattaatgatttttaattattaagtcaaatcgaattatttctttataaaattaatctatttagctaatctgtttaattcttttaaggctagaggaaattttgtgaagccgtcactagtcaaaaagtggccgcctttttctttaactatgagttttgctctaattttattagcgaccgcaatgctattttgataaggagcgattgggtcatctttagctgttataacggtagctttagcaagtttagggagtatatgctcataatgaggctgatctttcataaactcatctaattcaggataagctggtaattctttgtcaaatgctcccacaagtaaaagtcgtgcatctttaacatgatgatgttcaatataacgaagggcggtaatacatcctaaactatgggcaacaaggatgaggttatcttggggatgaatttggtcgtcaaccgcttgatcccattcagcttgttggggattaaagggatttggtagccatatccgatcaagggtaattactggttttgcttcttcttcgagccatggaaaccagtcatcatcacgggtagacgtaccatgaattaagtatgcgttcttcattattaagactcctatttcataaagtgtttcaatattaccatgccgatgattaacaataaaatggcaatcgaattagtaagaatttcataaggctgaccgtgggcggcaattagtccccggattaaagccataattcctaagcttaataggaaatcgaccgcaattcggccatgatgttttagcgcggcaattatcattgtcataaatgaaaagaaaaaagacaataacacgatccaaaatcttaaaaataacatgatccgtattcccatcttgcataaggggaatcagccaaaaagtttccgtaaataagataatagttaataaaatccctagaattgctagtgcgccgattgtacatagacataaaatatggctaaaattagccgctaatttatatatttttttcattctcttatactcctcaagaaaacgctttaaccttaggatagcaatgatcaagaaatttagctaatatttaacaaaatagttgttaaaaatatgcgatacttaaagatgaatactaaaaggaggggcgaaaaatgcgaaaaccctttattgatgctaattggaagatgcataagaatgtccaggaatcggttgaatttgtggacgcaattaaaggaaaactgccagatccgcaagaagttgaagtcggaattgcggcccaagcttttgcattaccgagtatggttcatgctgctgatgattcagggttaaagataatcgcgcaaaacgcggcagctgaatattcgggagctttcactggtgagattagcttacgaggtttagctgatgccggtgtttcatacgtaatgttagggcatattgaacggcgccatttattccatgaggataatgagttggttaatcgaaaagtgttggcggcccttcaaatgggtgttaccccgataatctgtacggatgaaacgatggttcaaaaagaagtcaacggagagattcattacgttttccaacaattaatgagtgtattgaggggcgtttctcttgaccaaataaaaaatgtagttgtttcctatgaaccaagttgggcagttggatatggtcagcatgctaatccagttcttgctgaagaaggatgccgtcaaattcggcgaacgattgctgataactatacttatgagattgctgataagatcaggattctttatgggggcagtgtcaatccagataatatcggaatgattatgaacaagccggatgtggatggagtattaatcggtcgggcaagtttagatgttgataatttcttgcgaatggtcaattatcttaaaaatgatcaagaaaaataaaaaaagtatttctctttgccgtcattttatgttatagttattaacagttgttatggcggtattggtgaagtttggttaacacaccggtttgtgggtccggcacgcgtgggttcgaatcccacataccgccctgacctagcgcgatagcaaaggatttttcctttgccatcgcgtttttttgtattctctgttttatgaattttaattgataacatccaagaaagtaacttaaaatagtaagatggagaaagaaaaaggggctttaattatgaaaaacgtacaaattggtggaacaagttggaaagtatcgaacgttgcattaggtattatgcggatggggacgttagcagtgactaaagcgattgatgccttagaagccgcccacgatgctggaataaactttattgattcagctgatatttatggcaacgacccacagttaggacgtggatcttcggaaatccattttggtgaagcattaaagaaaagcagtcttacccgtgatgacttttacattcaatcaaaaggaggactttttgcgaacgcggataataaaataacgcggtatgattcgtcaaagaagcatttaatcgctgctgttgatggaattttgcaacggatggggattgattatcttgattcatttttgattcatcgtccagaccctttaatggagcccgcagagatagcagaggcctttgaccaacttcaagcatctgggaaagtccgccattttggagtatcaaattttaacccgcaacaaatcgcgctccttcaagcggcgacaaatcaacgacttttgattgaccaggtacagtttggcttaaagcatacggggatgattgattttggcctgcatacaaatatgactgatgatgctgcaatcaatcatgacgggggattattagaatatacgcgtcgtaaacagatgacgattcaaacatggtcgcctttccagtacggtacatttgcagggacgtttattaataatgatcaattccctgagttaaacgcaatgttagaaactcttgcgcaaaaatataaggtaagtaaaaatgcaattgccgttgcatggattttacgtcaccctgcgcatatgcaagtgttgcttggtaccatgacgccagctcatattattgacagtgctaaggggagcgatattacattgacgagccaagaatggtatgatctatatcttgcggccgggaatgatttgccataatgaaaaaagattatctccagttctatcagcatattacagctcctttttatcgatacccgtggacaattcctttattacgggcggttaataaatttgttgtgtggactatgtacgttgcttacatcgttatattagtgtgggtagggaaaaataatgtcttgaaagcaggaccttttctgcttattcccggtattggctttatcctgctttcttttattcgccaacgaattgacgcaccacgaccatatgaagaattttcgattaaccccttaattctacgtcaaaaaactggtgattcattgcctagtcgtcatgttttttcggcgactgttattgcgatgtgtgggttaaggttaaatttgattttaggagtgatcttactcgttttagctgttgtttctgctattacgagagtgattggcggagttcattttcctcgtgatgtggttatcgggtttatttgtggctttatttgtggttcgtttttatttcttgtctaaattttagaaaggtgtatttcatggacaattcagtgctgcaagatgcaattttgaatggacttattagtactcaatatcaaggtaatacgctgctaggtccgcaattattaaccaacaaccaatcatcgacaatttggcaaacgttacggcacgaattactgtcatgtaaagactttacgtggtcagttgcctttattacgttagatatgttagtcccctttaaggcagtgatggctgacttagcacagcaaggagtacacgggaccatcattaccagtaattacttgaattttaatcaccccgcgatgtttgaagaattgcaaaaaattcctaatttaacggtcagaattgctgatcttaatggatttcatactaaggggtatttatttgatcatgggaaatatcagaccgtaattattgggagtgctaattttacacggtctgctttattagttaataaggagtggaatttaaaattaagttcccgccaagaaggaagcttttttcaacaactaacgacggaattggatgctgttaaacatgagagtactgttctaacgtcagagtggattgcggagtatcacaagaattggcaaccaccaaagactagggtgacgcaaccagaaaaattaaaaccaattgaacctaatcaaatgcaacaggccgctttaggacaattaagcactctgataaaaactggcgctaagaaaggattggtcgtttcagcaacgggaactggaaaaacatatctgggagcatttgcggttaaaaaatatcagccgcgccgtttcttatatatcgttcatcgagaacaaattgcaaaaaaatcgttagctagttttcgacgagttatcggcggcaaaaaaactgattacgggttattgacaggtaatcgccatgattggaatgctaaatatttatttgcaactgtccaaacactaagccaacaagcagtactgaataagctcaaagctaccgaatttgactacattttgatcgatgaggcccatcgtgcagcagcacctagttatcaacgaattttaaaccactttatgccgcaattttggttggggatgactgcaacccctgaacgaatggacaatcaagacgtatttaaactgtttgattatcatttagcctatgaaattcggctgaaagatgcattggctgctaaaatgttagcaccattccattacgtgggggttaccgattatgaagttgatggagaaattattactgagacttctaagttaaaccaattgattgctgtaaaacgggttaattatgttcttaaccaattagactattatggatattgtggcgatcagccccgtggattagtattttgtagtcggcaggcagaggcaaaagaattggcagtccaatttgccgcggctaaccatcctgcaattgcattgacaaatcaaagtagtagtcaagagcgagcaaaggcagttgagcaattagaggcaggaaagattgagtatatcattaccgtcgatctttttaatgaaggggtcgacatcccatcagtaaatcagattgtaatgatgcgtaatacccaatcaccaattgtgtttattcaacaactggggcgcggcttgcgtaaatatcctggtaaagattttgtgacagttattgattttattggaaattaccaacataattacatgattcctcttgctcttaaccaggataatagtcgaagtaaggatcaagcgctccgtgaagttaaggtgccaacgaattttgacgtttcaaccattaactttacgaaggttgccgaagaacaaattttagtctcccttgataaagttaaattggactcgatgcgtgaattgcggcaggcataccatgatttaactaaccaactagggagaacaccattgctggatgacttttatcgttatggttctgttgatccccgagtatttgcgcaaaattcccagctcaaccattatggtgacttcttagaaaagatggggatagaacttaaattaacaaattatgagcgtcaagtactagcctttttaactaaagagttgcttaacggtaaacggccacatgaattgattctccttcaacgcttacttcgcggtacgtgtttaattgatgcttttaaagcagaattaaagcatcaaaatattcgcgttacaccagctgttttacaatcagttgacgatattttaagtttgcaattctttaatgtaaaagctggtaaacaggtaaaaaaggatcagtatggcggacagccgattattgatcatccagatttgttaacgtatcagttaaattcaaaaattcgagcaggactagaaagtcacaatgatttcaagaggttgtttatagatgtactaacaacgggacttgaaatcgctaagcaatatgacctcaagcaagcatttaccctttatcagcaatatgaccgcaaagatgtttgtcgtttattaaattggcccctcgatgtaagtgcgccgttatatgggtatcgagtggcagaagatatgtgtccaattttcattacctaccataaggatgtggaagaaaaaagaaatgctatttataataatcaactacaagatggacgttcattgcgctggtacacacggacacctcggcatctttcatctgatgaggtccagcggttgcttgcaggagtaaaagagggtaagccgcaagtaaaattacacttatttgtaaaacagagtgatgcagttggcaaagaattttattatttaggtcctgcttatattcaaccggactccgtaagagaagaattggttgggccaaagaaaaaagcggcagtggggatggatttagttttagaacatccattgacctcaactatgatgaacctattggcaatgtaaccatcaatatatcgcttttattttttgctaaatcttctataattaaaggcgtagaaagaagatgcatattatggcaaaaggaaaggtaaaaactagtgataagcgttcagttcgggatgttaaattagatgaattggctggcttactaaatgaatttgatgtcaatacgataggagcactagtaaagtctctaaagaagagttaaaagaagaacaagcaaagcaagaaagatgaattacgtgataccattgaacgataacaagaacatatcgatgaacaaaaagacacgattgatcaacttaataatcatatttctaaactaattgatcgtcttgataataagctataaaaaaatgaggctgagaaaaaacttttgttttttcaacagcctcgtttttcatacgaatattgttacgatatcgtggaactagccttgagccttgtcgaggagattatttctcacttctatttcttatcattcttttttatttactggttgtttaaataaatcattaaatgcttcactaattgttgggtgggtatagatttggtcccgaagtatttgataggggagttttgcccgcattgcaagaacaatcatgttgataatttcttgcgcttcctggacataaagggtagccccaataattaagttcgtttgtggatcgactaataccttaagcagcccacgggtatccttcaatacttttgcttttggaattgcggcagcaggcatcttaaagagtaggtaatctttcccttgtttttgcgcctctttttccgttaaaccgacttgtgcaagggaaggttcaataaaaacattggttgggacaattaaacgatcactaactcgccgttctttattaccgaataattcatctttaataattcggaagtcgtcaagcgagatgtaagtaaattggggaccacctttaacatccccgattacccacacattaggaacgctagtatggaggaggtcatcgacaacaatcgcgccgtttttagcgaccttaatatctgtgttttgtaaatcaaggtccgccgttgcaggcttccggccggttgccactaaaattttatcagcgaaaatagttgtttcacgattatcagctctagcaaaagtaattgcagcttgctcatcttgttcgctaattgccttaatatcaaccccaacttcaaagcgaaccccgttatccttaaagttttgaattaccatttctgccacatcatcatcttcacgtggtagtaaagtctgatggtgatcaagaaccgtgacgtgtgaaccaaaggaagtgaacatatttgcaaattcaagaccaatataaccgccaccgataatcacgagttcacgtggtaacttaggctgctccattgcttgggtagaattcatgagaaatggactactcttcaatccaggaatatcagggatggttggtgttgcaccagtattgataaaaatacgttcacccttgtaggaaagagtttgcccatctggcgtttgcacatcaatcgtgtggttaccagtaaaatgagcagttccatctaagacagtgatattttcttcgcttgctagcatttgataatttttttgtcggagttgggatgtcattacattttttccatcgaccgcgtcttcaaatgaggttccatgagcagcttcaataattagccgtttggaagggagacaagcaatattaatgcaggttcctccatacatttgcttcgatttttcaataacaagaacttgttctccatgttgagcgagaaacttcgcaagcgtttttccgcccttcccaaaaccaatgataatatttttgactgttttcatggaagaaacctccaattttaattattttatgtaccttcaaattatactaagaataaacgctttgtcacttaaaacgctcaaataaggcaattgtgcagtttgcgttatattgaacaaagtgttaggataatatcgtaaatatattagtcccaactgcagtcagaacttgtatattaaagaaaaacgtattagatgaacattgtatattattgatcatagatggtgcttcatcaaaataaaacgttttactaatttataaaaagttttgattgaggagagattataatgaaagctgcacacttagtagaacactcccaaaaagcaaatgaaaagaagcaagttattcaagagaccaagtttatcgacattttaagcaaggttgcaacagtcgtagctattttgatgtatgtatcttacatttcacagattaagaataatttggccggaaattacggtgctcctttacaaccattagtggcagcgcttaactgtacgttatggtgcatttatgcttacttcaagcagcaacgtgattggccagtcttctgggcaaatttccctggtattatctttggcttaatcacttttatcacatgtttacactaggaaaaataggattgcgagaaaacaaaattttctccagtcctattttttatatgctaactctcaactctatgatataattaaccgaacgtatgtttaggaggagtagagatgccaaaagatgggatgtcggtagttcactttagttcttttgcgccggtgacagagatgattttacagtcgttgccagccgtgaaggacaaagaggaccagaaagcgccggccattaaaaactttgatcaattacgtcaacgattaaatagtcatgcgcgattccttattttggaccttgagttttttcaggatcagcagaagcatcgaaatggcgttgctcagattgcggggaagatgtttgaaacacaaaacagctttaattactacctctatgcccagaatatgtctgctgagcgacaattggcctttttgcgacaatatgacctccgcctttcagaagtaaacggatatgaggttaggcagatttttaaccggatttttcatttcattgcggtagagcggcctgactatattgtaagctgggataatggaactgactttgaatcattgaattatgaagcaaatcgattaaagattaggaaagaggatcgtccctggcgtacgattcagtcgttagatctggaaaagctagtcgctaaagaagtatggaaaagtaaaagtgggatcagcctggaaaagatgtgtcgtttattgcaccttccccgggttaaatatcatcaagcccaaaatgatgtgatggcgattgaacagatcttgaaattttatgcttgtgatttagagcgtgaattaaattgtcgctgatcgttaccaaaatttaaaatttagttcatgatttatcccgattgactttttattattagtaataattgaaagaaggtgaacgagataaatttcatttttcgactgcttaagcggatatttataataggacttttagtaggtggaggatggctttatttcaatgatgcacaagttcaagcaacggcgaaccaaactgcatggaacgttcgtgatcgcattgctaagttaattggcagagacgatacaagctcaaacgataattctaatctgcacttaaacgatacaaacaatggctcttccaaaagtgaccaagaaccaacgacagaacaacaaacaagtacacaaacttcaattccatctactggacgatgggcgactaatcaagcaacggtctatgtaaatacaaataatgctcaacttgacgcagctactaatactgcaattcaaagctggaatcagactggggcgtttacgttcaaaccagtaaataatcaaagtaaagcagatatcgttgttacaacaatgaaccgttctgattcaaatgctgctgggttaacgaagacgtcctcgaattcgttgacaaggagatttatgcatgcaacggtgtacttaaatacatattatttaactgacccaagttatggctatagtcaggaacgaattgttaatacagccgagcacgaactggggcatgcgattggacttgatcataccaatgctgtttcggtaatgcagcctgctggatcattctatacgatccaaccagatgatgtgcaagcagttcaaaaactatatactaataataaataaaatggcgagactgaaagaagtaaatttctctcagcctcgctattctatttagtctgtcattttccgtgcttttagtgcccataagatagagacagtatcaattatttcctgtaacatggcgccgaaaaaggccggaatgattccggtgctagcaataagcattaggatagtacagattgcaattccgattaggaccgcctgttttgcaatccgcagagtttcctgagaaatgctaacggcttttgcgactcgcgaaaggtcatcttttaggataacaacggcagctgattcactagcagcggttgatccgtgagctcccatcgcaattccaacatcggctgtcacaagagaaggtgcgtcgtttacgccgtcgccaaccatgaaaacaggatgttcatttgttggaatggctttaagtgcattgattttatcttgtggaagaaggtcggctttaacctgcgtgatcccgacttgttgggcaactttatctgcaatgacagcttggtctcccgttaacattaatagattggcaacaccaagccgttttaaccggttcattgtttgctttgcttcaggacgaatatggtcggtaaaagtaattgcaccatagtattgcccatctacgctcacatagatagctgttgctgctaacatctggtcaagattttcaggagatacgaattttaattttcctactttaacttcccgcccatcaacagttgctaaaattcctttaccagttaattctttaagttgatcaacggttgataagaaaacattatatgcagtggcataagaaagcagtgagcgtgctaggatatgtgatgattgttgttcagcacttgcagcgtaatggaggagctgcgttgagtctatttttcctgtagggaggattttatcaacggtcaattgaccacttgtaatagttcctgttttatcaaatgcaccagttttagcaactgctagtttttccagtacactccctgttttgacaacaattccatttcgtgaagctcggctcattccagaaaccattgccacgggagctgcgaggattaacggacatggtgaagcaacaacgagaacttccgcaaatcgttcgggacgaccggaaaatacccatgcaagtgaagagataataatagcaataatcgtaaatggaacagcgtatcggtcggctaatcgaacaaagtgggcaggagtcgattcagcctccttaaccaatttaacgagttgctgatattggctatctttggctagtttggtgacctgtaaagtaatggcattatcaccattaactgatcctgacatcacttcgtcaccagctgtttttgaaactggccgtgattcaccagttaatgacgattcgtcgaacaatccctcaccatttttaataattccatcgactggtactaattctcccggtttaacgataagctggttgccaactttgacatcgttaactgggatgtcgctagttttgccattggtgattaaatgtgccgtttgcggtgagttattaagtaatgcttttaattcggtgcttgcttttttggcagcataatcttctaaggcatctcctccggttaacattacaagaataaccatcgctgcccagtattcgctaacagctagcgttgcaacgacagccataatagcaagcagatcaacgccatatttaccgctacggatggtttttatcatgccaataaacattgaaaaagcaacaattgcgccgacaacagtaaccagaatttgagcaaaaagttgtaaatgaaatccaaattggagcacaactgcgattgctgcaattactaggatgatgattaatttttgcttattagatagttttttcataatacccccgcttagtcctcgtgctttctacaatttaattatagggtttttatgcaatgatataataaaaaattagaaatattaaggaaactggtgaaaaataatgcaaaatggacaatcttatcaacgaatttttgtagtgataattgattcattagggattggagcaacggctgatgccaatcattttgagagtttaggggctgacacactaggacaccttggggaacattttcgagtacggctacaactaccgacttttcagaaaatgggtcttggcaacttacacccgattatggggatgtcttcgcttgaaaagcttcacgctgcttatggtcaaatgagttcaatttcaacgggcctgagtgatcgcgagagccagtgggagatgatgggcttagcaacgaccgctgaacctgacgtttttattgatggtgtgccgttggaaatagcgactaattttgcgcgaaaagcaaagcgccctcttttaagcaattccttaatgaatattcgtactgcgttgaaagattatggccttgaacaattgacaacaggtggtctgctagtagcgacggctagttcttcaagtgtttggttaattgcgcatgaacagactatttcggttggcgaattaaaagaagattgtcagattttgcgaaaaatgttggataattccccatatactatcgaaaatgtgaatggccttctttttagtgggaaccaggcggctaatttttatccccaagaactttatagatttcctttagctccagcaagtccaacggttattgattgtctcttggaagagggttatgctgtgaagttaatcggggaaagtacccagttctttggtttggaccataatgaaataaccgggaataatcaagagagctttgttcagttgcaagaactgatcgagaaaaagtttacaggtatttgtatagcagaagtgggagagatagagcaatttggtaaagcacgtaatcctgaaggctttggaacggaattaatgcggattgaccacgaacttacaaaagtcatcgataaaatgcaagatgatgatttactgattgtgacggggaacttcgggaatgatcctacttatcctggtgaaaaacatactcgtgaatatgtacccttacttataacagccccgcaaattaaacaaaatatttctctcggtggcagaagttttagcgatattggggcaacaattcttgataattatgatttaggagataagttgccagttggtaatagttttttaagaaaattattttctgcatatagataaaagaggatggaaaaattctgattttccatcctcttttatctatattaacgatgaaatttatagtaaatagcaattcccataatcaaaagaaggacaagggcagcaagacgcgggtttgttttaaataactcgtgcattgcatgaatttgtccaataccaaggggaagagtaaacatagaaaagacaccctttcaaaatttacttaaacgcttagtagttttttataaggaattctttcatatctgttggttgatgtccagtgatatgcgcaaagtcgtcagtgacttggttcatcaagcccattgcagctgcttggtacatagaagcaagttcgtttccgtcaccctcagcagcgtaaatttcagcaaatttttttacggtaacgggatcgtaaccaatttcttcacccgtaacattagtcataatataactaagttctggcattgtataatttttgctcatggtaaggagataattttgtcccttatctcgcaagtatggcttgactgctacattggcgatggcttcagcgctatcttggcggaaataaaactaacatcgactaaattatgaacatctgccttaaacattgcagttagtgaattctcgaattcgtcaattcgatccttaactaagtaggtaatacttggaatatagataacaatatcaattccgttaaaggccgctgtcatcttagcgacgtcatagtagtcaattgccgcaatttcgtatccggcatctttgaattgggaagcttttgcgggattgtgaacgccaacgcggatattatctggagatataagcttgcttaattgcttaacaacgtgttgaccaaggtgcccggttgccccagtaaccatatatttcattattaattccttctttctttttcagcatcttttagtgcttgcttaacgcgaatagtgtcgatgacatcctgtaaactgattcttgcaagtttagcttttgctgctgtttctgcttgctggtaaaagccatcaagcgtctcttgaatattcccgccaacgatgcattgtggatttgttcgttcatcaatcgtaaatagatgagcatctccttcgatcgcaagaaaaacatcataaagtgagatgttttcaggagattttgcaagtgctggatctgctgcaccatgaacggtattgattaatccggctttgttgagcgcactcatcaaacgtcggacgacaactggtgaagtttcaatgctgctagcaatattattacttgttaatggaataattccttgataaatattaatgaaagcaagaatgtggatgctatcactaaaacgggttgaaattttcatattatcattcctttaatgctaattgtaatttataaagttacatgatgtcaagagattgaatttatcattgccttgacaattatttgttttagatatagtattagtttattgattgaaacttttttagttacaagctaggagaaaataaatgagatttaagaaaatcgttgctctttcattattaagcattgctggcttactagcagggactattacgccggcagtagcaagtgctgccagcaataaaccaattattgtgggttcaaaaaatgtttcagaaagtaagactatcagtgaaatttacgcgcttgcacttgagcatgagggttataaggttactcggaaacccaacatttcaaataatgtgatttttagtgcaacacaaaaaggcgaagttgatgtttatcctgattatacgggcacaattgtagaggcgtaccttaaaaagaaggggaccggcaagagtgctagtcaaatggctaaattagcacacgatggtattcaaaaagacggcttaacgacatttaaatacgccccaggtgataatcgccaaggtgttgcaatgccaactaaggacgcaaagaagtaccacattaccaatttaagtgaactgcaaaagaatgcaaagaagattaactttgcttcacagggtgagttcgaaaaacgtgctgatgcccttccggaaatgaataaggtttatggtaaatttgattttaagtcaattaaggattatgacgtaaatttactctataagattatggaacaagggaaagcacaagcagctccggtttcaacaactgatggtcaattagcaactgacaagtttacgttactaaaggacaataagaatatttggccaccatataatttagttccagtagtaaataaaaaagctgccaaaagtcatcccaaaatggagcaagccttaaataaagttgatgcaaagttaacaactaagcaattaacagatctaaacaagaaagttaatgtcgatgggcaaaattataagactgttgctaaaaattggtataatcaaaatatgaaataagtgccaaaggggcagatagctagtttttcttgctagatatttgctccttcgttataggcaatagatggggagtggtagcttgctagggcaaataattcagtattttcaaacaaatagcggccaatattggcaatatgttggtcagcatataattctgactgttgtaacgctagtgatttcaatgatcattgcattgccattaggatatattggttcgcgaataaaaccagttgctcaattttgtgtgatgtttgcgcaattgttacgaatcattcctagtttggcattgctgtttctattaattccatttattggaacgggggttgtccctgcgttaattgctttaattgttttagcgcttccgccgttgctaatcaatacaattctcggttttaatgaagtgagtccactatataaggaagttgggatagccctagggatggatcagcgccgattacgtcggcaaatagaaattcccctggcgttgccctatattttaaacggaataaaactagcattggttgagatcattgctagtgcaaccttagctacttatattggtgctggtggattggggaccctaatatttactggcttaggcttatacgatatgagttatgtagtgattggcgcggtaagcgttgctattttatccttgctggcaatgattagctttgattttttaattagaaaggtacaaaagcatgacagaaccaattattcaatttaagcatgttgagaagcgttttaacgatcaaatagtgattcctgatctcaattttacagtcaacaagggcgaatttataacgattcttggctcatctggttcggggaaaacaactaccttgaaaatgattaatgggttgatagcgccaagtgctggtgaaatcttagttgatggacaaaagcttcgagaactcgatctagtaaaattgcgccggcacatgggatatgttgtccaacagatcgggttatttcctcatatgacgattggacaaaatattgcagttgtgcccaaaatgctgcattgggataaggaagagattaataatcgtgttaaagaattactaagtcttgttcaactaaatcccgctgaatatatgaaccgctatcctcaacaattatctggtgggcaacaacaacgcgtaggagtggcaagagctttagcgactaatccaccgtatgtattatttgatgaaccctttggcgcgctggatgccttaacaagaatggaattgcaacgagaagtaaaaaagattcatgaatcgttggcagaaaagacttttatgtttgtaacccatgatattaatgaagccttatttttaggtcaacgagtgatgatcatgcatgaaggacgcatcgttcaatttgctacgccagaagaaattgttcgccatccagcaacggaatttgttgagcagcttttagggacgattcgccaaaatcaagatttgtggaggcaacaatatgattgagtattggaatgagaattggccgataatgcttgatgatgtccagcaacatgcaacgatggttctttcttcattagcaattgccttagtgattgcggttgtaataatcttattattcttacggcgtgaaaaatggcttaatagtttgatctatttcttttcactcttatattcaattccaagttttgccttttttgccttactcttaccgatttctggattaggaatgaagactgcaattattgttttaacgatctactctgaatatgttttattacgttcctttattacgggaatccgtggcgttgatccacaattaatcgaagttggtgtggggatggggatgacatctcgacaggtttttcgccaaattcaattgccgctagcattaccggcaatttttagtggaatccaagtggccctagcttcgacaatggcaatggcaactattgcggcaacgattaatgccggtggtctgggtcaattattgtttgaaggactgcaggggcaacaggtcgtgccgattttgtggggaacagtcttaacaatggctttgacattaatttgtgcaggaatcgttcaattgatctcgtggatattgttgcatcggtggaaaggagtattaaataactgagcaggaaattagtagtattcactgagaattcgtataatcaaaataggtaacgaaaacgaggaggatgctgaatggataaaaatgaattaaagaaattaacgccaatgcaatatgctgtgactcaaatgggggttacggaaaaaccatatagtggtaaatatgatcgatttgatgaaccgggtatttatgttgacgttgttagtggggaaccattattctcatcattagataaatacgatgcaggatgtggttggccagcatttactaaaccgattaagaagcgtgttcttacagaaaagcgcgatcaatcatttgggatggaacgaaccgaggtaagaagtaaggaagctgattcgcatctcgggcatgtctttactgatggtccaactgatcgcggaggattgcgctactgcattaattcagccgctttgcagtttatcccagttgataaattgcaagaaaaaggctatggagaatatctaagtttgtttgataaatagttaaaaatcaagggagtgggaaataacctcctcgacaaggcggttggctaagctaggatgatgattagcacggcatgggctgattatccttcgtacttagactcgagccttgtggttattttctacgttatctttctattgttcataaaagtagttgaggatgatgaattgtttaaaaaattcatcatccggtttttattttggactaggagttttttcccagcctccattctcgattttggttttaaattatttatccataattggcgattcatcccccacttctacaagtgggggatgaatcgccctcttaaagcacgttagtgctttttcttttgttctatgatatatttagtgtatatcaatatgagagtggtggtagtaattaaattggatcgtaatcaacgttcagtatacttgctgaattaccatttggtaatggtggttaagtatcgtagaagagtaattaacgatgaaatatctgaatatcttaaacatcgttttgtgattgtaggtcaatcctatggaattaatttacaaaaatggaatcatgatcaagatcatgtacatgttttgtttagagcaactcctcacacggagatggctaaattcttaaatgcttacaaatcatccagctctagaatagtcaaaaaacaattcccagaaatcaagcagtatctttggaaatccgccttttggacacaaagctattgtttaattagtactggtggagcactgttagaagttgtaaaacgatatattgaaagtcaagggagaaaataatggttctaaaagccgttaaaatgcgtatatatccaaactctgcacaacgagaccaactttggcaaaccttcggttgtgttcgttttgtgtggaatcaaatgcttaatatgcaaattgaacggcgtaaaaataatccagaggctaaatttgttaatgcctttggtatgaacaatctcttgaaacaacttaaagttgaatatccttggcttaagcaagcagaatcaactgctttgcaaagtgctaatcgcaatttagccgatgcttttcaacgcttttttaaaggtcaaaataagttccctcggtttaaatcaagaaaatattcgcaaagctacaattcaaagtacgttaatggcaacattagaattctagataggcatcatattaagttgccaaaacttggtgtggtgtattttagagctggacgtttgccgttaggcaaaattaagaacgtcactgttcgactaaatgttgctggtcaatattacattaccgttttagtggagagcgaaaatcaaactctccctaaaacaggcaaatatattggtggcgatttaggacttaagtcattactgaatctctctgacggctataaagaaccgttgaatcattttgaatctaaatacagcaagaagttgcaccattgggaaaactacgcagtcgacgttacttaattgctcaacaagctatcgcttgggatcatcacaataaggtgttaaagccatgccaactcgatgatttcaaaaactaccaaaaggcacggatcatggtagctaaatatcggcaaaagattgccaaccaacggttggatcagctacaaaaattcactactatattagttaaaaagtatgacatcattgtgttggaaagacttaatactaagggcatgatgaagaatcaccatttagctagggcgatcgctaacgctagttggtcaaaattagtagatatattgcaatataagtgtgaatggtatggaaaaaaactcattcagatcaatccatcctatactagtcaaatctgtgcaaattgtggtgaaagcaaccatcggttgggactaagtaaggctgaatggctaggaattagggaatgggactgcccaaattgtggcaaacatcttgaccgcgacattaatgcggctcaagtcattcttcaaaaaggtttggcgattcaataattagataatctaaaaaatacaggctcgggacgagccttggttaatagtcgtaacctctgcttgaaggctcgttaagaacttgtaaagtaagtatgcgatgttcccagaatctcccacttcaagcgttaaaccgcaggtttagctaagtgggagtagttcaattttcttctaacattgcatcataaagtgaagggcgaccacctaataaacgattaacataataggcgactaaagtaattaatgtcattggcaaaatttgttcaactgaaccaaccatttcagttactaataaaattgcgaccattgctttccaattcgttgaaagtgacatattagtgacatatttaataaaatcgtgactaccaccaagaatataagggttccataatccaacaggaataactaataatagtggaataatgttatgaaattcttttggaataaatgtgattttgctgtaccaccaagttaggtttagtgctgcaaattgaaaacggtatgccaagaaaccaatgacaacgccagcaacgattagtcatggataggatgcgactggtaatttagttgtgatcggaatatataggcaaggtttagtaccaaagaataaaaaaagtgataaatgcagaaacgattgaagaagttaaagcaggaatccaaattcgagaattaaaattatggatcatttcttctaataaaaacattgttcctgctaaaggtgcactaaaagccgcagataatccggccgcaacgccatactccatcaataaatatttatctttgtccgtaaagtgaaagaatttttcgttaaagcaggctccgatacaggcatcaatttggatacttggtccttcacgccctaagaaaagtcctggacagatagtaagcaaactagcaacgaatttttgccataatactggccaccaatgaatacgatgctttcctaacaaaacagcttttaattgggtaacgccagaacgaacaacatctgtttcataaggcttaacgatttttccgattaaccatgcaacgataaatgttcctaatatatatggaattaatagccaaggatgtttacccataaaaggataaataattgtcagtaaagtaagggtccggtcgataatccagcgaaaagccccgatcaccagaccagttactatcccaatagcaatactaacgccaaggtaacgagaaacaatggaggtgaatggttttcctaaaatgtcccgtgcccgtttgtgatataaagtattttcgcctttcataaatactgccttcaataaggtattttccctatattagcataaaaagagagtgaacaataacagtctacaagagataagtattgttcactctgcttttactatgaactttttaatttaatctgtgttggtgtttaccacccacaaataaacttataattgaagctactaaaattgcggaaaaacttacaacagcgattacgttacttaataatgacatcatggtaaacaccctttcttaataaatcttgttatcgctttcatcaactatattatagcattagttgaccaagattgatcaaaaaagaccttttattttactaattagggttgttatttcagcaactgcctactctttaaaaaagtcacgaataatttgtttataagctttaattgtagcaacgtaactcgaaatagttgtatattcatcagtttgatgagcaacgttccaatcgtcacatcctaaaattacaactggaaggtcgggacgatttaatgtaaatacacttgcgtcagttgcaccattgataatatcaagcttgatgtcatttggatagtttcgctgggcagcattgagggcaatttggacaaaatcgttattaggttctgtcgcaattggataaaaatcttgaataatttttagctctagttggaaaggagttgtgtggttaatatattcaagcgcatcatttaatcgatctgcaactttaacattattaaatgatgccgtagggcggatatttccttgcaaactagcactgtcggggatggtattaacttgagatccaccatcgataactgtaatactatgttggacttttccaaggtattgatcatctttggtgttatcaaaaaggtgtttttcttcttcgataaactttaacagcccttcaattgcattaataccattttgcgggtgagaactatgacaagattttccataactggtaacgcggtaattcatactccccgagtgagcaaaaataacattcccaccggttggttcgccgactactaatgcgtcaaggtcatcggcaactccttgcttttgtaaacgataagctccaggagtaccaagttcttctccggcggtagcaataaatctaacagttcctgatggcagttgcccagcttcttttaattcgattaatacaatagcctgggcagccagaccgctcttcatgtcagcagctccacgaccaaaaatataatcaccactaatttcaccgccaaagggatcatgttgccagcggtctggattaggtactgccacagtgtcttggtgtccagtgagcccaaggatttttttactttccccagtcccaatttccgcaatcaagtttgcacggcgatcaccaaattcatcaacttttgaatcgattccgtgatttgctaaaagtttttgtaagtagcgtgctacttcaacttcatttccattaacagaatggatttttattaaatcctgcagtactttgactttttcactgacttccataatgatccctcctatatgttagcgatcttggtggttaagcttcttggctaaaatatcgccaactacttgaatgattaaaacaaataaaagaacaagaatcgtggcgacaagggttacgtcgttgttaaaacggtcgtaaccgtatgaaatagcggtattacctaaaccaccagcaccaattgcaccagccattgcagtaaggctaactaaactgattagtgtaacggtggagacacggacaagttcagaacgagcttcgcggaggtaaacgtcaataatgatatcccagttagtagccccaatagcttgggcagcttcaattttaccgtggtcaacactttcaagcgcaacttgaacttgacgagcatagaaagcaaatacacctaatgaaagcggcactaatgcggcggttgttccaatctgtgttccaacaattaattgggtgaagggggcaatgaaagccaacaaaatgataaatggaattgcccggaaaacagatacgactttatcaacgatactaaaaacaattcgattttctaaaattccaccgggctcagtaaccacaagcgcaactccgaagattaatcctaaaattccaccgaaaatagcaggccagaaagtcatgtagatagtttggacgattgaagtaccccaaccattgtcaccaccccagccaagttgaattacatttggtataagattattcattccaaatcctccgatcatcaatctttgtgacagtaacatcattttcttttaagaaatcaatagcttgttgacacttatcagcatcgcccttgataactacaaacagggtaccgactggtgaaccagccaagacttcaatgtttccataaagcatacttgcttcaacttgcagcttcttatataactcgataatgattgatttagtcacgttatttgcatcgtagactaattgcagcaactcttcatcatcatcaaggtgaccaagatcaaatgctttaagggtatcgactgcggctaaggatcctcccacaaattgccgggttaagtcttgttgtggttggaggaaaactttctgtaaggtaccacgctcaatgatttgtccatattccatgacagcaatcttattcgctacccgtttaacagcgtccatttcatgggtaataaggacaatcgttaaatccaatttatcattgagccgtttaagaagatccaaaatctggtttgtattttggggatcgagggcagaagtagcttcgtcagagattaaaatttcaggatcgttagctaatgctcgggcaatggaaactcgttgttgttcaccaccggataattgaacagggtagaattcagctttatcctttaagccaactaagtctaaaagttcaagtgccttcttctcttttgcgtcattgtctaaatcagtatgtttaagagcgaaaagaacattttcaattactgaagtttcatttagtaaattgaagtgttgaaaaatcatgccaatttttcgccgcttttcttgtaattctttattgctaatttgctgttggtggtctttgaaaaagacagtaccattaactgttactgatccagcagagggaagttggaggaggttaatggttcgaactaatgttgatttaccagctccagaataaccaacaatcccataaatatcgcctttttctacttttaaagtaacatccttaacggcgtgaacaacctgttttcgttgcttaaaagttacgctaatgttatctaagtcaatgatcgggttcgccatattaatcctcctttatttattgaagttgaggttccaagcaggaatttctgcagttccgtatagtttcttaatttctcgttttgttttttcagtttggtaagcacgtacaacatctttgtaaatcttgttgttcttttcgctgtctttaacagcaatgatgttgacccattgttttgaatcctagttaactggttcaacgaaaattgcactcttgtaattaagaccagcagcttgtgcatagttagtattaacaactgcagcatcaacgttatctaacgaccgtgctgtttgatcagcggctaattctttaatcttaagatcgcgtgggttcttagaaattgaacttacggttgcgagctttgtgcccttctttaggtcaatcaaaccagcattctttaatgcgaataatgcccgtgattcgtttgaagcatcatttggtactgcgatcgttccaccattaggaatttcctttacactcttgtattgcttggagtataaccggattggagtaataaatgtatcgcctaaagaaacaagatcagttttatgggctttattccaagtttgtaagaataacttgtgttggaaggcgtttaagtcaacatcgccattttccaaagccttgtttggttggttgtaatcagtgaatcgtttgaattttaaagtaacattgtacttatctttagcggttttgcttactgaattccaaatttcatcatcttgttttgaaccagccataatcccgacagtaacagtccgttttgcttgttgttgcggacggataaaactaaagtatccggcaataacaacgataagtgcaactactgaccaaataatgatatttcttcttttctttctcttcatagtaaaaactccctttcaatcaattaaatattttcgttggttaattaaaacgttaacttgctagtaaataaaaaagcactcgtccctttattcaaaggacgagtgctcgcgttaccacctttatttgctgaatcttcacagacccagcctcagtaggttactctaataaaacaattagaattacctagcactaataacgtgtgctaacccgttatcgactaacaatcatcgataccattccaagcccatcttcaatagttacgcttgcttcttcacaccacccagaagctctcttgtaagcctcgctacttactctgcttttcgatatgttttaacgttcaattaattattatgtgttccattataatgattctctaatttttgtcaacgcattttttaatttaaattttgttttatttgggtcatcaatcgttttttattttgcctatctatagtaattaaaaaataattatgctaagattaaaaaataattaaaaagaaattgaaaggggtcatagtaatgacacgaaaagttggagttatcggaatgggtaatgtggggtcaacagttgcccactatattgtggcaatgggttttgcagatgacctagttctgatcgacaaaaacgaagcaaaggttaaggcagatgcacttgattttgcagatgcgatggctaatttgcctttccataccaatattactgttaatgattatagtgcgttgaaggatgcggatgtaattgtatccgcgttaggaaatatcaaacttcaagataatcctaatgctgatcgttttgcggaacttccatttacccgccaagaagtaaaagaggttgcacaaaagattaaggaaagtggctttaacggtaagattgtggctattactaacccggttgatgttattacctcgctctaccaaaaaataactggtcttccgaagaaccatgtattaggaacagggaccctgcttgactctgcacgaatgaagcgggcagtagctgaacggcttaatttagatccgcgttctgtagatggttataatcttggagagcatggtaattcacaatttacagcatggtccactgttcgcgttcttggccgtcctttaactgaattagcagataagcgtggattagacttagaagagcttgataaggaagctaagatgggtggctggactgtctttcaagggaaaaagtatactaattatggggttgcaacggcagctgttaagcttgtcaatgcaattttatccgattcattaactgaattaccggtatcgaacttccgtgaagaatacggagtctacttgtcttacccagcggttgttggtcgtgatggagttgtagagcaagcacaacttgacttgacagaagaagaactgcaaaagctgcaaacatcagccgatttcattaaggaaaaatatcaagaaagtttgcaagcaaaagattaaggaaaatttaaataaagaaaatagactagcataaaaaaattatgcatggtagaattgcttctatacttaacaaataaaagtggcgtcatcagataaatttggtggcaccacttttattctgtaaaaatatagaaaggaaatatatcatgacaaaagaagtaaagcgtataatctttgtagttcttttttgtgagtttttgatttgtctcggaatgagtcttatcttcccagttgaaccattcattaaaaatgaataccactttactgcctttgacatgggagtgatgtcttccctatttgcgtttgtgcaatttattgcttcacccattgttggtcggatttcagataaagttggacgaaagccaatgttagtatggggattgctaatatttgcgattgctgaatttgtttttgccttagcacagcatttatggttatttgacttatcgcgggcggtagatggattatcagcagctatgtttgtgccaacatcaatggcattagcggcagacattactagtgaaaaagaccgcgccaaagttattggttggctatcagcggcttttagtggaggattgattttaggaccgggccttggtggaatgttagcgcatgtaaattataaattcccattttgggttgctggtattctaggcttgattagtacggttgttgcttggcgctttttacctcatgatgaggatgaactatttaagagtgaaactaaaaatcctgaaaatgaactattgactggtggttggaatcagttgaaacaaattatgaccccaatactaatcacgctctttggaatgatctttgtagcttcatttgggttagcaggttttgaaagtatttatagtttgtatgtcaatgaagttcataattttgacttaaacgcaattgcgcttgttttaactctcaatgggattatttcgcttattttgcaagtctttttctttgatcggctagttcgctggctgggagaagttcgcctaatgcgatatagctttttccttagtttagttggaacgatcatggtaatttatgatcacaatcattggcatatcattattgcaaccttgtttgtttttgaagcattcgatatgttacgcccaacaattactacattattaactaagatgagcaagacaaaccaaggattattaaacggggtaaatatgtcattaacgagtgtgggaaatgttattgggcctcttattagtggctatttattagatgtcaattatcaatacccatattggttcgtatcgatattcctaattatttcctgggtaataacacttgttttaggacgggaaagaaaagcagctgctaacgattaaatatttaactttattaagaaaatagcgaggaattaggaaaaataaaatttttctaatttctcgctattgttgtatttatgcttaattttgttgtgcctgttgcaatgcatccttggttgcttctttaatcgcacgacttgttgcactggctccagtaataccatcaacgtctgcactattagctgcaataattttgccgggaagttcatctaaagcccatttgcccatttcagattcgtggtgtttgattacttgtaaatcttgaatcttgtcatcttggtaggttaataagacttttaattcaccaccataagcactaaagccatttccaatatattgggttctttctatttctctcattttattatccatttaaattacattattttgtcctgttacgcagagtgataatagcgggcaagtctgacatttaggatttcttgccgtacagacatacctaccccaaaaaatcatactatgatgagcatctaaccagtgttcagggggaatagttttcattaatttcttttcaattgcaagaacggatgctttgggctcaactattctgagacggcgggcaacccgactaacatgggtatcaactggaaaagcaggaatattaaagcattctgcgaggaccacatcagcaactttccttccgactccagataaggtcattaattctttgagggtgtggggaacctccccgttaaagtcagtaacaatttgttgagaagttttgactaagaatttagctttatttcgataaagccctaatcttttgatataaggctcaacttctgcgggttcaatccctgctaaatctgctggcaacggaaaacgagcgaatagtgctggcgttacttcattgacagattgatctgttgactgtgcactcaagattgtagccaaaagaaagtggtagtttgtgtcagcaatcaaagttgttcctgcttcgggaaatgtttgccgcatgaccttgattgagtaacgaatttcatctggtgataacatataaaatcactcttttcgaatatgattataactattttaacccgaatgattaaaatagcgaagggtaataatctcattttatactcattaaattattatttgtaaaattgagggttagcaatatgacatcaatttatgttaaagaaaaaatgtttaataaagatataattgtagaaatcgctttctttgattaatttaaataaacgattgacctagggaaggcgccttggtaaaatgtattaaagattttcttataattctaatcaaaatttaattattcagaaaaggaggataattatgagtttttggaaaacaattacacgtaaagaagacccgcgtgtttatgataataaagacggtcatttagttcgatctttgaaggtgcgggactttttagctttaggtgttggaacgattgtgtccacttccattttcactcttcctggtgaagtggccgcaatgcatactggaccttcagtagttatctcttttttaattgctgcgatcgtggccgggttagttgccttcgcctatgcagaaatggctgctgcaatgccgtttgctggttcagcctattcatggattaacgtcgtgtttggagaattttttggttgggtcgctggttgggcactattagctgaatactttattgctttggcctttgttggatctggtctctctgctaacttccgggcattatttgttccgcttggctggaagctgcctgcttcattatcaaatgcttttggtacagaaggcggagttgttgatattgtttcagttgttgtaattattttagtagccctcttaatttcacgcggggtatcacaagctgctcgtgttgaaaatcttcttgttattcttaaagtttttgcaattttactttttattgttgttggtttaaccgctataaaagcaagcaattttatgccatttattccacaataccatgaaacagctaatggtgcatttggtggttggcaaggtatatatgccggggtatcgatgattttcctttcctatatcggatttgactcaattgctgctaattcagcggaagcaatcaatccacaaaaaacgatgccacgtggaatccttggttccttagtaatcgcggttgttctttttatagcagttagtcttgtactgattggggtattaccatatcaacaatacgctaacagtgctgaaccagttgggcttgcattacgtgcagctcatcatagtggtgtagcaactgttgttcaaacaattgctgttctaggaatgtttaccgccttgattggaatgagtatggctagttcgcggttgatttactcatttggtcgtgatggaatgctgccaaaatggcttggaaaacttgataaacataatcgaccaaaccgtgcactttggacacttacaattggtgttgttttgatcggtgctttcttcccattcgcctttctttcccaattggtctcaactggtacgttgatcgcctttatgtttgtttcacttggtatttatgcattacgtcgtcgtgaaggaaaagatattccaaatccttcatttaagatgccattctatccagtattaccagctcttggttttcttgcttcattacttgtgtttatgggattagattaccaggcaaaactttacgctggtatctggtttgtctttggcttaattatttactttgcttatggaatgcgtcactcgtcaatggcaaagaaagaagatgaacaaaatgttaaaaacgaaactgaagcaggagaaaacaaatagagatgttttattagaagaaaaaaatgcatttgcaactgctgcccggattaagtactacgatattgtattagatcatggacggggggcaatggttactgatattgaaggaaatgattatatcgatttgcttgccagtgctagttcgactaatactggtcatgcgcatccgcgagtagtgcaagctattcaagaacaagcagctaaaatgattcagtatactccagcgtactttgctaattcacaagcagcgcggttggcacctcgattagcagaattagcgccgataagcgggccagttgaaatggtatggggtaattctggttcggatgctaatgacgcaattattaaatttgcgcgagcatatactggacgccaatatattatttcctttacgggggcctatcatggttcaacttacggttcaatgagcttgtcaggtgtttcattaaatatgacgcgaaaaatgggcccaatgctaccaggcgtagtaaaagtaccattccctagtccctgggaacgattaactaatgaaagtgacgaagcgtttgttgagcggatgtttcatcaatttatgctgccttttgaaacttatttgccagttgatgaagttgctgcaattcttattgaaccaattcaaggtgatgggggaattgttaagactcctcctgcttatatgcaaaaggtatacgaatttgctaaagctaatggaattctctttgccattgatgaagttaatcaagggatgggacggactggtaaatggtggtcgatccagcattttgggattgaaccagatttaatgtctgttggtaagtccttagcttcgggaatgccgcttagtgcaatgattggtcgtaaggagattctggaatcattaggtgcgccagccaatgtttacactacagctggtaacccaattacggctgcagcagcgaacgcgaccttagatgttattcaaaatgagcatcttttagaacgttcacaacgccttggcaaaaaagcagctgaattttttaagcttgaacagcaaaaatatccttttgtgggtgatgttcgaatgtatggacttgatggtggtattgatatcattgatccagttacgggaaaaggtgatacagaagcaacaaccaagctaatgtaccgcatctttgaattaggagcaattatcattagtttacgggggagtatacttcgtttccaaccaccattagttattacagaaaaagaattagatcaagcttttgcgatgattgatcaagcattcgcggaattagccgctggtaaattagcagctcccgcaaatgcagaagagttaggttggtaactcttgcaatttaagaccatcttcgggtatactttaagcgccatcttagctcagctaggtagagcacatccatggtaaggatgaggtcggcggttcgaacccgctagatggcttaaaatgaactaagaaaagagatttagaaaaacgattcgtttttctaaatctcttttcttctttataagaatatgaccttgctagtaatataattaggattgaaattacggctatgttaaaatcaaaattatgtagcattagcttaattgataaattggaggaaaagaaatggaatttattgcagtgttggcggggttattgcttgcaacccagatcgtagcacacttatgtcgtcgcgttgagattccagaagtgattggacaaatcctagttggaatcattgcaggacccgctgttttagattgggttcatctaaattcaatgatgaatgaatttcaggaaattggggttattatcttgatgttcatcgcaggattggaaagcgacctatccttactaagaaaatacttgaagcccgctgttgttgtggcgcttttgggggtaattgttcccattgtaattatgggaccagtaagttatatgtttggctttactaagcttgaatcactttttatcggggttatttttgcgacaacatctgttagtatttcagttgcagtattgcgtgaatttaatcgcctagatagccgagagggggcaacagtgcttggagcagcggttgccgatgatattattggtgttatcttgttaagtgtgatgattagtgtaatcaatggaagcagcaatagtggccacggcaatggtcagcctttaggaattgtcctcttgatgcagttagtgttctttggtggaacttacctattaattcgttggttagcaccttacctgattcatatgagtgatcgcctattaacagttgcttcaacgtcggtaatggcgatgattatctgtttaggcatggccgcaattgctgattatgttggcttgagtggggctgttggctccttcttcgccggaattgctgtggctaacaccaagcataaagaagttgttgaccggagttttattccaattggatatgcaatgtttattccgctattctttgtcagtgtaggcttgaacatgcgctttgataatattggtgaatcgtttgtctttgttattgtaatgacaatccttgcatgcttaacaaaactgcttggatgtggagcgggtgctaagctatctggctttagcatgcccagttcttatattgtcggtagtgggatggttgcccgtggtgaaatgggattaattacagcccagattggttatgaagcacatcttctttcgccaatgtattattcagatgtaattaccgtgattattatcgcaactgtattagcgccatttattttaaagaatgcattgaaacgatcagccaacgaacttgagtaaagggggcttttgatggaaaatcatgaacgagaaacggagcaagcgcgggttgataatgttgaaaaacaaattgaccaacagatagctgctaccactaaagctgttgaagatgctcatcgtgaaacacgggcagttgaacgtaattatagtgaaaatgcatctattaatcgttatgaagttgatgatattgctgaatctcggtcaatgattgaacagcagcgacaattggtttcacgagcagcggaaagtgaatcaattctaaagcaccagttaagaactttgaaaaacttaaaagggtcaccgtattttggccggattgatattcaagatcctggtgaagataagagtgaaacgctatacattggtacttcttctttaatgaatgaagataaaacagactttttaatttatgactggcgggcaccgatttctggggtttactataatggtacccttgggaaagtcaattatgaaacgccagctgggatgcaaaccacagaattaaaaaagaaacgccaattcactattaaggatggcaagatcactaacatgtttgataccaatgaaacggttggtgatgaagttttgcaagcagctcttggaaagcaaaatgaccagtatatgcataatattgtggcaacaattcaaaaagagcaaaatgatattatccgtgatacgcgtagtgatcttttgctagtacaaggagtggctggttcaggaaagacttcagcgatccttcagcgaattgcatacttgctttatcatagtcgaacagaattgaatgcggatcagattgtcctctttagtcccaataatttatttagccactacatttctgaagttttgccaagtcttggtgaaagaaatatgcggcaagtaacattagaagggtttatccggcggcgttttgaaggcttgcaagtagaaacattatttgatcgctatgaagaacggcaaaaacctgaaaatgcttctcatgttgttgctgactttattgaaagtgaatcttttatgacgtcaattgcacattatgtcgagaaaatgacaattgaggatttgcagtttgctgatattcgttttaatggtcaagttttcttttcagctgaccacgtcaaagatctttataaagaattaccattgacgatggctcctgctgataagttagttcaattgaaaaataagttaattcgtgaattacagcggcgagttaaagatgaagctaaaaaagattgggtagctaaagaactggattcacttgatttacaacaattgcacaatctttgtggtaagaagtcaattgatgactttaaggatgaagatgagcaatatgtttacctttcgcggcgtttagctaaacgacgcttacgtgtgattgcagatgcgatctataataattactttctcgatttttataatcaatataataagtttttgcatcaagttgaggtacctaagacaattagtcagcgggaatgggcaacaatgattcttgcttttcaagatgagattgaataccatcggctggaattaatgcatgcggcacctttgatgtatctgcgtgatttgatttccggtacaggacaaaatcgttcttttcaatatgtatttattgatgagatgcaagattattcaacagcgatgttaatctacttaaaacacgcctttccccaagctaagtttacggtcctcggtgatagtgaacaggctctttttaagccattgcagttaccggaagagttattaaacaaacttagtgggatattaaaggctaagcggcctaatttaattgctttacggcgaagttatcgttccacgacggagattactaattttgcgaaggccttgttgccggatggagataagataatttctttcactcgccatggaaagaaaccacgcttgttagttcgttattctgataaagagagtcagcaaagcttgttagatgagacacttaaactagctaacgaacatgaaactgtagcgatcttaaccaagaatcaagagcaagccgctgttatttatcaattacttcgccggcaaaaggttgaaaatattcatctcttagataaggatgcaagtgaattgccaaaggggatcttaattctcccaatttacttagcaaaaggactcgaattcgatgctgtccttgctgcggatgtctctgctaaaaacctagctaatactgatgaagtcggtatgatctatacaatggcatcacgggcaatgcatgaactggtccttttaagcaacggttcagttagcgacgcaattaacgagaaagctgggcgtcttttaacgattgaatatcaattgccaaataaaaattaaatttttctattgtctaaaaacgctttcaagaagtgtcgacttatgataatctaatggagtagatatagaaaaaggagatgcttcgccatggttaaagacgaatacacacttgtactagtaaagcctgatggggtaaagactcgtcatattggagatattattacccgtattgaacggaaagggtataatattgaagctcttaagatgattgacccatcagaaaaaaagcttcgtcaacattattttgataaagttgacaaaccattcttccctgaattgttagaatacatgacagaaggaccaattgtcggaattgttgtttctggtactaatgtaatccaagcaattcataacatggcaggagctactaaccctggtgaagctgaatggggaacaattcgtggtgactatggtcgtgaatggcctgatggtaacttgcgaaatatcattcatacgtctgataacgttaacagtgccactcgtgaaattggtatttggttcccagaatttgatattaaagataaacagtagaaaataaaaagactgagagaaaatttttcctctcagtctttttacttttcacttgccctttgttggcgtttaatttttcgttgtactgccaaggtattgcgttcccagaagactccgtcagtgtagccttggatgctaggatcatcttttatttgattaagtcggtactgtccccatgcacaatatagaagactttgctcgattccaagataacggcggttaagtttagcagcagtcactaaactcgaaccggaaccagcaaaaggatcaaaaatgaagtcattaggattagaactggcaaggataatttttgccagcaatttctcaggcttttgcgtagggtgaccagtattttctggcattgaccaatacggaattgaaatgtcatcccaaaaattagacggcattgtatcccgaaagttaccatttttagtagcttgccagtctttagctaccccatcttgacgataaggagctaccacctgtcgtcgttgcttaacttggtcgacgttaaaggtgtaatcactcgggttcgcggttaagaaccaaatatcttccatcccatttttccaatttttcagtgaaccccggcccttttctcgttgccaagtaatccgattttgaattgtaaaatttttttccaggatcggtgctaaggccatgctggttgcccaatcagaaaagacatagatactagcattttcttttaataatggttttaagaggtcaatccacttttgcgtgtaagcttgatattggcttgtggacatttttttaaagcttaaaccatcatactgtttattaaggttgtaaggagggtcaataagggcgagatcaacctggtgtggtgataatttagtcattaccttgaaggaatccccgttgataatcttatcggatattgtctggagattatcagtaggctgaataatttggttgaggagctcaggtgaagcttcctccagcgtgaaatcgattgttttatttctttttgagcgcatatagaccactcctgttcgacgtttaatattattatacttgtcatattcaggattgtcttgcctttttagtaggagttggattaaaattaattatattaagtagcgcgagccttagcgaggggcggtcggtgaaaaggtccccaaagtgcgaaatggtcacaacaagatacacaatgagcggcaataatgattgcaatttaggtggcaccgcgcgaaaagcgtcctatttagtttatacgactaagtagggcgttttgtaatttaggaggaatttaaaatggcagaagaaaaacacgttattttaactggtgatcgaccaactggtaagttgcatattggacactatgtaggttcgttaaagaatcgggttgaattacaaaatacaggtaaatatgatacatttatcatgattgctgaccaacaagcattgaccgataatgcccgggatccggaaaaaatccgccgtaatctccatgaagttgctctggattatttggcggttggaattgatccaaagaaatcaacaattttggttcaatcacaaattccagcattgagtgaattaacgatgcactaccttaacttagtaactgttgcacgtttacgccgaaacccaactgttaagactgagattaagcaaaagaagtttggtgaaagtgtgccagctggattctttacttacccggtaagccaagcagcagatattacagcatttaaggctgatacagtgccagttggtgatgaccaagaaccaatgcttgaacaaactcgtgaaattgtgcggacattcaaccgtatttaccaacaagatattttagttgagcctgaaggggtattcccaccaaagggtcaaggacggattccagggctagatggtaatgcaaagatgagtaagtcgcttggcaatgcaatttatctttctgatgatgctgatacagtgcaaaagaaagtaatgtcgatgtatactgatccaacacatatcaaggttagtgatcctggtcacgttgaaggcaatactgtctttacttaccttgacatctttgatccagacaaagagcaagttgctaaattgaaggagcaataccaagctggtggccttggggatgttaagattaaacgctacttaaatgaagttcttgaagctgaactttcaccaattcgcaagcggcgtgaagagtatgcagctaatattgattatgttgatcaagttcttaaagaaggctcagcacgggcaaatgaggttgcaaaccagacgcttaaagaagttcgtgatgcaatcgggattaactactttggctaaaaatataaactaaaaaagcgaggctgctaggaaaataagtttttacctgagccccgttttttttcgtgtctcccatagcagaacatggtaacataaaagagatgtatttatacgaaaaataattaattaaagcggaggtgaaaatggtggaaaacctcgcgattgtagacctcggctcaaactcggcccgaatggcaataacagaaattgctccagatggacgatttcgtgaaattcgacgtgtaaaagaaaatacacgtttatctgagggaatgggacgagaaaaaatgttacaagagagtgcaattgaacgcacaattgcggctctaaaacgatttaaaaaaatctaccaagagattcccaatattaaagttcgtgcgatcacaactgctgcagttcggcaagcacgaaatcgtcaagagtttttgaatcgtgttcaacaagaagtcggtattcatctacaagttttatctggtaaaaaagaagcctattatgattatctaggcgttgttcggacattgcgacttaaccactgtttgattctagatgttggtggagcaagttgtgaattgatattggtgcaacagcgaaaagcacgtaatttgatttctattccggtgggagctgttaatttatcagaacaataccacttaaatggctatgttcgttcggctgacctttttcgtgcgcaggtagcgataaatgaacgattgaccaaaattccttggttacgatatacaacgcgtgttccgattgttttattaggtggtgctaaccggactttggcgcgtatgactcaatcctatcatcaccatcaccgccgaaacggttcgattcatgggtatcaactctcctcacgagtagtatttgcgacttaccgtgaattattaaatcggaacttggcccagcgtaaacggctgactggtctagaaccggaacgagcagatattattattggtggaatgctgcctcttgtaacccttttgcaacgcaacagtgatggccgggttattttttcagagagtggtgtccgcgaaggaatcatcactgaatatgtaaatcaaaggaagcgacaccatgactgattggcaacacggtttttataagttatctgccgatgatcgacgtcaacaattagcaaaagctcgtcacctatcccctatggaagagcaagtattagcaaatacaagttcagatttaggggatgagttagtcgaaaattatattactgattattctttacctgaaggagtagccttaaatataaccgtaaataatcgtccgtatgttgtaccaatggtgattgaagaaccatcagtcatagccgctgctagcaatggtgcacaccgggtaagtaggtcgggaggatttactgctcctcggcaagaccgacaattagtggggcaagttgtgttagatgatgtgaccgataaagcagcagttaaagcatggttattagaacaccaagatgagattttaacaattgctaaccaggctcatccctcaatgcaggcacgaggtgggggtgcgaagtcgatgaaagttcgcactcctgggaactttattagcattgacctggggattgatgtttgtcaggcaatgggcgctaatagtgtcaatacgatggcagaagcggttggaaaatggttaacagaccagggcttccatgttattaccgcaattttaagcaatcttgcaacgcagagtctgcaagccgctacttgtaaagttgattttcgatacttagcaactccggagatggatggtaaagaggttgctcaacgaattgctcgtcttagtgatcttgcacaagttgatccttatcgagcagctacccataataaaggaataatgaacgggatcgatgcggtcatgatcgccagtggaaatgactggcgggcaattgaaagcggggcccatgcctatgctgctcgtgatgggcaatatcgaggattaagtacttgggaaattcaggacgactacttggtaggaaaaattgttcttcctttaccagttggtgtaattggtggttcaattggattaaataagatgacaaagataaactatcatattagtcaaattaaaagcgccgaagagttagcagcagtaacagcaagtgtcggattagcacaaaatttggctgctttgcgggcattgacaactactgggattcaagctggtcatatgaaactccaatatcgctcattagcggcaagtgtcggagctacgccagcagaagtaccgttagtggtagctcaattaaagcagcaatcacatgttgaccaagcacttgctaaagaaatattatcaacgatcagaaaggaccaagttaatgactgaagagagaattacactaaataaagaaaatcaagcactccttgatcaggttaacagtctatatcctgaaggtagtgtctttgttcagtttcatggtgacaagtcaggatacgttcgccatgaccaagcaactcaacaaactattcctggtgccttggttattattgtgactgacttaactgccccaaattacactgcttcacatgagttattgcaccttttgatgttgctaaaagggtttccacaaatctttttccaactatctcttggtgataaggaactcgatgaacagatgatgattatgtcaacggatttgtataatattgccatgcatcgagtagtggttgcagaacaacgtaagcatggttttattaccgatgagattgaagagcagtatctaaaggggattgaacacacattaactccggaaaaagaggaagatgatgaacggacgttacggttgttaacccttttggatgccttggtcttttatggtgatcacctctcaaagtatgaaaaaactttagcagaaaagtacccgcttgcactgaccgcggcaaaaaagatgtatgctgagattacaaagaagccaattaagtcaccattcgatatgcgccggtcaattgttaagatttattctttgtttgatcaacaaatgcaggaatggggcttaccagccttacataataatgaatatacaactctctcaccggtattaagtgcccggcaattacgtttagagatgcgtcaagtttttgaaatctatcactctgatatgaaagaacgggggacagataagcgcgcctatgttggtcttcggcggagtgatggtcaaaattcgtttactcttccggcaccggctcaaaatgcgccagaagaatttaagaagatatatgatcaaccagtgaaggaatttcttgaacagaatagcattccatacattgtaaggaagtgagttagatggatgcgacgattcaaaaaacatttgacgacgcaaaaaatattgtctttctaacgggagctggtatctcaactgcttctggtattcctgattttaggtcagcaaacggtttatatacgcaaaatcggaatgccgaatattatttaagtcaccgttattttgctagtgatccagaaggcttttacgaattttgcaagcagaatttatattttccagatgcaaaacctaacgtaattcatcaaaaacaggcagcgttgacgcaacaggatcgcgcgacagttataacgcaaaatattgataacttatatgaagaagctggaacaaaacacttaattgattttcatgggaacctcttccacgtttattgtgaaaagtgtcatgaaacagttccggtgagtgaatatttgaatagtcgcttgcatcaaaaggataatggtcccttgcgtccggatattgtgttatatgatgaaggaattaagcaagaggatattgtcaattctgtcaaggcaatgcaacaagctgatttagttgtgattgtgggtacttcgatgaaagtatacccatttgcgggcttgctagattaccgcaatccaaacgcaaaggtgattgctgttaatcagcagttattgcaatttccttttaactttcaaatggttcaagatgacgcaacaaaattctttgacgaattaaaagtataaaaaagaagctgcagttgtctgaggacaatttccagcttctttttgctccagtagttattcaaagaaaacgaccttcccatcaactttgaatgggagtgctactaaatgagaacccttctttttagtagtagccttttcttgataaaaaatgtgacgaatacctttgttctttagtagcatttctgatcgctcctttcatattgttcacttgtaaaataacatgttttgaacgttttccctagagaaataatgaagtatgagaaacgatttcattttaatgggtgaaaatgatgcataatccgttcgttttttactacaaaaatgaataaaagcgataaaaacaacgattcaagtccttgaaaaatgaatatagatttattttgtagtgtataagaatttgctaagtaatttgatgaggattttggggtacgaaagagaggattaaagatgaaaataacgatggggatgacaacttggacagagcatccagtactcattcatgatgaacaacgcccagtaaggcttgatgagtatgctcaacattttccagtcgttgaggtggatacttttttctatgctttacctcagatatcaacgattcaaaactggcttgctactgttcctccaacttttcagtttatcgttaaagctaaccagaaaatgacactgcatcagcgaaaccaggaacgtggcgaattagaacaggtctttcaacaatatcgccggataatctcccccttggtagctgctggtcaattaaagacgatattatttcagtttcctccatattttgatgcaactgtgcgtgatttttcttacttacgattaattcgggaatggttaggaaacttgccaattgcagtcgaatttcgtaatcaaacttggtataagaaagaaattttaccgtcagtcttagacttctgtcgtgaactcaatttcacattagtggccgctgatgaaccccataatacgccaacgtcagtaccatttgtgcttgcaacaactaatcccgacttagccatgctgcgccttcatggtcgtaatcgcaaaggatgggaaaatcaaggaaaagaatggcggaaaacgcggactttatatcgatattcgacggaagaactccaattctttaaaaaacaaattgagtccttgcagccgcaacctaaagaactctgtgttatcttcaacaacaactcagctaaagatgcagcacccaatgcattgagtcttcaaaaaatgatgaatattgaattcgagggcctggcacctaaatcgccagaacagcttgatctgttttaggatggagcaagccctaataaaatgctatactaaatgttaaatcttaattagtaatatcttagaaagaggggcttcatatggctgaacaaaaaccaacttattacattacaacaccaatttactatccatctggtaaactccatattggtaattcgtacacaacaattgcatgtgatgcggaagcacgttttaagcgtttgatgggttatgacgtattctacttaacaggaaccgatgaacatggccttaagattgaacaaaaggctgaaaagctcggcatgaagccacaagaatacgttgatcaaatggctgcccaaattaaagagctatggaaaaaacttgaaattacaaatgacaagtttattcggacaactgacgactaccatgaaaaagctgtccaaaaggttttccaacaattgcttgaccaaggggatatttacaagggtaagtatactggttggtactcagttgatgatgaagaatacttcacagaaagtcagttagcagaagtttaccgtgatgaagacggtaatgtgatcggtggaaaagcgccatcaggtcatgaagttcaattagttgaggaagaatcatacttctttaagatgagtaagtatgctgactggttaatgaactactataaggaacatcctgattttatcgaaccgcaatcacggatgaatgaaatgattaataacttcttaaagccagggctagaagatcttgcagttacgcggacatcatttgcctggggggttaaggttcctaatgaccctaaacacgtggtatacgtatggattgatgcattatcaaactatattactgcgctaggatatggcagtgatgatgatagcctcttcaagaagtactggcctgctgatgttcacatggtaggaaaggaaattgttcgtttccacacgatttactggccaattatgcttcatgcgcttggcttaccattgccaaaacacgttattggtcatggatggttaacaatgcgtgatgggaagatgtcgaagtcaaagggaaacgttatctatcctgaaacccttgttgatcgttacggccttgatgctacacgttactacctattacgggcaatgtcatttggtaatgatggcgtctttagtccagaagactttgttgataaggtaaactatgacctcgctaacgatctaggaaacttgctcaatcggactgttgcgatgattaataagtatcaaaacggcaaattgcttggtactaatgatgcaactactgattttgatgctgatttagaacaaactgctagtgatgtaatcgctgagtataaagaactgatggacaaaacacgatttgctgaagcattggcagctgtttggcagttggttagtcgtgctaacaagtacattgatgaaactgaaccatgggtattagcaaaagatgatagtaagaaggatgtattatcagatgtgatgacccatctagcaaagagtttgcggattattgcagccctaattcaaccaattatgccgcatgcaccaaaacaaattgttgaacaacttggaattgaagggactgacttatcattaaccgatcttcaatttaatgatttcccagcagaagctcaggttgtcgccaaaggaactccgatcttcccacgattggatgtgaaggccgaggttgaatttattaagagcaagatgacagtaaacgaaaagaagaagggaagaaaggcaatggctgaagcaaaagaaaaagcccaggaagcagcacaagaagaaaaagcagatggcaaaaagccaattcggattgatgtctttgataaagttgaattgaaagtagctcaaatcactgctgccgaccatgtagaaggtgctgataagcttctgaaattccacatggatgatggaacagaagaaggtcggcaaatcctttctggaattgctaaatggtatccagatccttctgttttagtaggtaagaaagttttgattgttgctaacttgaaaccacggaaaatgcggggcgaattaagccaaggaatgcttttgtctgctgaaaaagacggtaatgttcaagtagtaactgttcctgacaatttagtacctggaatgggcgttgaataaagtgagtaatcatcaacaccagcaattggtttatgattcccatacccacctaaatgacgatgtgttttatgatgatgtgcctgcctttattaaccgtgctgctcattatggcgtgacggagatgaacattgttggctcgaaccagctattgaatactcgtgctttaaagttgggacatcagtacgataacctgcatccaattatcggttggcatccagaagatattgctaattggaatagtgaaaccaagaaagaattacgccaacaattagcagatcccttagtcgtgggaattggagagattggcttagattattataatgacgagcattctcctcaccagcaacaacaagaaatttttgctgaacagcttgagtgggcgcgagaacttaaattaccggtctcaattcactgccgggatgcactagctgatgcatatgaaattttgcggaatgcccacgtcgatgaatttggcggggttatgcatagttttaatgggacttcagaatgggcagagaaatttatggatctcgggatgatgatttcatttagtggtgtcgtaagctttaaaaatgcgacagaagtccatgaagcagcattagttgttcccctggaaaagatgatggttgaaacggatgctccttacctaactccgctcccataccgaggaaagcaaaacgaacccggttttactaaatttacggtggatgcaattgcagatttaaagcaggttgatgctggcaaagtggcatataaaacatttacgaacgctcgccacttatttttggaaaatgaagaaagaggcctatgattagaataaaagaagttatagttgttgaaggtaaagatgatactaagcaaattttaaaagcggttgatgccgatacttacgaaacaaatggatctgcaatttcaacggctgacttggcaaagttgaaaaagttacaagcaagccgaggcctaattgtttttactgatccggactttaacggggagcggattagaaaaataatcagtgaagccattcctggcgttaagcatgcttttattaaacgaaaagatggtgtgccaactgaggctcacggtagcttaggggttgagcatgcaacgccagcaattataaaatcagctttggagcacctttatactcaaacaacgacacctcagcaagtttttaagcgagaagatttgcaaaaatggggattaacaggtcaagcagattcacgaaaacggcgtgaaaagttagggcaattactcggaatcggttatggaaatgggaaacaattgattcaccgtttaaacatgtttcaagttgaccgggcaacatttgaaaaagcgattaagcaaataaatcaggaggcagatcatgagtaattcaccagaaattggtagtcgaacacgtacccgcgcgataatggaaaagtacgggatccgaacaaaaaagagtttcggccagaatttccttactgatttgaacgtcttaaaaaatatcgttgaggcagcagatattacagctaatgacaatgtaattgaaattggtcccggaattggtgctttaacggagcaattagcacaagcggcgggagaagttttagccttagaaattgatcaagatttaattccggtattaaaagaagtattatcaccatatgataatgtaaaagtgattaatcaagatgtccttcaagctaatttaccagagttaatcaaaaaggaatttaaggatcctagtcgaccaattaaggtggttgctaatctcccatattacattacgagtcccattctaatgaatttgctggctagtcctgttgagtgggcgacgatttgtgtgatgatgcaaaaggaagttgctcaacgactcactgctaaaccaggaactaaacaatatggtgcgttgacattagcgattgaataccaaatgcaagctaaaattgcttttgatgtttcacggaaagtattcgtgccgtcgcctaatgttgattcagcaattgtggtattaacgccacggacaaatccgcttccggttcagccttttgataagcaaaaattatttggctttatccggggatgctttgctcatcgtcgcaagagtctttggaataacttgcaaagtgtaattggtaaggatccagcggtaaaagagaaaatgactgctgtcttagctcagctggatatttcgccacaaatccggccagaaaaattaaccctcaaacaatttattgaacttgcgaatgctcttcaccggcaaaatctcttgtaaaagatggttgaccgttataaaatattatggtacaattttgatttttgtgtaaaaaaagagtatgctagtctacagtgaggtgaaggagtcgtgcctaatagcattgtagaaattaagaagaagctagatgaacggattggcgagcatgttttagtaaaagcgcaagctggacgtaaacgtattaccacccatcacggtattttaagtaagacttatcctgcagtatttgttattcatttaaatgatgaacaaggaacattggatcgagtttcctatagttatactgatttgttaacacgaaatatttcaattgccttcgatgaagcagaataaactgataatttaaaattcatatttataaaataataggagtgagtaaaaatacctttcaacaggaaggcagtttttattcactccttttgctttaggaatagttaggaaacagtagttgcaaggattatagttccgttagtataatttaactaactaaattattacaaataaggagggttgccggatgatagttacagaaaaagcaccagcaaaattgaatttgagtttagatacgccgatgcgatattttgatggttctcctcaatgggatatggtaatggtctcggcagacctggctgattatgtaactgttgagacacaccggcgccctgcaacaattaaagtctatacaaatagtggctttttacccaatgaccaacgtaatttagcataccaagcagctcatattttacgtagtcgttttcattgtaaagatggcgttacaattcggattaagaagcaaattccagtcgcggccggattgggcggtggctcttcagatgcagcggcagttttacgcgcattaaatagtatttggcggttgggcttgagtttatcagaactagcaaagatcgcattaacaattgattctgacgtcccgtattgtatatataacaaattagcccacgttactggccatggtgaaaaaatcgaattgttaccaccgcaacctcattattgggctgtaattgcaaaacagaagatcagtgtttctacgccgcaaatcttacgacaaattaattatgagaagcttcaacatcttaataatgaagcattactgacaaatttaaagaaagaagattggcaagaagcaacaaaatatatgggaaatgttttagagcccttaacgatgaaattttatccagagattggtcgtctaaagaataagatgaaagaattgggggccgatgttgcccagatgagtgggacgggaccaaccgtcttcgcaatctgccatacagaatcgcgagcaaaacggattcaaaatagtatccggggattttgtcgcgacgttcatgttgtaactttgctttgattatatttaaggacaagaggaatgaggctgagagaaaacttttgttttctcccagcctcaactgcttttatgaacaatagtaagataacgtgaaactagcttcatgtcgccacaagactcgaggctaagtacgaacgctaatcagcccgtgccgtgctaatcatcgttctagcttagcccaccgccttgtcgaggaggttattttccactctcctcttgtcctttttatttttatagttgcaatctagcataaagttcgatattatattcattgttctaaatagtaatgattacgattaaagaagagggaaagaatgaaaaaatatattatcagtattagtagtattgttgctttgttggttataattcttgggttatcctttgttccgtggaaatcgatggggaaaaatcaaaagccaattagagtggtaactgggatgaatttctatggtgaagtagcgcagaaagtagctggcgatcatggccaagtgatttcgtttattgataatgcttcggttgatcctcatgattatcaacccaatactaagcaagcccagcaagttgctaaagccaatgtagtaattgaaaatggtcttggttacgatagctgggtaaacaaactcgttaaatcaagcagtaaccataacaagattaaagtaattaatgtagcatctttaaccggcaagaaagatggcgacaatgagcatatttggtatgcacctgagacggtcgaaaagttagcaaatgatcttgcaactcaatatggtaaaattgatccgcaacatgctaaggattaccaaagaaatgcacgcaaatatttagcttctcttcaaccgcttaatgaagaaattgcgaaagtaaagcgccaggtaaatcctaataataatcgagttgcagtcagtgaaccagtttttgattatgccttagagaatgttggttatcaaattatggacaagcattttgaaaaagcagttgaagatgggaatgatccatcaccaaaagatattgaagaaattcaacaagcaatcattaatcaccaaattgccttctttgttgataattcgcagacaagtgataaagttgttgataatttagttaaacttgcccatgaacataatgttccagtattaaaggtaacggaaacaaagccgaatgggtatgactatatgcagtggatgctcaagcaataccaagcattgtctcgcattcaacaaaaggagaattaagaagataatggcagttgtatcagttgatgatttaacgatcgcttatggaaatcatactgtaatcgatcatttaagcttctccattaatgaaggggattttcttgtcgtggttggtgaaaatggggtcggaaaaacgactcttgttcgctcaatgcttggttttttaaaaccgaaaagcgggacaataactattccgcaaagtacacgacttggctacgttcctcagtttcgtaatattgacgaggaatacccgctatctattcgcgattttgttgctttaaatactaaaccacgccttttgccatggctgactaaaagcgagcgaaaccgtgttgaacggatgattcgtgaaaataacctaacaaagattgctgagcggccccttggtttagcatcagggggtgagaagcaacgagcatatcttgctcaagctttattacccaatccaaatctccttattctggacgaatcgacggcaagtctggacaatgaaatgaagtatgaattgctagacctggtaactcgttttcaacaaaatggtttgagtgtaatgtttattactcatgattgggatctagcaaaacaatatggaactcgtttcttgtatttatctcccggttcttattccactgggccaattaatgagttacccagtccggtaaagggggataaaaaataatgttaactttaagttttatgcgtcatgcatttgtcgctagtacatttattgcgattatttgtggaattattggagtttttgtcgttgcacgaaatttatcattcttaacgcataccttgtctgaaattgggtttgctggtggtgcttttgccgtttttgctggatggccagcactaaatgggatgattctgtttacaatgttaagttcagttattgttggacaaatgagtataaaagaatcacgacgagaagcggttattagtgccgtttcagcgctgttcattggcttaggaattcttttcttatctttgagcagtcagtcagctagctcagcaacaagtattttgtttggtagcgtggttggaattagtttgaatgaggtctggcagcttgtctacctttccattcttgttttaatcattttgctattgatgtatcgtcgccttaagtttgattcctttgattcaattggggcacaggtcagtggaataaatcaaacagtgatttctgttatttttcttttactacttgctttaagcgttagtgtcgctgctcagattgtcggttctttgctaatttttattctcctaacgttaccagctgctagtgctaaatactttacgcatggtgtcgcacggatgattattttagcgattttattttcactgttaggaacatggcttggtctttttctcggttatttgacagattggccggttagtttctttatcgcagtgattgaagttatcatctataccacagccttgatttatagtaaatttatcgaatcgaattagactgtggcttaagtagttaagcaggtaaacaacatagtacaacaatggtcttcaacgcccggcaaagtgttggagactattattatttgcggggctttcagatgctagcttcgtggtgacaaaacgcccccctatctcggactctttttcttcagtaaatactaaaatttttgccgaaaatccgaacattttatgttaaaatcaatgttaattaatcctttttgaaaggcagagaaagaacatgaaaattagacggagtaaccgattggtggatatgacacgttacttgcttgaacatccgcgatcattagtatcgttgaaattttttggtgagcgatatgactcagctaagtcatcaatcagtgaagatttaggaattgttaaacataccttccaaacgtggggacagggacgattagaaacaattcctggtgcaagcggtggcgcgatattaacgccattttattctaaggaaaatgctcaggcggccattgataacttggttgaccgggttaatgatgactcgcgtttgctaccgggaggttatgtttacttatcagatttaatcggccaaccggaagtcttgcggcagattggtaagttaatcgctactcaatacgttgatactgatgttgatgttattatgacagttgagactaaaggaattccgattgctcaaagcgttgcgatgtatatgaataaaccatttgttattgttcgtaatagttcacacattactgaaggacctactgtaagtgttaattatgtttctgggtccgtccaacggataaagaagatggaattgtcccgtcgtacattatcagctggggcgaatgtcttggttgttgacgactttatgaagggcggcggcacgattaacggaatgaaatctttgattaaagaatttgatgctaacttggttgggattactgtttttgcagaaggtcgtccggtaaatgggcaacggttagtcgataactgtacttcattaatcaaagtggaaactaaagatggtacggagaagaagattgcagcacaagcaggaagcttcatggaaaacgtgtttgataagaaagtagagaattaggaaatgacaaaacgtaatgcaattattttagctgctggtaaaggtacacggatgcgctcaaagctatacaaagttttacaccaagtttgtggtaagacaatggttgagcatgttttaactcaattggaaaaagccaaaatcgataatattattacaattgttggttttggggcggaaacagttaaacaacgattaggacaccgtactaaatatgcgctgcaggaacaacaactcggaactggtcatgccgtaatgcaaacaaaaaaccttcttgcaaatgaagatggtgaaactattattgtcagtggtgatactcctttatttacggctgagacttttgaaaagctttttgaatatcatgaacaacggcatgcggcggctactattttgacttctattgctcctgatccaactggttatggtcgaattgttcgaaatgatgttggaatcgttgaacgaattgtggaacaaaaagatgccactattcaagagcaggcaattaaggaaattaatactggagtttactgctttgataacaaaaaactatttgctgcccttagtaagatcacgaatgataatgctcagggtgagtattatttaactgatgttattggtattttaaagcaagaaaatgagatcgtaacagcctacaagatggataactttgacgaatcgatgggggtaaatgaccgagttgcccttgcacgtgccaacaaggtaatgcgtaaccggattaatactcattggatgcgtgaaggggtttcgatgattgatcctgatacaacttatattgatgctgatgttaagattggtcgtgatacagttattgaaggtggcgttgtgatcaaggggcatacagaaattggtaacgattgttatatcggtgctggttcacggatcattgattccaagattcacgatggggttaaaattatttcttctacccttcaagaagcagaaatgcacaatggcagtgatatcggtcctaatagtcacctgcgtccagaagcagaaattggcgaaaacgttcatattggtaacttctgtgaggttaagaaggcttacattggtgaaggaacaaaggtcggtcatttgacttatatcggtaatgctactttaggtaagaatattaatgttggctgtggagttgtctttgttaactacgatgggacaaataagcaccataccaatgttggggaccatgcctttatcggtagtaacagtaacctagtggctccggttaatattgccaaggattcatttgtcgctgctggttcgaccattacagacagtacagaacaatatgatatggcaattgcgcgggcacggcaggttaataaagaaaattatgctaagaagctaccatggtaacttgctttttgcctcactaatttatattatgtaagtggtagtagtataacttttattaatcagcggaggacctaatgacacagcaatattttgatcaaaatttaaaaatctttgcgttaaattcaaaccgtcccttagcagaaaagattgctaagcatgtcggtgttgatttaggaaaattatctgttaatcgttttagtgatggtgagatccaaattaatattgaggaaagtgtgcgaggagacaatgtttatgtcatccaatcgacctctgccccagttaatgacaacttaatggagttgttaattatggtagatgcacttcgtcgtgctagtgccaagacgattaacgtggtgatgccatactatggttatgcccgtcaagaccgaaaagcacggagccgtgaaccaatcactgctaagttggttgctaatatgttgcaaaattccggtgttgatcggattattgcacttgatcttcatgccgcacaaattcaagggttctttgatatccctgtcgatcatttgatgggtgctcctcttttagcagagtattttatcaaccagggtgttgctgaaaatgcagttgttatttctcctgatcatggtggagtaacacgggcacgagcacttgccgagtttttaaaatctccaattgcgattattgacaagcggcgtccacgggcgaacgttgctcaaatcatgaatattattggcgacgttaagggtaagaagtgtattatgattgatgacatgattgatactgcgggaactattagtttaggttcgcaagcattaatagatgccggcgcagaagaagtctacgcatcatgtacccatgcggtattatctggcccagcaattgaacgtttacggaatgcaccacttaaagaagtcgttgtgacggactcgattcaattgccaaaagaaaaacaaatcgataaaatcaagcaggtatcggttgctccactaattggggatgcaatcaaacggattaacgaaaatcgtccggttagtccactatttaagcaagtattccaaagtgcacagttggaaaagaagtaaggcttaagtaaattgagattagtaaataagtagggactgtgacataagtcaagttactttcataaaagacaaatggcacagtacaccaatggcttccaacgcccggtaaaaccgaacgttggaggcctattgttgcttgcggggctcgaaaacgaagtcacaagtgacttctgtctcgcttcctttcttatattccatttctgtatttaaaagaaaataaagatttgggaaagacaaacagtcattatcaattcatgttataatacgatgtgaaataaggaggagaaaaatgacaacaattaagtttttcaaaaaagcaatggttggaacagctgcagtcgctactatctttgccttagctggttgtggtaaacaatctgcgtcaagtagtgatacaagttcttccagcacatcgtcgtctgtccgttcttccgaaagtaaagcttcaaaggcttatcgtacagctaataagcttatccaaaatcatgattatgaaggggcttatgaacagttaaaccaattaaatgatcataatgctcaaacggaagcacttgctgatgatttacaaagctacatggatgcccaaaaagcatatgaaaatggcgattatgatggtgctaagaacaaattgaaatcacaaaagtcaactagtccggcaatgcggaatgcatacgctgatttacaaagcaaggtaagttctgcacagggttctactagttctcaaacttcatcatctactaataatagcaagcaaacaaataagcaatccggttctacaagtgcagcaactcaacaatcatcctctgctgctaaccaagctgcatctgatgcaactagcgataatgtagtacaacaatttgctaacaagatgggcttcagtggctcccaaggttaccaaattatgccaactggtaagactggtaatgtttacaagtttgaagtacgtcaaaacaatagtgataacactgttgctaacttaatcggtatttaccaatacaatagtcaaactggagcggtaacaaaaatcgcttaatatataaaagatgacaaaaataaaagcaagaggtgtagaaagtacgcttcttgctttttatttctgtctttacttaagaacatatttttcaatcgcttttccaacaccatcatgattattatcagcggttgttacgtcagcgatctttaaggtaccaggaattgagtttcccatcgctacccctaacccagcaaattcgatcattgaatcatcgttttgtgcgttgccaagggccattacttcttcttttttaattccgagttcttcgctaagtaattgaagggtatttcctttacttgcttgtttattcatgaattctagataaaagtcttcgctgcgaacaatggaaaagcggtcacgcatttctgccgaaagctctgcccaggctttgtcaatttgttctttagtatcaaccatcattgctttggcgattacgtattgatcttgcattttagaaagttcttcaaaggtacgataacgaattggcatacttacaaggtctgactcgtagactgtataaggactcaaatcccggttaattgtgtagatgtaatctcgcgtttcgatttgggacttgacgccttctttaatacaataagtttgccagtctgcatagtcattgaaaggcatcgtgtaatttaccaggacgttcccactagttgattgggccagtgcaccgttgaagctaataacaaattcgttatctgaatcatttaagcccaattggtcaaggtatgcttttacgcctgtcattggacgtccagtgcataagacaatctttactccctgcgcgctggctttttttattgcagcaacagtttgtggtgtgatttcacgttggtcattgattaatgttccatcgatatcgattgcgactaatttaattgccattatttttgctcctttgggttaataatatgattattcttgatatagctttgaaattcttcatagattggttcgaaaatttcaatattgtttcgcgtttcaagcatctcttttgggaaaaagaaccgttgatctccggcttctcgtcccgatacgctagcgactaaggtactaacttgggatagttccacaaaatcgccattaggttggagaagctcgatttgcgtttgagtattagaatcttgtggatgataagtatcatatggaagtttaaaactatcgttgactgcggtgtaatactggctattaaacccagcagtttggatgagctttcgtaaagttggtaaaagtttttgtgtattttgatcataaatgactgatttaaatggtcggcggttaagaaaacgactagcaaggtcgcttaaaatatcatcacgagaatgggtccaatgaataaaataggtggttaagacaccatcgtcaagcgccaaatagtcatccaaggtaaacttaccattaaaaaacggcatcagcatatgaggggtgaagtcgggctcaaagtcattaggatgttggtaaatatattttgcccgcattaagaggtggtctaagataacttccattgaacgggaaactgggtgaaagtagacttgcagatacatttgaaggcgactgataatgtaatcttctaccgcatgcattcccgaaatttcaaaggcaattcctctcttaactggtcgcataacatgaagaacacgatcaagatcaaactttccgtagtttgttcctgtgtaatacgcgtctcgttgcaagtaatccatccggtccgcatcaacttggcttgagatcatttgcaccacttgtggattttcataagtatggtcgatcacactagcaacttgatgaggaaaatcaggggatacccgttgtaatattttattaatattagtgctgctgtcggtgatcaactggcgggtaatttgctcatggtttgtatggaaaatatgctcaaatgtatgggaataaggaccatgccctaaatcatggaggagggctgcacataaggcaactggtcgttcgtgatcatcccataggccgtcgccaggatgctgactaggatagtttcgctggaaatagttgcacatttggcgggtaatttcatagacgcctaagcaatggccaaagcgggaatgctcggctccatgaaaagtaaatgatgaagttcctagctgcttgattcgtcgtaatcgttgaaactcaggagtattaattaggtccataataatttgattatcgacaataatttgtccgtgaattggatcgcgaaaaaccttttcacggcgaagtttttcgtcataaaagtgattcatattaatcttctttctctaaacgttcttgtaaacgttccatgctgattagttctttattgagggttgatataaaattaggcgaccacattaagttattaaggctgtcaggaacaatgatttgaacgactgattggattcgctggatcgcatcctgaacgcttaattgcgtgttgagggctttagagatagttgtcatcgctcccggccaaacatctggaaaatgccacttattttggctttgctgcaatcctgtatcatagaagtcacgaattagtttgccccgatcctgctgattgccaccgacacttaagtaaagcattactgtaactcccattttgtttcggcgttgggaaatgccaccgattttttggccgttaacgctgatatcaaaactccccggacagtatgaatgagtgatttcaccagtagcgatttttaggctaggaaaagcagcctgaattaggtcgaccattcgttgatatgcttcatcaatagttaattcatggtcttcgaggtgccatggatagaaaattgacaggtttaaaataccgtcgtcacttacaactgctaatccccctgaattacgcatgaaataatgaaaaccacggtgcgtaagcgaagtaagggcagttgataaatgcggtaatcgttgatcttttaaccctaaaataaccgtatcttctaaggtccaaaaatgaagaagaggatatttgagtttgttagctgaacgtaacaaagcgttggtatagatgaaagacgaaagattatccgctggagttaaaggttgaataaaccgctgaaaacactgattcttaaaattagccatcgtacttcttcttttctatgaaataatatatctatattatacaagaacttacgagaacatggatatttcacggggtatttatccataaatttgcgagaatacccccacttctataagtaggggatgaatcgctctcttaaagcacgttagtgctttttcttttgttctatgatatatttagtatatatctataaaatgtggtgataacaatagaattggatagaaatcagcattcagtatacttacttaattaccatttggtaatggtggttaagtatcgtcgaaaagtaattaacgatgaaatatctgaatatcttaaacatcgttttgtagttgtgggacaagcatacggcattaatttgcaagaatggaattatgatcaggaccacgtacatgttttgtttagagcaacgcctcatacggaaatggctaaatttttaaatgcttacaaatcgtctagctccagaatgatcaaaaaacaatttccagaaattaagcaatatctttggaaatcagccttttggacacaaagctattgcttaattagcactggtggagcgcctttagaagttgtaaaacgatatattgaaagtcaagggagaaaataatggttctaaaagccgttaaaatgcgcatctatccaaattcagcacaacgaaatcagctctggcaaaccttcggttgtgttcgttttgtatggaatcaaatgcttaatatgcaaattgaacggcgcaagaataatccggaagctaaatttgtgaatgcctttgggatgaataatctgttgaaacaacttaaggttgagtatccttggttgaaacaagcagaatcaactgctttgcaaagtgctaatcgcaatttagccgatgcttttcaacgcttttttaaaggtcaaaataagttccctcgatttaaatccagaaaatattctcagagctacaattcaaagtacgttaatggcaatattaaagttttagattgccatcatataaagttaccaaaactcggtatcgtctattttagagctggtcgattgccaatgggtaaaattaagaatgtcactgttcgtctgaacgttgctggtcaatattacattactgttttagtggaaagcgaaaaccaaactcttcctaaaacaagtaaatatattggtggcgatttaggacttaagtcattacttaatctttcagatggatgcaaggaaccgatcaatcattttgaagacaaataccataaaaagttgtatcgttgggagaaattgcgtagtcgtcggttcttaaaggctcagcaggaaatcgcctgggatcatcataataaagtgttagttccacggcaattagatgattttaagaattatcagaaagctcgtattatggtggcgaagtatcgacaaaagattgccaaccaacggttggatcagctacaaaaattcactactaaattggtcaaaaagtacgacatcattgtgttggaaaaacttaatactaagggaatgatgaagaatcaccatttagctagagcaatcgctaacgctagctggtcaaaattagtagatatgttgcaatataagtgtggctggtacggtaaaaagcttattcaggtcaatccgtcatatactagccaaatttgtgctaattgtgggaagaataatcatcggttaggattgaataaatcggaatggttagcggtacgtgagtgggattgtccaaactgtggtaaacatttagatcgtgatattaacgctgcacaagtcatcttgcaaaaaggattagctatccgatagataaagttaggctcgggacgagccttggctaatagtcgtaacctctgcttgaaggttcgttcagaatcggtagggtaagtatgcgatgtttccagaatctcccacttcaagcattaaaccgtaggtttagctaagtgggagtagttcaatggtaaaaagagtataataatgacgatgagcaaagtgaaaggaggagtttattatcaaaagtgtaattcctgttcatgtaaatctctcaacgatcattgatcaaaatggacagcaagaaaaatttacctttactgaagaaggtacttttgttgaaatgaatggtaagtattatttacggtacattgaacaccaagatggtcaagaaacgccggtccaaattaaatttgaagatgagctaatccgcttaagaaggcgtggaaatgtcgaaacaaacctatttttagacccaacacaagaaaccatcatgcggtaccaaacagaatacggcatgattaaaattgacgtgttaacagaaagtttggaaaaagacgttgatgtaaaggctccggctggtcacctttctgttaagtaccaactaaaacaagcgggacaattaataggtagttaccaactagaattgcaatttgctgcttaatattgtatgatgtagtttagactttttgaagggatgtgcaccaatttggatttaaaggtttttgacggtcaggacaaatcagaactttcaatgattgaagtcgcacacgctattttagctcaccatggggaagcaatggcgtttgttgatttaaccaacgaggttcagcaatatctgggtaagagcgatgaggaaattcgtgaacgtcttgcacagttctatactgacttaaatgttgatggcagttttatttcccttggtgacaacacctggggtctgcgtgcttggtacccattcgaatctatcgatgaagccacagttggtgaaaacgaagaagatgaagaggatgatcgtccaaagaagaagcggcgtaaagtcaatgccttcctcgcagacaccgatgacgatgatgatgtaattgactatgacaatgatgatcctgaagatgaggatcttgatactgacgatgacactgattctgaagatgattatgatgacgacactgatgacttcagtgacgacgatgatgatcttgacgacggtattgaaggtcagctatcagaattacatgatgaagaagatgaagacgaggatgacgaatgattttcaactttgtgcttgactattatttattgaccctgtattatttttcttgggcgcctgtaaaaacaggccaataagttcgtagataaataagctccctgtttcagtgttttatttgaaatagggagttttttctattatcacacccgcaaatataaaaaaggagtagacgacaatgacgaaatacatttttgtaaccggtggagttgtatcatcattaggaaagggaatcgttgctgcctctttaggacggttattaaaaaatcggggcctgaagattgcaatccaaaaattcgatccttacatcaatgttgatcccggtacgatgagtccataccaacacggtgaagtttttgtgactgatgacggaacagaaactgatttggaccttggtcactatgaacgttttatcgataatgatcttaataaatattcaaatgttacaacgggtaaaatctactctgaagttcttcgtaaggaacgccgtggggattaccttggtgggacagtacaagttattccacacatcactaatgccattaaggacaagattaagcgtgctggtgaaagtactgatgctgaagttgtaattaccgaaattggtggtacagttggggacattgaatcacaaccattcatggaagctattcgccaaatgaaagaagaagtgggtagtgaaaatgtattgtacatccatactaccttagtaccatatcttcgtgctgctggtgaaatgaagactaagccaactcaacacagtgttcgcgaattacgtggtttaggaatccaacctaacattttagtcgttcggacagagcaaccaattactgatgatatgcggaagaagatcgccttattctgtgatgttgatcctaaagccgttgttgaatcgatggatgttcataccctttatgaaattccgttaaacttacaaaagcaaggaatggatcaattggttgtcgaccactttggtttaaacgtgccagaagctgacatgacagaatggactgaaatggtaaatcatattgaacatgacttaactaagaccgttaagattgcgatggttggtaagtatactgacttacaggatgcttatatttcagttaatgaatcattacgtcatgctggttatcctgtcaatgctaaggtaaagattgaccactttaatgctgaaaacattactccagaaaatgttgaagagacattgaaagactacgatgggattcttgttcctggtggttttggaaatcggggagtagaaggaatgatcactgcaattaagtatgctcgggaaaatgatgttccttatctcggcatttgcttagggatgcaaacagcatgtattgaatttgcacgcgatgtattaggctacactgatgcaaactcaactgaatttgatacaaacactaaacacaatattattgacttgatggcagatcaagcggacattgaaaatatgggaggaacacaacggcttggtgcatatccatgtaagcttaagccaggaacagttgcggcagcggcttatggtaaccaatcaatgatcagtgaacggcaccgtcaccgttatgaattcaacaacgactaccgtcaagaaatggaaaaccatggtttagttatttctggagtaaacccagatcggaatttagttgaagtagttgaaattcctgataaaaaattcttcgtggctgctcaatatcacccagaattcaagtcgcgtcctaatcatccagaaggattatttgctgcatttgtaaaagcagctgctgaggacaaataaaaattaagttgtataatatatttaatacaagagatgggggcaagaatgtcgcttctcttgttttttgtttagtagaattgttaaattttaagttaaatatgctaatttttggcctgaccttatgattttttttaagattgtttataaaaggttgtaattctcttgatatttcattatcattacagttgactgttttgtaactgaaataatcattaacttagcttaaatgaaaaacagactaaaatttttaagtgaggaaacgcagaaatgaagaaaatgatcattcaaggaggaaaccgtctttctggcgaagttacgatcggtggtgccaaaaatagtacagtggcattaattccagctgctattcttgcggatacccctgtagagtttgacacggttccagatatcttggatgttcacaatctgatgattattttggagtcaatgaatgtaaagtccgagtttagtcacggagttttagatattgatccaacacaaatcgtagaagctgaacttccaagcaaggcaattaaaagtcttcgggcttcctattactttatgggtgcattattaggtcgtttccatcgcgcgacattaacatttccgggaggcgataatatcggcccccgcccaattgaccaacacttaaaagcatttaaagcacttggagcaaccgttagcgaagaaaagggtactgttcatttagatgcgccgaatggcttacatgggtctcggatctttttagatatggtatcagttggtgcaacgattaatgctaccttagcagctgttcgcgctgaaggaacaacgattattgaaaatgcagctcgtgagccggaaattattgatttggcaacattcttaaataatatgggcgccaaaattcggggtgctggaaccgatactatccgtatcactggagtaaagacacttcagtcaatgaatactcatacaattattgctgatcgaattgaagcaggaacatacctatccttggcagcagcgcttggtgatggggttatgatccataatgttattcctgaacacttagaatcatttaccagtaaaatgattgaaatgggtgttgaacttcaaatcgatagcgataagatttatgtaccaaaatccagtcatttacatccggttactgttaagacaatgccattccctggttttgctactgatttacaacaaccgcttaccccattgatgtctcttgctgatggtgatagtacgattgttgataccatttatcccaagcgtgtaaagcacatttcccaactacaaaaaatggggatgaagattgaagcacatgatgggatgattatcgttaaacatacagaaaagcttcatggcgcagaagtctctgcaggtgagattcgtgccggagcagctttaaccattgctggattaatggcagatggacagactgtaattaataatgccggaaatattttacggggttacgatcgaattgtatggaagcttaatcgccttcatgccaatgtttctattgaggacgattcttcagtaaaaattggttagaagttgcgtacttctttaaatcgtggtatcctgttagagttgattatctatgtttcaggcaatgattcatggcaaaaggagcgtaataaattatgaaacaaggaattcatccagattatcatccagtagtttttgaagattcatctactggttacaagtttctctctggctcaacagccacttcaagtgaaactgttaagtgggaagacggtaacgaatacccattaattcgggttgaagttacttcagattcacacccattctacactggtaagcaaaagtttactcaagccgacggtgctgtcgacaagttcaacaagaagtacggtctcaagtaatcgaacttcttataattcaaaaaagccgggaaaagcgaaagtttttcccggctttttttgaattaagtctaataaatcattattaacgttattttgcgtctttaagtattgatctttctctgcgtataatattgataattgagaaagtgggggctacctatgcatgaaaaaataattaatcgaataattgctctgcatcgttattcttttgttagaataactcggcagacattaattatgatttttcccattgtttttattggaacgatggcaaagatgattttgaaaactgtttttaaaccagatggatttatttataatattgcttttcttgatgtaataccacagaacgtgttgcggattattcaatttatgttaactagcattagtcaattaaccttagggattctaggaatttatactgtttatatggcagcaaaatttacggcgaaaaggtatcggcgagacggtaaatttgccggaataaccgctattttgacccttttactaatgtcttatcgttatggcaagtcgtccccgcaattttcccttagcttttatcaacggctcctcagtggcaatagtttgttaatcgttttaattcttggttacggaatcggccagctttaccggtggttaaccccgcccaaagatggtgataataccaatgcgttgccgttattacaggaacgatcatttagttcaatgctgccaatgacaattagtcttatttttggagtgacggttgctcttttcttaaattccaacacaatctatcatgcttggtcaacaagttactccacgttagttacgactgcccaagagcatcggcaattatggctgacgttattagctacaatggggctaacaatatttgattggttaggattaggtgttccatacacttcgatggcgttaacctctggagattcatttactgctaacttgaactatgcgctcgctcatggaactccgtggaatgtaccgtatgagtttttaggcagttctctttataattcatttgctaactttgggggcgatggattgatccttgccttgatagttgccattctgttaacttctaatggctcctatatgcattgtgttgcccagtggacggccttaccaacactatttaattttaattatgcggcaatgattggcttaccggttgtatttaatcccttatttctgatcccatttgtcttcttaccgattgtaaacattctccttgccagtttagcgattgcgattaacttaataccttcaacaccttacccggttttgcaggggacaccgggaccccttattagttttttggggacaaatggtaattggggaattttgatttttaccttggtattgcttttaatcgatagcgctgcctatatcccctttgtaaaactggccttagtcgttgaaaatcgcttaatattagcagaacaggacgtgatcagtcatgaaaaaaatgactaaatcaattctccacactcgtttagtattgattggcctaatattgatcttagtcctaatggcaattccagcatattattggatgaaagatacaaataaatatttagctgcccaacataattctagaatgtcgccgataattatggttcctggaagctcagcaacacaaaaccgctttaatccacttattcgtaaacttaacgaggatagccctaaaaaacatagtgtgttgcgcttagaagtaatgaacagcggtaaaattgtttcgcaaggatggataaatcgcggcgataacgagccgattatcgtgattggctttgagaataatcgcgatggctatcaaaatataaagaaacaagcgcaaatggttaataaagcctttgaacgattgacggaagagtataattttaataactttaaggcgtttggccattccaatgggggtctagtatggacttattggttggaacattactactctgaatataaagatgcgattacaattaaaaggctaatgatactgggaacgccatacaactttgcggagtcttctgttagccatccgacgcaaatgttttctgattttgtaaagtatcgaagtcgaattcctaaaaacttattagtttattcggtcgcagggacagaaacttatacatcggatggtctcgtcccagaaggaagcgtcgatgccggtaagtacatttatcaaaaacaagtggcccattatacgagtatgacggtcacgggaaaagatgctcaacactctaacttgccacaaaataaacagattgtacggttaattgaagagtatttgcttgatccaaatgacaacggtaatcctaattcgcaaaataagcagggggctactcaaaattaattaagcaggttatactaagttcataataaaaagtaaggagttcaatatcgtgaaaaaagataaaaagcgatcatttgaatggttatggtggacagcggttgttgtactgttattgatttcagttgtcttaatttttaaccaacagattaagtcttacttagtagggagttataaacctgagattactcggcaaacggttcaaagcaaccaaaagaaaaaagcgacctatgattttcaaagtgtcaaagatcttaacttgcaaacggctgccaaggctcgtgcaaataagcaatcgattaataccattggagcaattacggttccggctattaatatgacgattccaattgctaatgggattgataatacaacccttgcgttagcagcaggaacccttcgtccggacatgaagatgggggaaggtaactatgcgttagctggtcataatatggcccacgggagtaaaatcctattttccccattgtattatcatgctaaggtgggacagatgatttatatcaccaacatggatcgcgtttatgaatataagatttatcaacgtgaattcattgcggcgacccgggttgatgtggtagataatacaccggaaaagattattactttgatcacctgtgatgctaccgggaccaatcggttgatgatccgcggtaaatttgttaagtcagaaccatttacgcaagcaccacaaaatgtgcaaaagaattttagcgagaaatatacaacaggtcgttaaacaacctaagattagttcaggaagcgagacagaagtcacttgtgacttcgtttttcgacgcgaagcaagcctctgggagccctcgcaagcaacaataggcctccaatgttcggtttttaagccggacgttggaggccattgttgtactgcgtatttgctttttatgaaagtaacttaacttatatcaaagtccttttttgcttgcaaatttttagcaatatttgtaatccattccaaattaagaaaaacacaatgacgataaaaatagccaaattaaaataaattttaagtaaacagatgagcgaacggacaggaatgccaccgtttgctcatttttttgctgtaaataaatttcttgactcttttttaggaaccacctaagaaggagatacattgaatttaaggagatgcagtaatggaaaaacgcgaacaaatgaatgttttatggtttgatgaattgcatcgctcggacgttaatctcgttggtgggaagtcctcttcattaggggaaatgacttctgcaatgaaaattccagttccatatggatttgcgacgacaactcacgcttatcgtcaatttatggcggaaacgggattaaacgaccaaattaataaattattagccgaaattaatgactatgaaaatgctgacgaacttcatcgggtttgctcacatattcggcagatgattgtcgaagcaccgatgccaagtgagatcgctatgacaatcaaaaaagcttatgcagccttatcagaaaaaatgggtgaaactgaaccatttgtagcaattaggtcaagtgctaccgctgaagatttaccgaatgcttcttttgcggggcagcaagaatcgtatttgaacgtgcgtggagctgaaatggtattagcaaaggttcaagaatgttatgcttccttgtttaccgatcgggcaacctattaccggcataagcaacattttcctcatgaaaaagtggctttatctgcggccgttcagatgatggttttctcaaaagcttctggggttatgttttcagttaacgtggcgaacggaaatgatgcccaaattgttattgatacgatttggggattaggtgaatacattgttttaggaaaagtaacaccggatcattttgtgattaataaaaataaccttcaagtagtagaacgttcggtagttccgaaagcaattgaattgtgtcaaacccctggtggcggagtacatgaagaaccggtgccagcagaccgggcaatccggccagcgctaactgaaaaccaaattcatgaattagcaggatacgcaaaggaaattgaaaagcactatggttgttacatggacatggaatttgcgctagacgcccgcacagatcggttatggctagtacaagctcgtccagaaacggtttggtcgaataaaaataataagcaagcaacaaaggagtccactgtctcaatgaataaaactaaaaaaatcttggtcaaaggattaccagcaagtccaggcgtttccactggaaaggtacatgtaattgcggatcctaaagatattgatgaatttgaagaaggagaaatattagtaacgttgatgacttcgcctgattgggtaccggcaatgaaaaaagcagcagcaatcatcactgataatagtggaatgacctgccatgccgcaattgtttctcgtgaaatgcagattccgtgtatcgttggaaccaagagctgtgggcaggcagttactgaaatgctacaagatggtgaacaagtgaccattgatgctaaaaatggagtcgtttatcaaggtgatctcgcagaacaatttaatggcgaaaaagagacaacggaatgtcaccatgcagaatattacccgccgactgcaaccagggtcatgatgaatttaggcgatccagaactagcagaaaaatatgcagaactccctgttgatggcattggcttaatgcgagaagaatttctttggacgacttatattcatgaccatcccctctacttaattgaaactggtcatcccgaaaaagttgttgatatgttagcagatgggattgctaaagtggctcgggcgattgctccacggccgatggttttacgtttttctgattttaagtcgggagaataccgtaatttaacgggcggcgataaatatgagccccatgaacctgccgacttattgggatggcgcggcgcttctcggtactatgatcccaaatatatcgaagcttttaagctagaacttgcggcggtaaaaaaggtgcgtcgagaattccagttaaagaacctcaatgtaatgattccgtttgtccgcaccgttgccgaagctgataaagttacaaaattaatggcagctgccgggttacatcgtggtccagattttaaggtatacatgatggccgagatcccaagtaatatcatcttggcagatcagtttaataaatatgttgatggttattcgattgggtccaatgatttagcaatgcttattttaggttgtgatcggaataatgatacagtggcccacctctttgatgaacgtgatcttgcggtgaaacgtgcgattagccaccttattaaggctgctcaccaagataacaagacggtttcaatatgtgggcaagcaccatctgaatatcctgaattagcatctttcttaattcagcaagggattgattatatttcagttaatccagatatggttaaagaaaccaaacagaacgtggcaaggattgaacagcgcataatcctggataacgcgacgggtaagggacgacaagctgtggaaaattatgcatggtagaaaggattgaataaaatgcaaatttttgttgatattaatgcttctgaaaacggtaatggttcacaagagtttccgtttaagtacatccaacaagcggcagatatcgctcaaccgggggattatgttcaagtaatgccgggggaatatcatgaggaagtccatccacaatattccggcactagtgataagccgattatttatgtatctgctaagcaaaatcgggcaatcattacgggcgctgaccgtgttactggctggcaacatgttgctggtccggtatggcaattaaaactccctaatgccgaatttggtaactataatccatacaacgttttagttgatcaaacctttaatcatgccggtgaaatcttcctaaataataaagcaatgtatgaagttgatcagttagcaaaagttgaaacaccaagtgaaaacaaattttcccaagaccggaaatttacctgctatacctggtataccgaacagttgccagcagaagattcaaccgtaatctatgcaaactttcaagcgcaaaatcctaatgatgaatatgttgaactgactttccgtgagacgtgtttctatccagaaaaagcaggactcaatcaccttattctatcgggctttacaatgacgaaggctgcttgtcgatgggcatcttcgcaatataataaggggattattggtactaatcgtggtcagggatggaagattgccaagtgtgatatttctcacgctaagtgttctgggatctcccttggtcgaaatattgttccaaccattgacgatgataaggtttatccacaccggattaagaacaatacgattcatgattgcgggcagactggaattatcggtgttgaaggcaacccatcgccgattattgaacacaatagtatttacaacattaacgtccgccaaaaccttgtcagtgatgatgtcagtgcgatcaacctttcgccagcgattggggctaagattttacgcaactgcattcatgattgcacgcgcggaatttggcttggtggcaaggttgaagatacccaaatttcacggaatgtgttctacaacaattcactgccagattcatttgaagtcacaaacgaaaatcgggaggacttagtagcggcccttggtgaagatattgaaattaaggattcgatgggtgtgaccttgattgataacaatttcctattatcggattatgcgcttaagctcgaatctaagggcgtccttctcgttcataacctaattaatggcagtgtggaatggttaagcaatacgaatgttgctgaaaatgatccttactaccaccgcctttatcaacaaaatgcgccagaaagtgctccttacgattcttcttgtttctataacaatgtctttatccggaagaacctccggagtgaaatggcaaaattaattgcatttgcccacaaacaggcaagtgaacaaccaatcgataatcatattagcgatgataatgctgcttatgttggcctagccagtggacaacgaagctatattccagctaataaagcaggaaatatctttatgaatgatgagcaagaagacgttaaggtcgccatcgattcaagtgaagatggggtatttcttaatagtaatatttgcgactacttgaatgaagatactagtcgggtgatcgcggttggtgttactcccgagactgcccgtgattttgatacagatttcttagggaaacatcgtgaaggaattagtgtaaccgctggaccttttgatacgaaagaagaatatagtcaacgcttatttagactactgttttaaggaggtaaaggaatgcgcaaaccgtttattattgcgaactggaaaatgaataaaaatgttcatgaatccgttgcgtttgttaaagcaattaaagaaaaactcccggcaaataaagaaattgggatcgcggcacaagcagtctcgctctataacatgaaaaaagtggcgggatcttccaacttacaaattattgctcaaaatgcatctgctgagttagagggaccgtatactggagaaattagcatgcgaagtttagcagatgcgggcgtaacatacgtgatgctagggcatttagagcgccggcgcctttttaacgagaataatgaatcaattaatcaaaaagttttagcagccctcaatgctggtattattccaatcatttgtacggatgaagagatggtccaaacagaagttaacggacaaattcattatgtatttcgccaactaaaaagcgtccttaaaggggtaccagctaataaactatcacagattgttatttcgtatgaaccaagttgggccgttgggagcacgcatcaagcaaatccagacattgcggaagagggatgtcaggcaattcgtcaaagtctagttgaaatgtatggtaatgagattggcgagcaagtccgaatactctatggtggcagtgttaatcccgagaatattggtcaaattatgagtaaaccaaatgttgatggggcgctaatcggtcgcgcaagtctcgagattgaaagcttcttacaaatgattaattatatcgaattagcgagcaagcagaagttacaggtaatttaggaggaagaatgatggcttactttgataacggaaacaaactttttgatgatgcacggaagaatcaatacgcaattggggcatataatattaataatcttgaatggacccgggcaattttgcgggcggcagcggagactaatactccagtgctgatccaagtttcaatgggagctgccaaatatatgggtggttataaatttgtcaaagatatggttgaagaccagatggatgcaatggaaattaaagttccagttatcctgaatcttgatcatggtgactatgatgcagcgattgaatgcattaacttagggtattcgtcagtcatgtttgatggccataagttgccgattgaagaaaattacgccaaaaccaaagagattgtccaattagcgcattcacgcggcattgcggttgaagccgaaatcggtaaagtgggagaaaatcaggataccagcagtggagaacttgctgatgttgaagatgcaatggcgtttgcagcaatgggggttgaccgtcttgcttgtgggattggtaacattcacggcatttaccctgctaactggccagggttagactttgaccgccttcaagaaattgcgaatgcgattgatattccgctagtgcttcacggtggttcaggaattcctagagaacaggttcaaaaagcaatttcaatggggattgcaaaggtgaatatcaatactgaattccagttagcgttccaagatgcaacccggaagtatattgaaaatgaattagacctcaataaagaacaaaaaggatatgatccgcggaaattattacttcccggaacagatgcaataactgctaaaatgaaagatatgattgaatggttaggcacgccagcagtcgcctaattataatggaggttatcgaatggcaatcacagtttactttgtccggcacggtgagacctacttcaaccggtttgctcgcctgcaaggatggtcagataccccgcttacagaaaaaggagagatggatgctaaaaagatcggccaagttttagcggacttaaggatcgattaccttttctccagtgatttaaaacgagcagttgatactgcacggcttttaattgcggatcacctaactgcgacggtgaaggaaccaatccaaaaaaagttcttccgcgaggtattttatgggtcttttgaaggtcatagtaatgaagaaggcgctatctgggcaagctatcttgaaggcaagcgatttaggcgtatcggtgaattagttgatgagtttggcgttgaaaaagcgcatgacttactgaaagccgccgatccggctcaccttgcagaagatagtaatgaattaaatgcccgtgtagagcaggcaattgcctttttgcaaagcttaccggatgagagtaatgtggttgtagtagcccatggatcgattatccaatatattgcggggatgtatgggaaacctggatacaagtatgaaaacttacataacggcgcgctgatgaaggttcagctaacagctagagacgttgaaattactggatacaatcaatttaaactataaaaagaggcaaggaattattttccaaacctcttttgttgttaggacaattctttagtaattttatccagccataatggcaatgtctcgtttaggctattgtaagtatcttcaaagcggtgagtataccaaggatcaggaatttcttgatcttctttgccaggaattacttcatatgctaagtggactttatcacgatcttgcgctggtgcaatgcgttgtaagttgtacttgttcatattatccatgcagatgatgtaatcagcccactcgaagtcttgtcgtgtaattggacgtgagattaagccatccgttgataacccgtgtgcgtgcattgtctttgcggcacctgggtggggaccatttccttcttcttcgttacttgttccagcagaatcaacattgattttgccatttaatcctgcgtcatcaaccatttgcttgaacattgcctcggccattggtgaccgacaaatgtttcctaagcagacaaataaaacgttcatgtaatcacctcgtttatacttctatcataccgaaaaagataatattttgctaaaatattcgggaatcctaacactatccttaagtttttggtaaaattaagaacaaatatttttagaggaggaacaaaaatgacccttattattgtaattgttgtcattgtcttgttgattgctatttatgcaggactttacaacagtttgattcaattgcggacacacgcacaagaatcctggagtcaaattgatgttcaattacaacgacgtaacgacttgatccctaacttaatttcaacagttaagggctatagcaagtatgaagcgggaaccttggaaaaggtgacaaagctgcggacggaattaaatagtattccagacagcgatcatgctaaaaaaatggaagtttccaatgaattaacgggaactttacggacattgtttgccgtcgctgaaaattatccagacttaaaagcaagtgctgaataccaaaaattaatggaagaattaaccaatactgaaaacaagattgcctactcacggcagctttacaacagtactgtggcggctttagatgctaagattcaatctttcccaagcaatattgtggctaaaattcatcacttccaacaaatggattacttacaagtgccagaagaagtcaaggctgtgccaaaagtttcatttgatgatttaggtgattaagcatgttatatcagcaaattgcccgtaataaacgaaaaacaattttggtgatgtttgggttctttgtattgcttgctttaattggggccgcgattggctatttatttgcgcggacagcgattggcggcatgatcattgcggcgattattgcggtgatctatatgtccgtgatcattggtcaatcgactgatgtagtgatgcggatgaataacgcgacggaggtacgatcagcgagtgatgcgccagaactttggcatattgttgaagatatggctttagttgcacgggtaccaatgccgaaagtctatatcatccatgacccaagtcccaatgcttttgcgactggtaatgatcctgagcatgctgctgtggccgctactactggtttgatggaaaaaatgaatcgtgaggaactagaaggggtaatggcccatgaaatgactcacgttcgtaactatgacatccgtctgcaaacaattgcgttagccttagcatccgcaatcgcaatgcttgttaattttgctggaaatttctggtggattggtggtcggagcagtagtgatgaccgggataatccatcaagtattttcgccatccttggttcgattcttttgattatcttagcgccattggcagcaaccattgcgcagatggctctttcacgtaatcgggaatacttagccgatgcaggtgctgtggaattaacccgtaatccgcaagggatgattagtgcattggaaaagctaaaaactgctgttccaatgaaacatgtggacccaagcagttcggcattatatattagcgatccagaaaagaacgctaagcaccatcctttttcaaatctatttgacactcaccccccgctagataagcgaattgaacggttgcgtcaaatgtaataagtttatagcaaagactgagaaaaaacttttgctttttctcagtctttgctatttttactcacgacttattgtttttaatcgccttatactagtgagggtgatataattaaaaagctagaccaaagtatcaaaagaagaggtatctttttcatgaaaatgaaattagcggaaattgccaaggcgatcaacgcacaaaatgacattgaacaatggaaagacgtagaagtgactagtgtgtcatttgacagtcgacacttagatcaagggagcttatttgttccattgcaaggtgcccaagacggccaccaatacgtaccgagtgcttttaccaatggtgcagtagctagtttatgggctagtgaccatgagataacggatcagacgcacccgctattagtcgttagtgatccactagcggcccttcaacaactagggaagtactacttgcataagatcaatccgattgttgttgcagttacaggcagtaatgggaagacgacgactaaagatatgattgcgtcaatcttaagtacgcagtttaatgtcgcgaagacatatgctaattttaataatgagattggggttccagtaacgcttcttaacatggagtctaataccgaagcagtggtagttgagatgggcatggaccgttttggtcagcttgacttcttaagtaagcttgtaaatcctgacattgccgttattacaatgattggggaagcacatatcgaattcttcgggactcgtgataagattgctgatgcaaagatggaaattacccatggcctaaaggaagatggaacactagtatttaatggggatgaaccattattagaggaacgggtaaaagatcttgcccaacgacagatgcgctttggtcggcaactaagcaataatttgtatgcaacaagtgtccacgatgaaccacggcagttatcatttaccgtcaacgaatggccagatgaagaattcactatcccaatggttggtgaatacaatattaataatgcgttagcggctatggaagtgggtaagattctgcatattactcccgcccacatgaagcaagcgttggcaaacgttgaattaacggaaaatcgtgctgaatgggttaaaggaaagaatggtgaacagatcttaagtgatgtttacaattcaaacccgaccgctgccaaggaagtccttaagacgattgcagaaacaccagtagctggtcgccggatcgccgtattaggggacatgctggaattaggggatgctgcggcaaagttgcatgctagcttagcagaagagattgaccaccaaaagattgctagtgtttaccttgtaggcgaacaaatgaaaaatcttaaagacaagttgatccaagaaggatacccagctgaagatatctatcattatgctgctagtgaccttcaacaattaattgccgatcttacgactactttgacaggtgatgatattgtcctattgaaggcaagccatggcattcacctagaagaagtcttgacggcattaaaagcagaatagttaatatatttgccagtcgattactgatgcttatatcataaatcgactggtcatttttaggaggaaaatttttgaagtttagtgaattaggcttatccgatagcctattaaaagcaatcaaacggagcggatacgaagaagcaacaccaatccaagaacaaacgattccaatggttcttgaaggtaaggatgttattgggcaagcacaaacagggactggtaagacggctgcttttggattgccaattattgaaaacgttgatactgaaaatctcaatattcaagcaattatcatttcaccaacacgtgaattagcaatccagactcaagaagaactttatcgtcttggtaaagataaacatgttcgcgtgcaagtagtatatggtggggcagatattcggcgccaaattaagagcttgaaacaacacccacaaattctcgtggggacccctggacggttacgtgaccatattaaccgtcatacagttaaacttgaccacattaagacccttgtcctcgatgaagcagatgaaatgctaaacatgggattcttagaggatattgaatcaatcatcaaggaaacaccagatgatcggcaaacattgctcttctcagcaaccatgccaccagaaatcaagcggattggagttcaatttatgtctgatccggaaactgtgcggatcaaggccaaagaattgactactgacttagttgatcagtactatattcgcgcgcgtgactatgaaaagtttgacatcatgacccgtttaattgacgttcaagatcctgacttaacaattgtctttggtcggacaaagcggcgggtagatgaattgtcgaagggcttgattgcgcgtggctacaatgcagctggtattcatggtgaccttactcaagataagcgttctaagatcatgtggaagtttaagaacaatgaacttgatatcttagttgcaacagatgtggctgctcggggcttagacatttccggggttacgcatgtttataattatgatattccatctgacccagacagctatgttcaccggattggccgaacaggacgggccggacatcacggggtatccttaacctttgttaccccaaatgagatggattaccttcatgagattgaaaaattaacccgggtacggatgctgccacttaagccaccaacagctgaagaagcatttaagggtcaagttgcctcagcctttaatgatatcgatgaattaatcgcgcaggattcaactgatcgttatgaagaagccgctgaaaagctactagaaactcataatgcaactgatctggtagcagcattgttaaataacatgacgaaggaagcggccagtgaagttccagttaagattactcctgaacgtcctctcccacggcgtaacaagcggaataaccgtaatggcaaccgaaataattcgcatggtggcaaccactaccggcgtaagaatttccgccgtcaccaacatggtggtggtcaccgaaatgataaccatggaaagagccattccagtcgccatgcatttaatatccgtcatcgaaaagaagattaattagctaagaagtctttggttgagatttgaccaaggactttttttaatttggcagattgcaagaaataatttgaacaaagttagtgacgcagattacgcaaaaagatctcaatcggttgacctttggggataaagcgtcgtagtactcggttgcgattctcattactgccccgttcatgtggagaataagcatgcgcaaagtagaggggaatcctggcctgctcttcaattagcttgtagttagcgaattctttcccatggtcaacagtaagggtcttgagattatcttctaactggttagctaattctaaaatggccttggtcattgaggtactatctcgtccctgaagccgtttaacgatgataagacgactcttacgctcgacaaacgtagctattgcttgacctttacgctttccagataaaactgtatccgcttcaaagcgacctgaggtatgacggtcaataacttcagcaggacgatcttcaatggaacgtccatggctaaaagtcccacggggttctttggctcgtcggcggcgaattccatggtcaggtaaatcagccacgtcaatatccaatactccttgatcaatccagttgtagatggtcttgtaggcgattctaactacatgagccacttgttcaatcgaccatttttggatcttaatcttttcttcaattaatcgcttgaggttagtcgttaagatggttttacgcccacgatgactaagtttagcttcatgatcagcttgagctttaactgcgtgatattcaccagtcaaacgatgaacctcattaaagatcgtggttttaccgaagccaaggtaatcagcgatgtatttaagggagcggttttcataacgaagagtttcgatgacaacacggtcttcaaatgataaaatagtggtgcccataaaggtccttctttctaatggaatgttgtggtaacaccattaaagacctttatgggtttttatgtccactaatatgttcaacttaaattttgcaatctaccataaattaaatatgggtttgtgacttaagttaagttacttccataaaagacaaatggcgcagtacaacaatggcctccaacgcccggtaaaaccgaacgttggaggcctactgttgcttgcgggggctcgaaaacgaagtcacgagtgacttctgtctcgctcccatttcgttatcttttttataaaaatatttattctaattatttgatttatttataatatatttgttgcgactattacgatgattagtatctgagaagatgagctcatgtagatattaggctattatttcatcatgcaaattaagtgtaaaggggggctaatttttcttgtttggtacttgaggagctgcagagttatttatgccttgtgtgagagaggttttgacgatgcaaaaattagagcaattgattgataaaaactttgctgaaacagctcatggtaaggttgcaaactatattccgatattaggaattgttgatccgcaacaactgggcattgccatttatgacgttgacgaggacgaaattgggaccgctggaatggcaggaacgagatttgcgatcgagagtattgcgaaggtcataactttaatattaacgatcaagagattaggacataagcgcgtcttagcagaactagaaaatggttcggcagattatagcctaagttcggtactattggatgacgagttaaccgagcaggtccatcggataaattaccttaataattcctccgccttgttaacgacagccttaattgaccagttgatggggcagaatagttttaatgcccttctcgggttctgccgtgagatctgcaatgacccatgcattagcttgaatgagcgtttatttcggtcagtaattatgaatgataaagatattcatgcactggcttactatatgaaagataaggatattttagagactgttgatcaaacattgataacttattttatgcaaagctcaatgatggtgacatcacagagtcttgctaacttaggagcagtcttggcaaatgatggaattaaaccttgggataatgagcgtcttattagccatgaagataacgagttggtaaagaaattgctaacaacagttagctcgtttgaagaatcaaaagaatacacaattaaaattgaactccctattaaaagtggtactggcggcggcttattggcttgtgccccgcaaaaatgtggtattggtatttttttagtccagctcttgatcaacatggcaatagtttggcaggaatgagtttattacaagatgttgttgagcaattagtagtttaataaaagcgaggcccgaagaaaattcttcaagtctcgctttttgttaatgtaatttttcttggaatttctgtaaattaccaggagttggggttaagttagtccattctggtgaaaggaacttactattgatttggtaatgtggttgcggttgcttattagaaataaaactattagtagctttatcaacttttacccaaccagcccaaccgatatggatagtgtcttccataaatccaggcttatcaccatcatgagaaagatcaaaaatatgattgaacccttgttggcgaagctggaatttaatttttttaacagattggtaatacatattcatgtccatccccgtgtacttttcccactttgaattaaccggtgggatgataaagaggacatttgaattggtattcttaaactgattcaaaactacttccaaatcgccatattctggtgacttagtataattgaaatttcgttgtgatccctttgttttcgctaagtttttctttacacgctgggtatagaagctgtttttgataccgaaacggttgttatcagtatcacgtgcggcttcattcattgcatcatcataaagttcattataattgtaatgctgaggaagcttcttaacatttgggaggatatgcttgccatagttattatttaattgaaaacctgagaagatggcatcttcatgaacaagcatgttaagtcggaagcggataactcccatgtcgaaactgctcagggattttccttcagcgatttttttagcatacgaagaaacagtcccatctttgccaagcattgcaattaatcgcgttgcaatgtaacgatcatatggtgatttaggattagcgtgttgaagccagttaaggttagcgagttcaccattatagtacttgaaagctggtggttgaacaccctgcttggtaaaccattgtggtgaaatgatatagactgccttattatttctcatctgcgtttccattgaattaatgttaaagaattgcggaagagattgggtaccccgtgaaccaaagaggaaaggagtatagttatgataacgagcagccattacagaaggatggaagcgatccattcgccgtaattcactagaaccaaagaatggaacatagtgagtgtgcttatcactgagcgcttgttgcttaattgattggttcttaaaaacaacggggcttagtgatactgcagctttatgttcaatcgccgctgagtgctttttactaatcggcagtgaaaacaaaagaactactaatagacaagcgacaatcagcgggccaaagattgaccacagctttttgccattatgcattttggagctcctttacccgttcttcaatcttttcaatagtgtcccattggctacggtcaaattctgaaactggtacttgaacgccaaaagcatcttgtaaaccgagaagaagactaacagttgccattgagtctaaaagaccactttcaaaaaggttttgacttgcatcactaaagtctgcagtatcccgaccagttgcatcagctaaaatattaataatttgttcttgcataattaaaatcctcctaaaattatttgaatagataagtatctaagaacccactgaagatcaagaaagtaaacattacaaagttaaatgtgacaaaaatagcaactccagtagtgaacttattatgtggtagctgttttaagtttttgcgcttgaaacgcagccaccagtcattaactactaggcctagaccttggagaaaaccatagagaatatagtaccaggtaattccatgccaaaagcccattagtaacatattaagcatatatgcggttgatgacaaggcatttcgattcttaaaccatcgttttttggtagcaagaaagacgaaccgcataaaaatataatcacggaaccagaaagaaaggctaatgtgccaacgattccagaactctttaaggtttttcgatttgaaaggctgcttaaagttcatcggggtacgcacacccataaagtaactaatagcaactgcaaataatgaataaccggcaaagtcaaagaataagtaaagtccgtaagtgtacatgacaccgactaagttccaagaagggaatgatggatcagccaaggccgctttttcaaagaaggggtaaaaacgctgaccaaagaaataaccgatgacaaacttgtacaagaacccaaggaataagtagaaaattcccgtattaacaagattcaaatattcctcgcgggtcggaacctttttataatctttttcaaaacgtcggtaacgatcaattggtccagaagtaatggttggcatgaacagaatgaaacgaatgaacttccatggggaaatctctttgatcattccatcacgcgtttcaattactgttccgactgcccggaaagttaaataactaattcctaagaaaccaaggagggagttatgaccaaccattgccggtgagagcttaacaattacaatcggcaaaattgataaggcggcagtgaagtaaaaaacaccactcgaattattattttgccggtagcgatgataagccatcacaataattgtctggtaaataacataagtaattaatgaaattccttgttgccagcttgaaccatcgaacattaagaagataaaaatgaaactaattaatgcttcataccagttaaacctcttcccaaagtaaaggccgattcccaacggcaaaatagcaagaagtaagtagaagaagtataccggggttccataagcactgaaattaggaaggtttgaaatccaatcaatcattacttgttagcctcagcaatcatttgtttaactgcaatcttgccatttgcagacattgggaatgattcacggtaaacgaattgggtaggcatcatgtatggcatgattaagccgtccaagctttcacgaatttgttttgttaatccagccgtatcttcagtagattcgtttggaataacataagcgatcaggtgcgtaactttgccgtctttattatattttggaaccgcaactgcttgtttgattagaggactcttttcaagactggcacgaacttcatcaagttcaatccggtaaccatgtaatttaatttggaaatccatgcggcctttgtgatgaagtaagccatcgctgtcaagggtacccgcatccccagttcggtaagcaggcacaccatcaatcttaaagaatgacttggctgttttttctggattattcatatagccacgtgccacactattaccactgattacaatctcaccttgttcaccgggagtagtgatttcttgatcgccattccaaatggataatttaactccaggctttgcatagccaactggtaagcggtcattattttcaatgatttcaggagtaatctcgattcctgatacggcaaccgttgtttcagtcggaccataagtgttgaagattttagcatctgggaatcgttggtgtaatcctttggcagtctttactgttaattcttcgccacagaagagaaaggtctttaagcttggcattttttgttggttaaatgctgggctaagcattaacatatcagcaaacgatggtgtccctacaaatacctcaagatcaaggtttggtagagcagtgaacatctgaccaaaattttcaacaacttcgtgaggaagcgccttgattgtcccaccattaagtagtgctggtaaccagtacatgtttgaaagatcaaatgaatatggtggctgccctaagaaattagcatgttctttgattttaaattcatcacttagcatccagtcaacaaaggtcataaagttatcatgactaacttcaaccccttttggtgaaccggtagttccagacgtaaagaggacataagctagttcgtcaccattaatcattgctgaagtatcaaaagtttgcggtgttgccaaaattttttcaagctgttgatgatcgacaatcggggcatcaaactggagatcattgcttggaaaatcattaacagcaataatcatcgccggtttagcagtatccagaattgattgcatccgtggaattgctgaatcgttggacactggaatataagtatgtccagcttttagagccgctaaaaagctaataatcatttcaacttgatgatcaccatatacgagaatcggactacgatcaggcaaagattgagtactaagccatgccgctaaagtatcaactgctgagcttaagtccgcataagtggtcgttttgcccatttcatcatatgcgatccgcgttgagttgtccttggcaatttgctcaaagacggtaataatattcttactcatatattatctatttcctccgcattagaattcgttgtagataaatggctcttggcctgctccataataaccataaaggtagattaataaaagaagcactacaaagtaaaataatgtttttaagatgaattgtaatgcaggatggcgttgaataatctgagccatagttctccttctctcatctttataaatttgtaattgacattcatatcaagaataccattaattatgtatctcggctaatagggtgagttactttcaccttactgtaaagtctttaagaaaaaattaatgaaatgttcagaaataagaatgcttattgccttaaaattataactttttctgagctaattgtaactagaaaaatataaactttatttataattttatatgacatgacaatgatggactaatgtaacaataattgcaagaagtgcttattttcgataagattaagcggtagataatagtgataattaaggagacgaacgctcgatgattaaggggattggaatcgatataaccgagattgaacgagttaagaaagctgcgacagcgcattctcaattcatccagcatgtattgacaccgactgaactagaacaatatagtcaatttagcggtcaacgatcagtagaatatcttgctggtcggtggtcactaaaagaatcttttgctaaagcatatggaacgggaattggtgctaaactaggctttcatgatattgaaatcattgataaccaatatggtgcgccaattgtgattaaatcgccgtataatggtaatgctcatgcttcagtgagtcatactgccgcgttagtaatgacagaagtaattttagaaagtgagaataaataaatggttaatggtcgtttgcgagatacatcattaatagtggacttagatgcattacgtcataatattcaagaacagaaaaaagttttgcccaaaaatagtagaatccttgctgttgtaaaagcaaatgcttatggcaatggattgattccagttgcccaaacagcaatgaccagtggtgcaagtggtttatgcgtagcaattttagacgaagcattggaattgcgggataacggtattgaagccatgacacttgtccttggaattacgccagttgaagatgcgttgattgctgctcaagccggagtttctttaacagtcggctccttagattggcttgaacaatatcatcaactagcacaagttgccaagcctaagaaaccattaaaagttcatctgggaattgattcaggaatgggccggattggttttacagaggtcgctacatttaagcaagctgttaagttgcttgatagtcctgaatttgaatttgaagggatgttcacgcattttgcaactgctgatagtcctgatgaaaattactttaatcaacaggttcaacggtggcatcaatttgttgccagtcttgacgaactgccaccatatgttcatatggcaaattcagcgactggtttatggcatcgggaaaaaatcacggctaatacagttagaatggggatttcaatgtacggacaaaacccatctggacgtgacttgaaattaacgcttgatttacagcccgttagttcattagtttcatcaatttcttttgttaagcagttaaaggcaggaagatctgtcagctatggtgctacttatacagcggagcaagatgaatggctagccactttgccgattggttatgctgacggttatccccggtgtatgactggttataaggtattagttgacggtcaattttgtgatattgccggacgagtatgtatggatcaaatgatgattcggcttcctaagtattacccagtcggcactccagtagtattgatgggcaaatccggtgaccaagaaattacagcaactgatttagctgagcaggccggaactattaactatgaaatcctaactaatattagtaatcgggttcatcgcatttatcaccaaagtaaataattaagggaagcgaaggtaatgacaaaacgaaaagtaaaacggggtgacatctattacgctgacttatccccggtaattggatcggaacaggggggcgttcgtccagtcctgatccttcaaaatgacgtgggaaatcattatagtccaacagtgatcattgctgcgattactgcccaaatgcaaaaaaagaagatgcctactcatgtccaactaaaaggtaagtcgttaccgttaactcatgattcggtcattttattggagcaattacgaacgattgataaacaacgattaaaagaccgaattgctcatttgtcgccagagacaatggcaaaagtggataaagcattaacgattagtgtgggattaagtgctgcctatgatgaaaataaatgagtttgacaatttgcgtcagaactcgtatactcactattgaattaatcacggttcttttaatgtagcccagagagactacaaaagacaaaataatataagcatagtgggcacaaaactatgcttcctcttttgtaaagctctaggaccattaaagggactagagctttttaggtctaaggaggatatcttgtgaaagagcaaaaggggacaacaatttttagtattccaatgaagaacagaaagactaatacttgggatatgtttgccacgtgggtcggtgcaaatgccaataatggaacctggtttgttggcggagtgctcgccgcttgtggattttcggttgccatgaaggtcttagtattgtcatctgccttatcatatgtatttttaagtttggtaggttacattggttataagactggggtatcgacgatgactttaagtcgtgcctcctttggtgaacggggcagttatctcccatcattagttaatattactcaatttattggttggacagcagttaatacttttattgcggcccagtcggtaagcattcttttccatgacttattaggatggcctgtgtggggacaacatggcggctatttagggctagtagtcgggattattatcatgagcattctccatattattagtgtttctagcggatcacgttcagtccaaatgattgagcggttagggataatccttgttcttgtattcgtcatttgggagtcagtagctgtttttcgaaccgtttccttcagtcaaattgtaaattggcatgttcctgcgcaatcaaaaatggcagtcggtgcggcggtcgattatgtagcagcttttaatttagcctgggtaactgccggtgctgatttcacccgctttactgctaaagaaaagaatgcgactttgacgccgttccttggtgctttactaggggttgtatggtttgctttcatcggtctgatttcaacaattagtattgcaatttcaagtggggtatataacgcaaataactctgatccctcaacgattgctagtaagttaggactgggggtagttgcccttcttgttattattttgacctcaatgacggcaaatgctgttaatttattagcggccggatcagctctttcaaatatctttacaaagctcaaattaaagtattcattatggatcgtcgtattgcttgcgacagttgtgacctttattccgatgtttgtcggtagtttcttgagtgcttttgaatcattccttgactatgtggggatggtgttaggacctacgatcgccattatttgtactgatttttatttccgtgctcaccggcaatatgatgttgatgaattaggtaaaattggtggaaaatattggtatcgtggaggcgtcaactgggtagcgattattgtttttgctatcggggttgccttcttcttaggtgttcatcagttaccaatcttcgtaaatacgattggggccacatttattgatatgtgtttgagtggtatcctatattatggaattatgttgctggttgaccgaaaggaagatgaattatgctattaaaaaatgtacatgttgataatcatgaagaagtagtcgatgttcgaattctcaatggaaaatttagtgagattaaggctaacttaacgccccatgacggtgaagaagttattgacggtaaagaaaatttacttttgccaccatttgttgattctcatgttcacttagatgctacgcttactgctggtcagccagaatggaatgaaaccgggactttatttgatggtatccggatttggagtgaacggaaacaagatttaacgaaggaagatgttaaatcgcgcgcgaaaaagacattactgaatatggttggtcatggaattcaacacgtacggagccatgttgatgtaactgatcctcatttaattgccgcccgtgctcttcttgaattgcgtgaagaattaaaagaccagatcgacttgcagttggttgcttttccgcaagaaggtattcttagctatcctcatggacgtgaattaatggagcaggcggttaaagaaggattagatgtcgttggtggtattccccattttgaatttacaactgaatatggttggcaatccgtccatttcttaatggccctcgcagataagtacgatcgtttagttgacgttcactgtgatgaaatcgatgacccagcttcgcgtaaccttgaagttttagcgaccgaagcctatgaacgagggatgaaagaccgggtcactgctagtcatacgacagcgatgggctcatataatgatgcttatacttataagttattccgactattaaagatgagtgatattaactttgtatctaatccattagttaatgttcaccttggcggccgtttcgatacttatccaaagcgtcgtggcgttacccggattaaggaattaacagcagcggggattaatgtttcctttggtgaggatgatatccaagacccgtggaatcctctcggcgatggtaacatgttagatgcagttacgatgggtgtttatattgctcacttgatggggtatcaccaactgcaagatgcctttaattatgtaacttataacggtgctaagacattgcatattagtgataattatggaattgaagtaggaaaaccggcaaactgtatcttattgaatgctcacgacttttataatgcccttaataagcatgttgaagttctttataatattcgtcatgggaaagtccttgctgagacgaaaccagctgaaaccaaagttaatataaaataaaattaaagaaatctcataatagttattgacaagttagggaatggccggtatattatatccagcaattaaatttagattagaaaagcgttgaaggaaataatgatttgaaattggtaacagagaattagcgggtggtgtgagctgatcgagatttctaattgttaatcgttcctgagttaccggctgaaaccaagtaagctgaggttggctgccatccattattttggccacaaatgattgtttgtgaatgagaggatcgactacgagttgatcaaagtaggatggtaccgcgcagaagcgttcttacaattgcgataaagcaatgtaaggacgcttttttctttctaaattttaagaaaatattttgtcttggaggtaattattatgactgaattaaacgcacgacaggaagaatttgctaaggctctttttgaagcttatgacactaatacgccgttaaaagaggaagaatggaaagacgttgtgactgatgatgaaacagcatatgcagttcaagatgcggtagtaaagttaaaagggaagccaactgctggctataaagtttcgttaactagtaaagaaactcaagacatgtttgatgctgattcaccattgtatggacaacaagttgctgaacgattcctccagtcaccggcggatgttgacttgcagatgttaaatgaaccgttattagaggttgaattaaccttccgcgcaaaagaagacttacaacctagtgatacattagaagatttatttcagaaagtaactgttgcgggagccttagaattgcctgatgcccgtttcgtcgattggtttccagatttaggaaaatataatgtaatggctgattgtgctgttggtggtcttgttgtatatggtgaagaacatgatgcagatagcgtatttgaaaatgttgacgatgctgctaatgttcatgccgttttattcaaagatggtaagaaattaaaagaaggggtatcatcagaagttttaggcaatccctttaagtccctccaatggttagtacaaaaattagctgaacaaggaaaagcatttaccaagggtcaaatggtatcatccggaacatttgtcttaccacctaagctcactgctggtaagtgggaagttgagttcgatagcggtttaggaaacgttgtagttaatgcgaaataagcgttgaaagcaggtgggaaaattgggtgagaaatcgccagcagaaattaatattctaaaaattaaaaggggctgggagaaaacttttgttttctctcagcctcaaccgcttttataaacaatagtaagataacgtggaaaataaccacaaggctcgaggctaagtacgaacgataatcagcccgtgccgtgctaatcatcgttctagcttagccaaccgccttgtcgagagggttatttcccactctccttaatatttaatagctttggtgcaagtcttcaatttctgaaacttctaacccttttttctcgagtcgtttaacaatccgttccatcttttctttagtaacatcagcaggcaaggtgtataagacccgtttcattgtttcgtcttctggatcgagtgaaatgacatttacgatctgacaaaaacgagtgatttctttagcagccgttactagcgctccccgttcatcaggagtaataacagttaaaacataactcccattattcacgttccagccagcagctaacatccgtaaaagactattatgggttaaaatcccataaaactgattattgttatccaataccgcaatatatggaaggtctcgaatagcaaagaagatagagaagaaagccgcgttaattgagataaatttagtagcattctttaataatgcagttaccggtaaatgcatatccccctgtcgtgctttatgccggtaaagatgcatcttataaatatttccccgaaagatctttcctgacttatcaagaactgggacacaccgatagccggtatcctccaagacagtcagagcctcatccaatgtcgctgtttctggaagagttgttaaggttgctttgggtttgattaatgaattgaaaatcataattaacatcctttttatcgattaaatgcactcactataataacacatttctatcaaaaggattagaaaaagattagaagatttatgctgttaattcaaattagtatgctgaaaaaagtaacatagggtataatactagttaaaatttatgctggacgggaaaagtgaccgtgcggcttttttgcgtgaaaggaatgaaagaacaatgaaaatgattgttggcttaggaaatattgggacgcggtatgatgaaacccgtcataatactggctttatggtggttgatcaactagcacgagattatcacctgggagcattcacccacctaaaacaagaagcagtcgcagttagtgggataattaatggtgaaaaagtaatgttggtaaagccgacgacgttcatgaatgattcaggacgagcagtcggaccactagtagactattatgatattgacttggataatctcgtaattgttaatgacgacttggatatgccagttggcaaagtacgtttaaaaacacatggggcttcaggcggtcataatggacttaaaagcattatcagcgcgttaggaaccaagaactttaaccgggtaaaagtagggattgaccatccccaacatggaacggtggttagtcatgtcttaggtaaattttctaaagaagaacgtcctaaatttgaccaagcagttgaacaagctgagcatgcattagaagactggattaatggagaagactttgccaaattaatgaatgcttataattaaaatagaaaggtggcgttgatggtgcaaatagaaaatttaatcgagaagacgccatcatttaaacaaattacggctgacctccaacccaagaaccatcaattaataacggggatttctggatcagcgcgaaccgaattactaagtgctctttctaaagaagggcagcgaccaattctagtagtgaccgacacgatttcccatatgcaggaattggctagtgacttggagaaccttcttcctgctaatcgtgtttaccagtttccggttgaagaggttttagcagcggaagtagcaactagttctcctaactatcgtcttcagcgggtactggccttaaatgcgttgattaataaagaaccggcagttgtagttgcatctgctgcggggttacgacgcaatattatttcaccagaatactttgcccagtcctcgttaaagattaagactggcggggaagtggatccagcaaaaattcggcaacaattaagcgcaatggggtatcaatatcaaaaaatggttttgcgtcctggtgattttgcaattcgtgggtcgattattgatatctacgccttaaacactgataatccgattagaattgatctttttgatacagaagttgattcacttcggtattttgatgctagtactcagcggagtattgataatgttgaagaagttcagatactgccagcgacagattttattatcccatcgactgaattttcgcgggtgtatgaagcgctagatactgaatataaaaaggtggggaaggagttaagtgctgacgatgcggatattaaacagcaggtggctaaccgctttgaaccattattgaacgcacttaagaaccagcacttgcctaatgaacttttagaatttagcaacctggtttatccggctaagcattccttatttgattatcttcctgatgatgggacaatttactttgatgacttgacgcggataaagcaatttgccaagcagatgacccaggaagatgcaggctggtttaaagataaggttgctcaccatcaattaacggatgttccagatcttagcaatgacgtatcggccataataaaaaaagacccgcatccgcaaatttatggcgccttatttaaaaaaggtctcggtaatattaaacttagccaaattaccgacctaaaaagcagaaccatgcaacgtttctttggtcaaatgccactgctgaaagccgaacttcagcggtggattgatcaagggcaaacggtagtactgatggctaatagtccagaacggcgaaagcaaattgcccaaacgcttgctgactttgatatcaccgcaacagaaactgaattaacaaatatcaagccgaatgttgttcaaattgttgctgctaacttaaacaatggatttgaaatgccacttgctgggctggttgttattacagaaagcgagatgtttaagcaggtaaaaaaggttcatcatcgtccacaaaaacttgccaacgccgaacgattaaaaaattatactgaccttaaaccaggtgactatgtagttcatgtcaatcatggaattgggatttttagtggaattaagacgatggaagttgaccatgttcaccaagactacatgatcatcaattaccgagataacgctcagatatatgtgccagtaacccaactaaatcttgtccaaaagtatgtatcatcagaatctaagaccccgcatatcaacaagcttggcggtaacgaatgggcaaagactaagcggcgcgtttcttcaaaaattgaagatatcgctgatgaattagttgacttatatgctaagcgagaagcggagaagggatatgcttttccgaaagacgattatctccaaaaacaatttgatgctaattttccatataatgagactcgtgatcagttgcggagtattgatgaaattaaagaggatatggaaaaaccaaagccgatggatcgactgttggtaggggatgtcggctatggtaaaactgaagttgcaatgcgggcaatttttaaagcagtcactggaggaaagcaggtggccttccttgtgccaacaactgttcttgcccagcaacactacaacaccctgatgcgccggtttgagggcttcccaatcaacattgccttgatgtcacgtttcaagacgccaaaagagctaaaagagacagaagcagggctaaaggatggaagcgtcgatgttgttgttggaacccaccgaatcctatcaaaggatgttgaatttaaggaccttgggctgttaattgttgatgaggaacagcgctttggggtaaaacataaagaaaaactaaaacaattaaaaaataatgttgatgttttaaccttgacagcaaccccgatcccccggacattacacatgtcaatgctgggcgtacgagatttatcagtccttgaaacaccgccagctggtcgttacccaatccaaacctatgtaatggagcaaaatagtagtgcgattcgcgatgggatcattcgtgaaatgcaacgcggcggacaggtttattaccttcacaatcgcgttcatgacattgaagagacagtggcgtggttacaagaccttgttcctgaagcccggattggctatattaatggtcagatgagtgaaaatgaactggagacagtcctctatgagtttattcaaggaaattatgatgtattagtgactacctctattatcgaaacgggggttgatatcccaaatgctaatacgctctttgttgaaaatgctgatcggatggggttagctcagctatatcagattcgcggacgaattggtcgtagtaatcgggtggcttatgcttactttatgtatcagcctaataaggtcctaacagaattaggagaaaagcggctagctgcaattcgtgattttaccgagttgggatctggatttaagattgcaatgcgagaccttgctattcggggagctggtaacctcttggggaaacaacaacatggatttatcgattctgttggttatgacctatattcagcgatgcttagtgatgcggtagctaaaaagcagggtaagaagcaaactattcactccgatgcagaagttgagttaggggttgaagcttacctaccaacggattatattgcagaccaacggcaaaagatcgaattatataagacaattcgccaagctaagacagatgaagaagttattgatattcaaggtgacttgattgatcggtttggcgattacccggcaccggttgggacgctgttgcttgtcagtcaattgaagaatcatgctgacctggcaatgattgctgagattaagcggcaacgtgataatattaatatcaagtttactgaacgtgctagccgcttgattaaagcccctgcaataattaaggagctagctaatacgcgatttaaagcaacaatcggtgaagacaatcagcaactaacgattcggctggttattcaacctaaaatgactactgatgattggcttcaccagctactacaatttgtaacgactttaggaaacgttattcaagccgatgaaaaaggagcggaaaaatgagattagataaatttttaaaagtatcacggattattaaacgtcgatcaattgctaaggaaatcgcggatcaaggacggatcttaattaatggtcaaccagcaaaatcatccagtcgggtagcggttggtgatactttaacaattaagtttggtaataagacagaaacagttaagattaatcggattgttgaaacgacgaaaaagagtgaagcggaagatatgtatgaaattgttgatgaaacttacgcggaatcctttgaccaactataatatcttctgagatataaaaaagttgataatcatatggacattctccgcggtatcttgctatacttaaagcgtgataagttaaaatggaggggaatgtcagatgaaaggacaatctgatagcaaagtttcacaattaaataccccatatgcccgccaggtttcgaatcaaaaaacatataatcggcatgtgcataagcgccgttgtcagcggattattgccgtttttttggttatattcttaatctttggaattcagatatttcaaagcaaacggacattagcagatattaatggcaatattcgacaagcacaatcacaattaacaaaacaaaaacaaaagaatcaacaactacaacgtcagattaaaatgttgcataatcccgaatatattcagcaggttatccgtgctaagtataattactctaagaagggcgagataatctataatttgaactaatgatcacaaaataggatgtttttagtagggttagaatattttaaatgttaaaattgagaatgtaattgggtgatttttcagcttagttttttatgagaagtttagttattttcatacgttttcaagatgaagttatgatatactcaaatacaaaaatatgagatggttcaggaggatctataggtttcatggcaattgaagttggagcaaaggtttcaggtaaagtttcaggaatcactaattttggtgcattcgttgatttagatgataatcagacagggctagtacacatcagtcaaatctctgataaatatatcaaggatgttcatgatgtattggctgtcggggatgaagttacagcaaaagtaacacggattggtgatgacggtaagattgctctttcaatcaaggctgcagctcctcgtgaacatcaagatcatcatgaaaataaccatcatcgtgaaaataatcaccgtgattttcaccacgaacggaataataatttccgtggtcacaatgataacttccgtggtggttttagtggtcgtcaccacaacagtcaccaacacgaagactttaatgacatgttagctggctatttaaaagaaagcgaatcacgtttatctactttgaaacgtcaaactgatggtaagcgtggcggccgtggtggtcggcggagctaatatggcggatttacaacaagcatttgagcgacacctagtaaggagtcgcttttttgctacccaagataaggtggtagtggctgtctcaaccggagtcgattcgatggttctgttagatctcttgcaacatttgccgttaaaatatcgtccccagattatcgttgcccatatgaaccatgagttacgaaaacaaagccagcttgaagaacggttcattcggcagtattgtaaacaaaatgatttaaaactagcagttgcacactggccacaagatcttcatccacagaccggggtcgaaaacgctgcccgtcaagcacgctaccaatttttccgggaagtgatgaaagataatcaggcaagcattctgctaactgcacaccaccaaaatgatctagcagaaacaatgctgatgaagatggctcgtggtggtcagttgagtcaattagtgggaatacgagatcggcgaccatttgcttctggaaccttaattcggccgcttttaccctttagtaaacagcagttaaagaaatatgctttgcagcatcatcttaagtggtatgaggataagacaaataaggacttgaacattcaacggaatcgatttcggcatgcgataattccaatgcttgaagaagagaatcctcagttgctttctcacctcgaaagctatcatcaacagttaacggatctccttgcctggcgtgatcaagaagtggcagatcaattagcagcatgtgttgatcaacaaggaaggatgatcctggcaagattattgcaaaataaggaaatcattcgaaaagaaattttacgacaatggtttaatcaacaaggaatatatgatattaaggaccagcaacttgatgaactgctgcagatcctagaaaacgagcaaaagccacagcaaatcattgagttgccgcatcgatatattcttgagaaagcctacgctacttgtgtgttaaaaaaattggataatccgcttgagaacctacaaaagccccaagatcatgtgataaaattggaacaatggtatcaagtagatccaataaacttaatggcagtgtcagctgaaaagtcgtttttcaatgatgaagagcaggtagttttgcaatggcttgctccagatcaatttccgctgcgtctacgacaatggcgacaaaaagatcgtattcgcttaaaaaatggtcatcaccagttagtcaagcgggtcctaattgaccaaaaagtttcccgaaaacagcgtgaccagcaaatggtcctagttgatgcgcatgacgaggtcgtctggatagttaaccgaaagtggagttggtttgaacggccaaccggctatcagcagacatgtcggtcatgttttattggaataaaaaataaggagaagaaggtaaatgaataacgatattgagcgtgtcttatacagcgaagaaatgcttggcaaacgaatggacgaattagcaacggacttaacaaaagattataaggataaacggccaattatcatttccgttctaagcggagcagttttatttactgttgatatgattgaacggctagatatcatggcccaaatcgactttattgatgtttctagttattttggtggcttaggttcgactggaaaagttaaacttattcatgatttgaaaacagatgttaaagatcggcatgttctaattatggaagatattgttgataccggtcatactttgaagtacttgatggaccttttagccgaccggggagcaaagagcataaaggtttgttcattattaaataagccagaaggtcgggaagtagatgtcgaacctgattatgttggttttacggttcctaaagagttcttggtagggtatggccttgattacaaaggattctaccgaaatttaccgtatgttggaattttgaagccatctgtataccaaaatgactaaaaatgttagataattaggatgacggaaaaatcaatattaaatggacggtattttaaagatattcttaattaacgtccatttttatggatccgtaaatatgtagtatgtattattaataacattggcgataaaactattaattcttctgtaaaattaatggtcaatatttgtcaaatatgctatgataatgactacaattataaaatatcgttgctggtagataggaggttgttatgaacaacaatcgtaaaaaaaataattttactcataacgttctcttctatgccgtgatgttcttgtgtattatgggaatcgcctacttcttctttgggggcaatgcctcaacaggacaaagtaagacagtttcccaaagcgagtttatctccgaactgaagagtaataaggttaagagcgttcagcttcagccaaatggtggggtatataaggttacgggtacttaccgtaaacctcagtcaaacaatgacaattccgccaacaatactggctttgctcttacaccacaacgaaacaataaggtaactcaattccaaagttctgttttggaaagtgacgtaactgttagtcaacttcaaaactatgctaaccgtcataatgtaaagattagtactcgtgctgaagaatctaatagtgtctggatgaacctgttgttgactgtcttgccattggtcatcatgattttcttcttctacatgatgatgggccaagctggtcaaggtgggggtggccgtggagtgatgagctttggtaagaccaaggccaagccatctgatgctaagaaaaacaaagttcgtttctcagatgttgccggtgaagaagaagagaaacaagaattggttgaaatcgttgaattcttgaagaatccaaagaaattcactaagcttggtgctcgtattccatctggtgttttactggaggggcctccaggtactggtaagaccttgctagctaaggcggttgccggtgaatcaggggtaccattcttctcaatctctggttctgactttgttgaaatgttcgtcggtgttggtgctagtcgtgttcgtgacttatttgatcaagccaagaaagctgctccagcaatcatctttattgatgaaattgatgccgttggtcggcgccgtggaaatggcatgggcggcggtcacgatgaacgtgaacaaaccttgaaccaattgttagttgaaatggatggtttccaaggcgatgaaggaatcatcgtcatggcagctactaaccgttcagatgtcttggatcccgcccttttacgtccaggacgttttgaccgaaagattttagtaggtcgtccagatgttaagggtcgtgaagccattttacgagttcatgctaagaacaaaccaatggcaagcgacgttgatttaaaggaaattgctaaacagactcccggttttgttggggctgacttagctaacctattaaacgaagcggccttattagctgcgcggcggaacaaaactgaaattgatgctgctgacttagatgaagcagaagaccgggtaattgctggaccagctaagcataaccgtgtccaatctgaacaagaacgaaagactgttgcataccacgaagcgggtcacacgattgtgggtcttgtattaaatgacgcacgagttgtgcacaaggttaccattgtcccacgtggtcgcgcgggtggatatgctatcatgcttccacgtgaagatcagatgttaatgtcgaaaaagaatgcgatggaacaaatcgctggtctgatgggtggacgagctgctgaagagcttgtctttaagtcacaatcttcaggagcttcaaatgactttgaacaagcaacccaaattgctcgttcgatggttacccagtacggaatgagtgataagattggtccggtagaactgcaaagttctggtcaggtctttacaggtcaaggctatgaccaatcaccttactccgaaaagactgctgctttagttgatgaagaagtacgtcgaatcttaactgaagggcacgaaaccgccttacacattattgagacgcaccgtgaacaacataagcaaatcgctgaagcattactcaaatacgaaacgcttgatgaaaaacaaattcttagcctttataagactggaaaagttcctgataaggatgtggctgctgaagacgaagaggcacgtgcacaaacctttgaagaatccaagcgtgaacttgaacgattggaaaatgagcgtcacgatgaagcaaaggataatcaaaatgattcatccgatactaagagtgacaactcaaatgattcacaatcaagtgatgattcagacaattctgaagacaagtaaactattgaaaagacggaagatacaaaacctgattggtaggtggtgatcttccgttttttctttaggattaattttaaggagaaatttaaaatgaaaacaacagattatttagtaaagtcaatgactaaggatggaaagtttcgggcttatgctgtaaatgctacccaagtcgttcaaaaggcacacgaaattcatgatacatggagtgcttcttcggctgcccttggtcgaacgttaattggaacgattctcttggctacttctagtttacaaggagaagcaggaatgacggttaagattcagggaaatggtccagttggctttattattgcggatggaactgctgaaggaaccgtaaaaggctacatgggtaatccacacgtttctttaccagccaatgataaggggaagatcgatgtcgcaaaggcaattggtaatcaaggaactctttctgtaaccaagatggctcctggcgacaagacaccatataccggcgaagtaaatttagtttctggtgaacttggtgatgactttacttactaccttgctcaatctgaacaaattccttcagcagttggcctttcagtattcgttaaccctgatgaaaatattgacgttgctggtggcttcatgattcaagtaatgcctggtgctagcgatgaagaaatcagcaagcttgaaaagacattgaagagcttgccattggtatcacaaatgttacgtgatggtgatacgccagaagatattttaaagaaaatttttggtgatgacttaaagatccttgaaacgatgccggttcgttatgcatgtgattgctcgaaggagcgttttgcacatgcccttgcaagtatttctaaagatgatatgaagaaattgattgacgaagaccaccatgcggaagctgtttgccaattctgcgggaagaagtacgaatttagcgaagacgaattaaagaagatctacgcggaaatgactgcaaatgatgataaaaaatcaacagatgaaaagtaatttttggtgctaagcgtgttgatatgctatgatagttgagttatcggacaattaaaaatgaaactggatggccagcacagtttcttaagcagtaatgaggtgaaaaaatgaaatggaagatcggtaacgttgaaattcctaatcaagttgttgttgcaccaatggctggagtaaccaattcagcctttcgggttatctgtaaaagatttggtgctggctacgttgtctgtgaaatgatctcagaccgtggcattgtgtatcataatcaacgaactttaaatatgatggatgtcgacccggaagaacatccaatgggaattcaaatttttggcggaaccaaagagacattagttgaggctgctaagtatgtagatcaacatacagcagctgacgtgattgatataaatatggggtgtcctgttaataaggttgtaaaaactgacgcgggtgcacggtggttactggatcctaataaagtctatgaaatggtgtcatatgttactgatgctgttaagaagccagttaccgttaagatgcgaactggttgggacgacaagcatattttagctgttgaaaatgctttggcagctgaacgtgcaggagctagcgcgattgcgatgcatggtcgaactcgaaaacaaatgtatacgggacaagcagattggaatatactaaaagaagtagcgagtcaattgaaaattccgttcatggctaatggtgatgtgaagacaccagaagatgctaagaagattcttgatatgactggcgcaaccgccgcaatgatcggtcgggcagcaatgggtaacccatggatgctaaagcggactgaacattacttagagactggtgagctgctcccggaagcaaccccagaacaaaagattgaaatggccaaagatcatcttaatcgtttagttgatttaaagggtgaatatgttggagttcgtgagttccgtgggttatccacgtactatatcaagggtattccgcgtgctgcccggactaaggtagcgttagtcgaggcagaaacacttgatgaaatgaacgatatttttgaccgctttgctgaacaaactgcagaacgagctgcaaaaagacagcaagcttaattacgaggaggagaacttaagtgtcacaagaactagatcaaatgcgcgttcggcgtgaaaaaatggaagagttaaaagaagcggggattgaaccgtttggccgtcgcttcaaacgagaccatcttgcccaagacttgcatgataagtttgatcaatacgataaagaagaattaaacgagatgggcgccaaagtaattattgcgggtcgaatgacaagaaagcggagtagtggtaaggctggtttcgctgactttgttgatcggactggtaagattcaagtttacgctcgtaaggatatggtcggggatgagccttaccatgttttcaagcggtcagatattggtgacttccttggaattgaaggggatgttatcaagacggatacaggtgaattaactgttcgtgcacataaaattaccttcttgtcaaaagcattgcgtccacttcctaataagtgggatggggttactgatcctgaaactatctatcgtcagcgctaccttgatttaatttctaacccagaaagtttcaagcgtttccaccaacggacagcgatcatcaaggccgtccggaagtacatggatgataatggctttacagaggtagaaaccccaattttgaacactcaagctggtggtgctaatgcgcgtccatttatcactcaccacaatgcgcttgatattgatatgtacttgcggattgctaccgaattgtaccttaaacggttaatcgttggtggctttgaacgggtatacgaattgggccggattttccggaatgaagggatggaccctcaccataaccctgaatttactacaatggaaacttatgctgcttactttgacttccaagatgttatggatgaaacagaaggaatcgttaaggcagcagctaaagttgtttcagatgatggaaagattacttaccaaggacatgaaatcgaccttggagggaactttaaacggatcacgatggtggatgccgttaaggaaaagactggcattgacttcagcgatgaatcaatgacggacgaagatgctaagaagttagccgatgaacacaaggtcgaatataagccttactggacaaaggggcatatcttgaacgcattctttgaagagtttgttgaagatacacttattcaaccaacttttgtctatgaattcccagttgaagtttcaccattagcaaagcggaatgctgataatcctgcgatgactgaccgtttcgaattgtatgttgacggtagcgaattggcaaatgcctttagtgaattaaacgatccaattgaccagaaggaacgttttgaaatgcaagcaaaggaaaaagctaacggtaatgatgaagctgaaccagtcgacttagattacgttcaagccctcgaatacggaatgccacctactgggggacttggtattggaatcgatcgtcttgtaatgctccttactgatgctaaatctattcgggatgttattctcttcccaacgatgcgtccggaaaaggaaactaagaacgattcaaagaaaaagaagaacaagaagaagtaagctgaatggttgatgaaaaattagcataaatagataactcgtattccatttttatggggtgcgagtttttctgttttagttatgttagaataactatcaatttagaggagaaatgaggggaattgatgggagaattagaaaagttaaagcaagactgtatagtaaaacaaaagcgtgggttgcatataataattgcttcgatcgtagtatggggcggtattcttgcagtagaactacttaatgttcccgttcttactaaaaacttattcgtatttgtctgtacggccttacttttaccaatatcttatttcatatcgcgattaattaatgtggattttcaaaataagacaaatccgttaactaagttggggatgttattttcgatgaatcagcttttgtatcttctaattgcaatgtggatttatccgactattcccaataaaatgctaatggtgttagcgataatatttggtgctcatttactgccatatagttggttgtataattctagggcttattttatttcatcgatagtaatttcaatattagctttattggtgggaactaattttaaaccgtttattttagcatcagttatgcttaccatagtagtagcattttgcattaccttaatattagaaaatcatcaacttgactgaagggctccgatccgtaaagaagatcgaagccttttttactatattattttaattcttgtgaaacttctaatagtagaaaaaacaattgcaaaaagagactaatagttatcaaggaatgttcctaacaatctatccaagaagatataaaaattgaattggtccggctattcagctactgatttaatggctgaataataatttccagcgttaagataaaaattgaatgggtaaatatatcgagttactaaccgagtttaatattgatgcttttctccatactaattaggtgattttcgggatggaaaagaaatgctaattggtaagaatggtaaaggaggcaggcaaacttattaaaggaatagtgagtttaagaagctaatagatagcgatgaaaataaaattcaaaaaagttgaaaaaaggtgttgacgaaagaatgaaatccatgtatagtagttatcgttgtcaaaacagctaagtgctgttgagatggtttaacaaaaaagttaaaataattgttgacatcgacttggcaacatgatatattaataaagttgctgattgagttatcgatcaaaagaaattaaaaaataatttaaaatttcttcttgacaagttaatccgatgcatgatataattaaattattgattggctgcttaattagccgacaggtagacctttgaaaactgaacaaagtttcgacgaatcaaatgtgtagggtcttcaatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataataacaaaagccacatggcttttgtttaaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcaacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcgaagaaactttgtttagttttgaggggtttaccctcagagcttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagtaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattacatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatgggtaacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgttcccatgccgaacacagaagttaagcttcaacacgccgaaagtagttgggggatcgctccctgcgaggataggacgttgccatgcgttattccggcatagctcagttggtagagcacctgactgttaatcaggttgtcgtcagttcgagtctgactgccggagtcgatgaagatgttgactaccttcggttagttaacatctttttttgccaacttagctcagctggtagagcatctccctcgtaaagagaaggtcggaggttcgactcctctagttggcattatgaaaggtttataaccaattagaagtctacagattaagccgataaagcttattatgtaggcttttttgtatacttaagaagttaagtgaattgttcgtaagcagtcaataacagtacgtctagctctagctaccccggatcttctatactgagactatcatcagtaaggagattttttatttatgacagaacaaaatgaaattattaccccagttttcaaaaacaagccaagtaatttacaaaagcattcttttacggcacgccctgccgtaaaaattaatgtgaatgaagtcgaattaacgattttcaaggggactaattctgttttagcttcggatatcgttaaagtggttattcgttatgctcgttaattggcatgacccagattatatctatttagtctgtggaaaaacagacatgcgaaaaggtattgatgggctcgcaatggtaatcgctgagaactatggattagaattatataataattcgcttttcttattttgcggcggacgtaatgatcgctttaaaggattgttttgggatggcgagggctttattatgctctataaacggtttgaaaatggccaccttagttggccgagaaacagtaatgaagccaaagaattatctgctcaacagctcgactggttattgcaaggactgaacccattaccaattcgtaaaattcaagctgttcgaccaggaagtttttattgagttacctctatttaaaagaagaattctttgatataattaccaaagaataattcaaaggaggtgacgtaccatgaagcaaacagcggaagaacaaatcaaagaacttaaacaacaattagctatggccaatgaaaagattgctcaattaacagctattatcaaacttcaaaagaaccaaatatttgggaaaaaaactgaagtaatggagcccatcgttgatggacaacaatccttatttagtgagcaagaaatggatcaacttcaagatcctgatatttcagtcacggaagtgactgaaaagaaaataaagcaagtggtgcgtcaccggaaagcaaaacaatctggtcagcggaccacttttttagatggtttaccacaggttgaagaagttattccattaaaagatactaactgcccacactgtcatcaactaatgaaaaaagtgggtcaacatgtatatagtagagaagcacggttaaaaccggctgaattatattgtgtgaatttgattcaagaaacttataaatgtaatgagtgtattaattctaatggtagcgatgtacttgtcagtagtaagatgccacagagtcttttaccccatagttacttttcgagtactattttagctaaagtagcagagttgaagtttaatcttgctttaccgtttcatcgtcaaattaagttttggcaagtcgtcggcttacgagttgatgctcgattattggcgactaacatcattaaggttagtcaaacctaccttgaaccgttatatgattatttacaggaattaatcagaaaagaatcggtaattcatatggatgaaactccattcaaggtaattgatgagcctaatgaaactggctacttttgggtaacgcgatcaacaaaagaattcagtaagcatcaaattatcatgtttcattactataatacccgcgcgggtaaaaccattggtcaaattatcggtcatcaatatcgtggaattattatgtgtgacggttatggtggatatagtgatcgattatatccccaggcaaaatttgggtcatgtttagttcatattcgacgtgaattttatcacattacatgtttattgaataaggagcaattgaagaactccaaagcataccgagttttacagctaatgcgaccgatctttcatgaagagaaacaattaacatattccaatcataaggaaaaactagtgtaacgtcggttgcacgtgaagcctttgatggataagttatatacttatttagaaaatatcagttttcctcaaggacggttgaaagctgccattaataatgctttgaagctaagaaagcgagtatatcaaatatttgaagatggtcgagtgccgttaacgaataatccggttgaacaagcgattcgtccatcaactcttattcgaaagaatagcttatttgcgaaaagctctgctggagctcagtcaaataccattttctatactttggtggcaactgcaaaccagaaccatttaaatatctacaaatactttaagtatctttttgatcacttaccaaaccgcaaggacgcaggactttaggcttatttgccatggtcaaaagaaattcaagcaaaatgccataaataaaacggggtcatgaattaccattttcggtagctcatgatcccaattttttcaatccgtactgttattgactgcttacgatccaccacgctcaaggcgagaaataaaattaattgatagattgcttaactcagcaagttgttgttgggtcatatttaattcatggcgacggttagcaatattttttcctaattgttgttccatagttgattattccttgttttttattttaagggtaatatgattatatactaaagtcgctaaacggatcgaacaaaaagagaatatgatttattgaaacttaatctcagctaaaaatcagtacctaaccttcatgttattacattggttcaacaaaagtaagctgttaaaacttcttatgattaagtagagcagaaaataaacaaactcctacttgaaaatatttctagacaaattttaaattagcttgacgggtataaggatataatatataatgatatccgttgagttattccggcatagctcagttggtagagcacctgactgttaatcaggttgtcgtcagttcgagtctgactgccggagtcgataaagatgttagctgtttggctagcatctttttttataccttctaaacatctttttaatattctaaattgcatatctccagtttttaacgatagattattaatttttatatcaaaaaaattgtagaagttttaacatgagaatatactaaaactgtaactagtttcatatgtagtttaggagaatggaggtatttataatgcgatttagtaaagcaatccttgttgcaacaagcataattgcaattgggctatgtacaagtggctgtagtagttttagcacgagttccaacagtagcaagagcagtaagtctcatcagcaaaaaagaggagtcacatattgtgggctcgtatcgtgatgatgccgatggagctgctattacccttaattcagatggaactgggacatatgtaatggaaaatccgacgcagactgatatattcttgatcaattgacctggaaacaggaaaagaataattacatcattaatttaaatgatagtaattatgatacgccaattgatgcgcggctaaatgaagataatttgagccttgtaggtaacgatgaatggcctaatcagtcatttaaacgagttcatggggactttgacgttgataatttctcaaaagaacaacatgcgaaaactaacagttctacaactaaggatactcattctaaggaatcatcgactcatgcccgcgcagcacttaaaaatgggcgagtgaccaccacaaagacaccagcaagattgataatttgaaggctacgactgacctatctgagccagatgaaggttgggcctgatgataatggaactgaatgtgccattgttcgaaatggaaaagtttacccacgtccggttattgatggtgatacgtcatctaattaataatcttagcgacaaacttaataaaataaacaattatagctcatacatgcgtttgcgttctcatcaaaaacttatttttcaattgacgatgttttgaaacacgtttataatagtactattctgaattttattgttaaagttttttaatgtttagaatacgtattcaattaacattgtgctaattgaaaagtgaaattatttggaggaattgtatgagtaaacaaaagaatttggatacctccttctttggacaaccgcgtggattgtcgacattgttcttcactgaaatgtgggaacggtttagttactacggaatgcgggctatccttctattctatatgtactacgctgttaccaagggtggtttgggtatggaccaagctaccgcagcatcaattatgtcaatttatggttcattagtttacctggccagtgttgtcgggggatggttatctgaccgtgtatggggatcgcgtcgaacggtcttcatcggtggtgtccttattatgtttggacatatcgctctgtcattaccatttggtgtgtcagcactttatgtatcaatcgctttgattgttattggtaccgggttattgaagccaaatgtttcagaaatggttgggggcttatatagtcctgaagatcgtcgtcgagactctggttttagtatgttcgttttcgggattaacttaggggccgctgttgctccttgggctgtcccttgggctgctaatggctttggcttaaaccttttccatggtgaaatgaacttccacgctggtttctcactagctgctatcggaatgttctttgggttagtacaatatgtagttgacggccggaagtatctttcaaaagatagcttatatcctgatgatccgatcgataaggaaagtttacgtccagtaattatttggtcaattgttggtgttattgcattagtgatcattcttggattgcttgcggcaatgggtcaattaaacatcaataatatcattacaatcattacggttattgctattgctttaccaatctactactttgtaatgatgttgaattccaagaaggttacaaaggatgaaaagtcacgggttgttgcttacattccacttttcattgctgctgctatcttctgggcaattgaagaatcaggttcagttgttttagccctcttcgctgaacaacggactattttacacattggtggctggcactttgctgctgctaacttccagacattgaacccattattcattatgatcctaacaccatttttcgttgcactttgggatcactggaaaaaacaaccaagtgctcctggtaagtttgctgctgggttagtaattgcaggtctttcatatgtttggatggcacttccagcaatgattcacggtacaactgctggacgggttagcccattctggttagttggttcatggttcattgttgaaatcgccgaaatgttaatttcaccaattggtctttcagtaactactaaacttgcaccaaaagcatttaagtctcaaatgatgagtatgtggttcttggcggatgctgctggacaagcggttaacgcccaggttgttaagtactactcatcagctacagaagttccatacttcttaattatcggggcagtaagtatcgtcttcggattgatcctttgcttattcgttaagaagattcatggcttaatggatggtgtagactaaaaattatattaagagatcgagaataattcttggtctctttttttatgaggtgagttatgaaaatcgcagtaagcagtgaccttcatttagatttaaatcatgctgatgttgcagaaattattactcaacaggcgcattatttaacccgtcaagaaattgaccattacttttttgtgggggatgcctttaatgattttgcgcaaaccagcgtatattttgcggaactacaatcgcaattgcctatcacaaaggtccattatcttgccggtaaccacgatatgttagaaggagtcacttatgagcaattagaaaatttggatgatgatctatattttcataaccgatttatcgatattccccaaacaaactggcggattatcggtaacaatggttggtatgattattcgttttcaacgtatgaaagtaatgtaaaaggggtcgcaaaatggaagcgggcatattgggtggatcgtccaattatgcagccaatgaatgatccagaacgaatggcgattgttttacaccaagttgaagaaaacctaaaacaggctcgcaatcaacaaaaacaggttatctttatgacccacttcgcaccgattagagaagctctcccgcatccaattattgagtcagcacggcggcagcggatgtgggagatgacgacagcaatgttgggtagtagacacttaggagcattactcgctaaattcccggaagtaaaagcagttttctatgggcatcttcattatgctcaatcattaattactgttggaaatattgaataccgtaatcaagcagttggcgtaagacgcaaaaatagtgagaactggaaggggaaaagcctattagatcaatggattagctgcctttatactaaaaaaatctagttttttcaaaaaaataagaaaaaatacttgcaatgaggttggaaattaggtattataataaacgttgattgatacgaaatatttaatcaagcaacttcttggaggagtagcgaagtctggttaaacgcgacggtctgtaaaaccgttccttcgggttcggcggttcgaatccaccctcctccatctttattattgggctatagccaagcggtaaggcaacggtttttggtaccgtcatgcgctggttcgaatccagctagcccaactgttattgaaaggctaagaaaaacatctgtttttcttagccttttctagttcaaaattttattaagctatatgaaaaaaggaatgacagccaatgcctaaacaaggtcattttgcaaaaagcatgcgaactaaacaaataaatgattttaaagtgaaacgcaatgcgactggtgcgaccattgatgatgaacagttaacagatttcctagtggttcgctttgctttaacagctaagaagagggttcaatctggggctcgagaaactgctcaacggttcttgattgaaatttgtgattctttacaagaaaatgatggggatttacaggcgatcattccaaatttactagtgagtcttaatgcccgggtaccttggcaattctatccaaaaattctgggagagtgggatttgcttcaaaagtttttacaaaaagaacttcctgcagttccgttagaaaaacgtctacgaattaagcacccagtcacaacccaggaaatggagacgttaattgcaaaattattggtcagaaagattactgcaattacgtttattaatcagccgggagttgatccacataaaaaagatcagatggtgacaatgatgctgacaacgatctatcatgatcaaacgattgaatgggataaagtacggttgttactggcgccatttaagtttgaaattgcccctgaactagacgaagaaacgaaagactggttaaagaaattagcagaaaaataataacgttgactttcgttctgcttccttggtagaattaaatcgttattgcagagctgtggtggagtttttatcaccgtggctctttttattttgatttgaaggaggaagcgaaaagcaatggcagaaaaaaactattcacggatttatctcgcaattggttcccttgcattactaacgtttatcggaattttgaatgaaacatcgatgaacgtcacatatccagaactatctgctcagtttaatgtatcactcgatgttattcagtggattacaactggctatttattgatggtaacaattacgatggggacaactgcctatctattacgccaatatcaagcgcgttggttgcacttatttgcagtatcatttttcattattggtgacttgatgtgtgctttgactggtaattttcctattttgttaacggggagattgattcaagcgatggcaactgggttagcaaccccaatcatgttccatttaatttttacggagattccgcgtgaaagaattggcatgatgaccggaatggctgcaatggttatttcgtttgcaccagcactgggaccaacatatggtggggtcatttcagaaatgctgtcatggcggatgatcttttggattttactaccaattgttttgattagtcttgtatgtggtcaactttttattcgtaataaaccacttggaaatgataaagcatttagttatggaagcttgattacactggcaattgcccttattagtataattagtgcagtttcttcaattgggaaacaaggatttggcaagcagttttggcttttattattggtagcaattattttctttagcacctttatctatatcaataatcatggtaaatcagaattgtttgacttaaaggtgtttaagattttcccattgcggctatcaactgtcacttattttaatttacagtttattaatattggaatttcgcttgttattcctatttacgttcaatatgttttgcactcttcggcaattgtcgcgggtcttattttatttcccgggtcattaatcggtgcttttatctcgccatttgctggaactttggctgatcgttatggttttgctacgccagttatttccggggggattcttttggttattgggacaagttgcttcagtattttccaacgtcatttaacgccattactaataacgatcttctttgttattttgcgaattgggtttaactttgctttttctaatacaatttccaatgcttcaatgttggttcaaccgcaaaatgcccctgatgtaaactcaatttttaatatggtccaacaatttgccggctcactgggaactagtcttcttgcctccacaattgctttattccaaatgggcaacagcggttcactgatgggacgtacatatgctggaggacgatttgactttatcttattgggcgttttggcaatcattactttattaacaatggttactaactatcgcatgcaacaaaagaaggaaagtatttctcaataagtggttgaattagcctgacaagaatgtaataatgtggcttgattaatacaagttattacaggtttttaaagaaagtgactataagttaaaatgatacattctatcgttcactttatggtgagcaatcaggtttttacgctgtttatttgtcttgcaattggctttttgattggcaactataaaattgcgggtaaatttaatattggagcaacggtgggaacgttaattgtgaccctaatcgtggggcaaattgggagttttccccgggatgaaatgttgggaacgattttctttggcgccttcatgttctctgttggttatcggatcgggcctcagttattagttagtttgaaactatttgggattcgaattttaatcgctagtattttctggatggttgttgcattcttagttgggtggagtcttttttccgcctttaagattggaccagggatcgctgccggggttatttcgggagccctcacccagtcagctaccgttgccagttcgttgcaaacgattgggtcattgccagtcagtcaaagtgttagggcaacttatgaggctcaactcccagttgcctatgctttaacatatgtttttgggacattaggggtaattatctttttacgtgacctagcacctaaaattttggggatttcaattgctgaacagggtcctaaaatggctgaacattatcactttcatgctaaaaacccgaacccaacgtggcgacgaacatatcgcattgcaaatgattcaccgcttgtcggcaaaacgcttgaggaatttaatcgacggtctaattaccggattattgggttagctgcttttcatgatggcaaaatgactgaccaccttgaatatcaattgcaggctggcgacttgctaactgttattggttacgctgttcatttcgatcggttgatgcgagtaccaggattaacagaagtattgacgccaaccaatgcgccgcgtgaacgagcttttgttctgggaaaaaactttaaaccgggtgaattagcccttctacggcaacatggggtttttgtgaacattcaagacccaatcagtggaaaccaacaattgattaaccagttgcgaccaggggatgtgatttcattgactgggaatacatcacgaaccaaagcaatcttaaaaaagatgggacgctggaaagctgcagatacagcgatgaattattctttattctctttaggaatcggttgtgcttcccttttaggaattatcgggctaaaattaaatagtattccgttgcaactaggaaatggaacggcggctttaattatgggactaatcctgagttcatggattgagcgtcaccgtgaccgtaaatcaatccctgtaacggtaactagctttcttcagagttttggactaacgctttttgtggggacagttggtttacaatcagctcaagcatttacaagtgcaattaagtcgttagggatcggggtcttatttattggggcgatgatttcaataatgccacatttgctaacgctgttctttggacgctatatattgaagatggaacctcttgctttaattggtgcgttgactggttcaggaacgattgcagcggcaatgaatgagatttcgcaaaaagcagggccggaaggtggcgcatattatgcggctgcctttactccggcgtttgtagttggtaatattggaattacattactagggccgatttttgtggcgctactatcataatttatcgcttagaaagggcgtgcaaaattataatgcaacaattttttacaattttaggtggaatggggacgctggcaacagagagttatgtacgtctgttagataaaagaacgccaattcatcgtgatcaagattacttaaactatttagttgttaaccatgcaaccgttcctgatcgtactacatggattctcgatcatagtcaaccagatcctaatgaggccctgattgaagatattaaacagcaaagtcttttgaatcctgcattctttgttttaatttgtaatacagcccattactcttttgataagttacaggcagcaacggagattccaattctcaatatgctgcaagaaacggttaacgagatcaagaagattaagccggatgcaaagcgggttggtctattagccactaagggaactttggcagctaacctatatgatccttatattgagaaggctgggtacgaacttatcaagccaactcctgagattgccgatatgacagaagacctgatttaccatgatatcaaagaggctggtcattccgatggcaagaagtatcatgagctagtacggaaaatgattgaagaacaaggagcagatgtagtagttttgggttgtactgaattatcttttgcagaagagatggatcctgaaactaagtaccctgttgccgattcacaatcaattattgttgatcgctcccttgaacgagcattgaaattacgacaaaataataaaaattaaaaattagagaccagaaaggtaataattccaacggtctctaatttttattaattttttgccgatattttaagaaattggtctagatttttgggaatggtgtaaaatatacacatgcgcaatgtttagcaaacaatggcgtaaggaggaaagaaaatgagttcacctgtttatattcaaattcataatcggttaagacaaaacattgaagatggtgagtggaaagttggcgataaaattcccgctgaacgcgaactcgctaatgattttggcgtcagtcgaatgactttgcggcaagcaattcaagcattagttgatgaaggaattcttgaacgaagagttggctctggaacttttgtcgctaatcgcaaagtccaagaaaagatgtcaggaataacgagctttactgaattaatgcacgcgacagggaagaaagctgctagtaagacaatttcttaccacttgacgatcccttcgcaaacagaggttgaaaagctaaagttagccccagatgaacaggttttacgaatggaacgggttcgttatggaaatgatgtgccaatttgttatgaaatcgcaactgttcctgctaacctcgttcaaaaatttagcaaagaagaaattaccacgtctttttatcggacgctagaaaaaaaggcgaacctctatcctggtcatgcaacccagcatatttcagcaacgaaggcgacggaaaagattgctaattacttgcagattaagcgtggagatgctctcttgcgaatgacccaactatcttacttgcaagatggtcgtccttttgaatatgtccacactcaatatgttggatcacggtttgaatttgtctttgaaaagtaatcaagacaaatccatgttacaatactgattaacgatattacttttgagaggaattatactaatgaaatttgattatccggatgatagccttaccctgcatactgatgcgtatgaattgagtatgatgcagacctactggaaaaaaggaatgggtaaccgccgtgctgtctttgaggccttcttccgtaaaatgccatttaataatgggtacgctgtttttgccgggttagatcacattattcgctatgtaaaacaattacattttactgatagcgacattgaatacttaaagtctacgaatcaatttgatgatgactttctagaatatttacgtaactttaaatttacgggttcaatcaacagctttgaagaaggagatctggtatttaaccatgagcctattattcaagttgatgcgccgattattgagggccaattgattgaaacggcaatcttaaatattcttaattatcagattatgattgcgacaaaggcttcacggattaagtcaattgttggtaaccaaactgtaatggaatttggctcacgtcgggcacaagaattggatgcagctttgtggggaacgcgagcagcatatattggtggcttcgatgcaacaagtaatgtccgtgcaggtaaattatttggtatcccgatttcaggaacccatgcccatgctcttgtgcaggtatacatgaatgattatgacgcatttaaagcatatgcagaaactcatcataattgtgtctttcttgtggatacttttgataccttaaagagtggggttcctaacgcaattaaggttgctaaggaatttggcgataaaattaactttatcggtgtccgcattgacagtggtgatatggcctacctatctaaaaaagtacgcaaaatgttggatgatgctggtttcccagacgcaaaaatcatcgcatctaatggcttagatgaaaagacaattcaaaacttgcaaatgcaaggggcgaagattgatacatggggaatcgggactaagctaattactgcctatgaccaaccaactttaggggccgtatacaaattagtcgctattgaagatgaagatggccaacttgttgatacgattaagatctctaataatgttggtaaaatgtcaactcccggcaaaaaacaagtatggcggattaacgatcgtggagacggcaagagtgaaggggattatattacattagttgatgaggatcctcgtaatgaaaagtcactcaatatgttcaatcctaacttcccactccagcaaaaagacgtggaagattttactgcccggccaatgctaaagccaatctggcaagatggtaagtatgtttatgatgaaccgaccttagaggagagtcgtcaacaccgtttcgatagcttaaatgctttatgggatgaatataaacgcgatttaaacccagaagtatacccagtcgatttatcacagaaatgctatgataacaaacttaaattaattcaccaagttcatgaatatgttaaatcattgaataagtagaggtaatctgtagtgcgaaagtatcaagaagaaataattaatgcattaggcgttaactcgcaaattgatccccaagcagaagtaactaaacgtatccagttcatctgtgattttctccaaaccactaagatgaaggccctggtattaggaatttctggcggtcaagattcaagtttggcggggcggctttcacaattggcagtcgaaaaactgcgggaagagactggcgacaatgaataccaatttatcgcagtccggttgccatatggtgagcaagctgatgagtcagatgcaatgtttgcaattaatgacttcattaaacctgataaaataatgcgggttaatattaaggcggctactgatgcgatggtagtatccttaaacgaagccggtacgccaattagcgattttaataagggaaacattaaagcccgggaacgaatgattgttcaatatgctattggcggagaaaacaaaggagccgtagtgggaacagaccacgccgctgaagcagtaactggtttttatactaagtttggggatggtggtgcagatattacgccactttctggattggataagcgacaaggaaaagccttattacaatacttaggagcaccagcaaaactttatgataaaacaccaaccgcagacttggaagaagacaaaccaatgcgtcccgatgaagaagcgcttggtgttcgctatgatgaaatcgacgactacttagaaggtcgtgaagtttcgccagcagctgctgaaaaaattgaaggctggtatcgtcgaacccaacataagcgccacttgccgattgctccatatgatacttggtggaagtaaattgataataaaatgggaggctgggaatcaactcagtctctttactagttttaaggagaatgataatggaagaggaaacacttcagcttgttagcaaacaattgccagatattcgccctcaacaaattaaagcggccctcggattaatggatgagggaaatacgattccttttattgcccgttaccgtaaggaaatgacgggcacgcttgatgaagttcaattgcaagcgatccgggatgaatatcaccgggtaacgacattacgggaacgtcaagcaacagttatcaataaaattaaagagctcggtaagctaacaccggcgctcgaaaagcaaattaacagtgcaactgaattgcaagaagtagaagacctttacttgccatataagcaaaagcggcagacaaaggcccaacaagctcgtgaacatggcttggcaccgttagcaaattggctgctatcttatcccgatgatgatttaagtgcgaaggcgcaagagtttattaacgatgatgttcctgatgctgaaagtgcattaacaggcgcccatgaaattttggctgaagcaattagtgaaatggccacggtacgaagctggttgcgaaattatactgctcaacatggtcaattagagacaagcgtaaaacgtgatggtgaagaaaaggatgaactggggacttacaagcagtactatgagttcactagtccagttcagaaattgaattcttatcaaatcttggcttttaaccgcggagaaaaagaagggattattaacgtcaaaatcactttagctgaagaaccagtgatgaattaccttcgttttcgtttgattaaaactagcaagaaaaatgatgcgactgcctttattgaggaagcttacaaggatgcttacaagcgtttcttgggtccagcaattgaacgggaactgcggcgacaattaacagagggcgctgatgaacaagcgattaaggtctttggtgaaaatctctatcatttattgatgcaagcaccaatcaagggaaaagttgtattgggcttcgatcctgcctaccgaacaggctgtaaattggcggttcttgatgaaaatgggaagttcttaaccaaagcggttatttatccgcataagccagcgccagaaaagcaacgagccgcagcggaaggcgaatttattgatttgctagagaagtatcatgttgaaatgattgcgatcggtaacgggacagctagccgggaatcagaacaatttgttgcggaagctcttaaaaagatcaaacggccaatctattatgtcatcgtaaatgaagctggtgcctctgtttactctgcaagtaaggaagcgcgtgatgaatttcctgacttgcatgttgaacagcgaagtgcaattagtatcggtcgtcgtttgcaagatccacttgccgaattagtcaagattgatcctcaagcggttggggttggacaataccagcatgatttgccgaagaaagaattgagtggggaactggaaacgattgttgaacgggcggtaaaccgggttggcgttaacctcaatacagctagttaccaattgttgacgcggatttccgggcttaataaaacaattgctaaaaacattgttacctatcgagatgaaaatggccgctacacaaaccggacacagttaaagaaagtgccacggttaggacctaaagcttatcaacaatctgttggtttcttacggattattggtggcgaaaatccattagataacaccgatgttcacccagaaagttatcaggtggcggaaaagattattcaagcggcaggaattaatgtcgatgagttaggaacgccaagtgctgatgataagttaaagaaaattgatgttaagcagttcacggatgatcaagtcgggactgaaaccgttactgatattatttcttccttgcaaaagccaggccgtgacctgcgtgattcaatgcctgctccattattacgccatgatgtaatgacgattgaagaccttaagccggggatgaaacttcaaggaactgtccggaacgttgttgactttggagcctttgttgatatcggtgtcaaacatgatgggttagttcatgtttcaaagatgagtaagcagttcattcgtgatccgcgggcaatggtagccgttggtgatattgtggacgtgtggattgatgatgtcgacttgaagcgtcagcggattcaattaacgatgcttgaaccggagacagtcacaaatgactaatgcagaattacaacaattgaccgaacagtggtcgaaagaatactttgggcgcgaatttacgcacaaggtattttttaataagcggttaaaaacaactggtggacgctatcatttaagtgaccatcatattgatatcaacccgttaatgtatactgagtttgatcttcataatctgcgccaagtggtccttcatgaattgtgtcattatcatttacatctgttaggaatggattatcaccatcgcagtagagaatttaagactttactagcacaggtgggaggatcaagatatgcgccaccgactagtaaaagaaagataaattccaagaaaaaatggcattatatctgtactggttgtggtgttgaattcgcacgacaacggcgttttaacacccaaagatatatttgtcgacgatgtggtcacaaatttattttaaaaaattgaaaaaagttgttgccaacgaataggtatcttgctataataatattcgttggttgatatgcggccgtggcggaactggcagacgcgtaagattaaggatcttatggtcgattatgaccgtggaggttcaagtcctctcggccgcactacttaaaaggcactgagcaatatttgctcagtgccttttttgttttaaaatttttgttcaataaaatttacgtaaattttacctctcctcttgctatcccaatcatgaaagcgctatactttagatgttgtagatagtaatgaggagggatttattcatggatgcagatatcaaatggcttgatgaaccggaaacattccgggttaatcaattacctgcgcatagtgaccattattactacggcaactatgatgaatggcgtcataataatagtcgttttgcgcaaaacttggatggtcaatggcaatttaactttgctgaaaacccgcgtgaacgtgaagaagatttttataagacagattatgatagtagtagttttggaacaatcgaagtccctagtgagattgaactaaataattacgcccaaaataattacattaacactttgattccgtgggaaggtaagatttaccgtcgtcctgcatatgcccttagtcctgatgatgcgcaagagagatcatttagtgatggggatgataatactgttggcgaatacttaaaacgttttgaccttgatccttccttacggggaaagcaggttcgcatccggtttgacggtgtcgagcgtgctatgtatgtttggcttaatggtcactttattggttacgctgaagacagttttaccccctctgaatttgacctgactccttacattcaagatgaaggtaatgttttggctgtggaagttttcaagcatagtaccgcctcatggattgaagatcaagatatgttccgtttttctggaattttccggagtgtaaacctattagcccaaccacttgttcatgttgaagaccttaatattcggccaattgttactgataattatcaggacggtatttttaatgttgaccttcaacttcacggtgaaaagaccgggaacgttaatgtgcgggttatcgacaatgatggtaatacgctcgtcaatgaaacacaccctgttgactccacggtagaagttcgggatcaatttttagaaaatgttcacttatgggataaccatgatccttacctctatcaattgttgattgaaattcgtgatgacgaaggtaatttggtcgaactcgttccataccactttggttttcgtcgaattgaaattaataaagatcatgttgtcttattgaatggtcaacggctaattatcaatggtgttaaccgtcacgaatgggatgctaaacgtggccgtgcgatcacgatggatgatatgacgagtgatattcaaacctttaaggaaaataatattaatgccgttcggacgtgtcactatccagaccaaattccgtggtattacctttgtgatgataacggaatttacatgatggccgaaaataatctggaatcccacgctacctggcagaagatgggagcaattgaaccatcatataacgtccctggttcagttcctcaatggcgtgatgtagtagtagatcgggcacggactaactatgaaacatttaagaaccacccgtcgattttattctggtctttaggtaatgaatcatatgctggcgataatattgtcaaaatgaatgaattctataagaagcatgatgacagtcggcttgttcactatgagggtgtttgtcatactcctgaataccgtgatcggatctcagacgttgaaagctggatgtacttaccacctaaagaagttgaagagtacttgaagaacaatccagacaagccatttatggaatgtgagtacatgcatgatatggggaactctgatggtggaatgggttcgtacatttctttacttgataaatacccacaatactttggtggcttcatttgggactttattgatcaagccctccttgttaaggatccggtaagtgggcaagaagtgatgcgctatggtggtgatttcgatgatcgtcactcagattacgaattctcgggagatggcttgatgtttgctgatcggacaccaaagccagcaatgcaggaggtaagatactactatggcttacacaaataaattacgcgtgatatatggtgatgcgacattaggacttagtggtgacggctttcattatatttttagctatgagcgtggtggactagaatcgcttaagctaaacggtaaagaatggctatatcgtgaaccaatgccgacgttttggcgggcaaccactgataatgaccgaggaagcggctttaatattcggtctgctcagtggttagcagcggacacttttcataagtgtgttgcgattgacctgacagttgataatcaacactttgccgaattacctattgcgccgataaccaatgaatttagtgatccggtatctgctgagaatgtcaagattaagtatacttttgagacgctaacagttccggctacgcaagtcactgtaacttatgaggttaacggacaaggtgagattaaagtgacaatgcactactacggtcataaagacttacctggtctgccagtagtaggaatgcgttttatcatgccaaccgttgctaccggctttgactatcaaggattatccggtgaaacttacccggaccggatggcaggagcgactgagggtaccttccatgttgacggcttaccagttactaagtatctagtccctcaggaaaatggaatgcacatggatactcatgcattaacaattacccgcgattccacccaaaataatgctgatcattctcgggaaccatttagcttaactattaaacaagacgagcaaccatttgccttcagttgtttaccatatacagcggaggaattagaaaatgcaacacacatcgaagagctcccactcgcacgacgaactgttctcgttattgcggggaccgttcgaggtgttgggggaattgatagctggggagcagatgttgaagaacagtatcatattcctgccgaccgtgatgttgagttttcgtttgtattgaatacaaaataagaggttggattatattccatgccgctatgttcgtaaaaagttgtataacaaaggtctctaacacccggtaaatccgaacgttagagacctttttgttttaattaatttgtccagctgcaatcccttggaagtatttcttaatatgagtacagaaataataaaggccataaattgcaagtatgctaagaccaactaatgagatcactaataaggcggtgaaccatttagcttgcttaaagtagagggtaacggtatttttccctttacgttgctgaacgtaaggggcaccaaccgaggatcgctgatagtggcgaagtagatgagcattagccgttaattgtgattcatgatacgtaataattggcaaccgaacttttcccgcttttcctgcttcccatgataattgcaatcctccatgcggcaagacagtatgagtatatttatgggcttcattaataatttgcccttcgtaagcgtaagaacgaacatatttttgattcatgtacttcttagggatcggcaaatagtcaggacttctcttctcaaccatcgttaacaattgaccagggtaaagatcatgaacggaatgtcgcagtgcggccttattttcacttacgcgggtaatcgcgctaaaactattaagaacaatttctgagtcatagcgggctgcacgtttataaacatcaattgttgtaggagtaaagaccagaaaaaccattagcaagaggataccggtgattaattgatttcgtaagtcaatctcttgcgcttttttatcaagggttgtagcgctgatcccaactcctgcgagtaagaggggaaaggcaatgattgtcaatcggttaggaaactgtaaagtgtgtccaagtgcagggaccacatcttggaaaaaggaccaaggagtaagggaagaactaagcaggaggaccaaagaaccaagtaacgtcaggactgtattagtaagcgattttttgaaggtgaataatacgtaaatgagttgaaggataaagagaagccacattgcgtagattagataatcgcgtgtactgctaaacattgaaggcagtagcacattatcggcgaggctaaaatcggcaggatgggcaatattattatggaggttaagcattaataaggctccccaaacattagccgttaaaataatagttccgccgactgccttcagcgtttcgatccacattttcttacggttagtcgttataattaacccaataataaagaacggtgttagtgtaatcacaaaaaataaagaacttagcatatggatctgaatgataatcgtcatcagggtcatcaattgtagccagttgactggtcgttggtgatcctgaatcatacgtacgccgcaaattaccatataaggagccagagcagctccccaggcattcatgttctgtgctaattcccatcgtggaagccacccaatgttcatatagattagggcacagataattgcaaatgtccgtttactatgaacgcggatgctaagttgatacataccgattccacctaatagatagacgataaaggtagtgacgatctgatattgataccaagttcctactacgccgagaatagccccatttaaatatgcaaagagggggccataaacggcattgatgatgcgaccactttgttgaaaactataattactttgaaaatagctaaaattaagctgttgaatttgcttagctgcatcgtaaaaacggttaaagtgaaaaatggagtccgtccctaaaataactccatgtgatacaaactgggggaacatgattaaataggccattgcagcgatggcacagtatggaagcccccaattaattagattagcaattttagatttcataaaattgagaattaaaccaaatcagtttaatttttcctttcctcaaatacttaccttaataattatacggcagaaaagtcgactgtaaaataaccttctgcagctagtttaattgttaagcactagtaaaatgcgctattataagcatagtggcaaaggggagtgaaaaaatggcagaattagtaattgtacgtcatgggcaaagtcaagctaaccgtgataatatttttactggctggactgatgttccgttgactcctaaaggaattgaacagggtgaattagtcggcaaggaattgctaagactgggtatccaatttagtgatgcgtatacgtcttacatggaacgggcaatcatgacgactaatattatcctagaagaaattaatcagttatatattcctgtccataaaacgtggcgactaaacgaacgtcattatggagcattgagtggccggaacaaagatgaagtgaagaaagagattggtgcagaacagcttcataaatggcggcgtggttttaaagatttaccaccacaattaaaagaacgtcagcatgatcaccgctatgatcgcttaggagttaagattccgcttagtgagagtttagaaatgacgctccaacgactcctcccatattggcaagaccatattgcgcctcgtttgattgatggacataatcagttaattgttgcccatggtagttctttgcgggcactaattaaatatttagatggtatttcagataacgatattgataaagtggaagttccaaatggcaagccaattttatatcgctttggtgatcaccttaatgtcattaaaaagacttttataacaatggatggtgaaattgatgacaatacacgaattagcaaataacccaacgttaagcggccaagtacgcttgattgaaaatattgtttatggtgcgatggatggtgaggcattacatatgtcgatcttagcaccgtggacgcaacgtttcccaaaacaatatcaaactgaacctcggccattgattgtctttgttcaaggaagctcgtggcgaaccccaaaaatgggagaagaaattccacaactggttcaatttgttcaggccggttatattgtagcgactgttcaacaccgtagttcaattgatggtcactcatttcctgcgtttttgcaagatgttaagacagccattcgtttcttacgggccaatgcgcaaaaatatgcaattgatccgcaacaggttgcaatttggggtacttcctctggagccaatgcggcaatgctagtcggcttaacgggtgatgatccgcgctataaagttgacctttatcaagacgaatcggatgcagtagatgcggtggttagttgttttgcaccaatggacgtggagaagacgtttgagtatgatgctaatgttccaggaaataagttactgcaatattgcttattggggcctgatgtatcaaagtggccagaaattgaaaagcaaatgagtcccctatatcaagtcaaagatgggcaaaactatccaccatttttattgttccacggagatgctgataaagttgttccatatgaacaaatggaaaaaatgtatatgcggttgaaggataatggaaattctgttgaagcgtaccgggttaagggtgcgaaccatgaacgagatttctggagtccaacaatttataacattgtgcagaagtttcttgacgatcaatttaaataaatttcaataattgtattgacaacttattttttataagttatgattttgacatactaagttaggaggaacacgtcatgtttaacaaacaattaattagcgctactgtttgttgttgtggatcgcgtcttatgcgacccacagtttggcgtgcttacttttagttgagtaactgctaacgtaatcgggaataaatgcataaggcgcaaattcaagtgagaagttcttgagtttgtgccttttttgtattcgtttttgcattctaaaggagatagatattatgaaattcaacacacaattaattcatggcggtaatagtgaagatccaaccactggtgcggtctcaacaccgatttaccgttcatcaacattccatcaacatgttcttggcggtgaacctaaatgggaatattctcgaacaggaaatccaacacgtgcatctcttgaaaaattaatcgcagagcttgaacatgggacagccggctttgcatttgcttctggatctgctgctattcatgctactttttctttattctctcaaggcgatcattttgtagttggtagtgatgtatacgggggaacattccggttaatcaacaaggtattaaaacgctttggccttgaatttactgttgttgacatgcaagaccttgaagcagtcgaaaatgcaattcaagataataccgttgcagtttattttgaaacgccaactaatccgctcttgcaaatcgctgatattaaagcaattgctgatatcgcaaaaaagcatggaataaagacaattgttgataatacctttgctaccccttataaccaacaaccgttaactcttggggcagatattgttgttcactccgcaaccaaatatttaggcggtcatagtgatgttgttgccggattagcagttactaacgatgatgaaattgctgaacaattagcgttcctgcaaaactcaatcggtagtacgcttggtcctgatgatagttggctattacaacggggaatgaaaactctcggtgcccggatgcgagctcaccaagaaaatgcgaatgaagttattaatttcctccaaaacgatgaccatattggaaaaatttattatccaggcttaaaagattttcctggtcatgagattgcggctaagcaaatgcggaactttggagcaatgatctcctttgaacttaaggatggtttagatgcgaaaaagtttgttgaaagtctacaattaattgatcttgccgaaagcttggggggaattgaaagtttgattgaagttccagctgtcatgactcatggatctattccccgggaaatacgattagaaaacggaattaaagatgagttgattcgtctttcagtgggaattgaggaccctgaagatattattgttgacttgcaacaagcacttaaaaaattagattaattatagaagaagggaaactgtgacttatgtgggaaattatcaagacatctttaccacaactcttagcagcgggatttaaatatacgattccgttagcgattatttcatttttctttggactgattattgcactagtaacagctttaattcgtctctctcgtcaacgtggcgcattcatgattcttaaatggattgctagtttttatgtttggctttttcggtcaacaccgctactggttcaattatttattgtattctttggactgccatatctgagaattaagggactcctgccgcatggaataaaattagaaccatttacagccggcattattacattttcacttaatactggtgcttatgcttcagaaacaattcgggcagcgatcagttcagttccaactgggcaatgggaagcaggcgcagctatcggaatgacgcggttgcaaatcttatggcgaattattttaccacaagccttaagagtagctttaccgcccttatcaaacagttttataagtttggtcaaggacacctcattggctgcttcaattacaattatggaaatgtttgctgttagtcaacagattgcggccgaaaactatcaaccattgcttatgtatactttggtagctatggtttatgcggtctttacgacaatcttatcttatttccaaggatatcttgagcgggtagtagaccgtcaagtaaatgcaaataataggtgagaaaaatgaaattaacaaatattaataaaagttttggtaataaaaatgtcttgaaaaataccacgttagagtttcctgaaggtaaaacaacagtaatggttggtccatctggatctggtaaatcaacaattctccgctcacttaacttactggtaatgccagagagcggccagtatgattttgatgatcatcatttggattttagtcaaaaagtaagcaataaagataagttggcaattcgtcaagaaacagggatggttttccaagactacaatctttttcctaataaaactgtccttggtaacattattgagggaccaacacaggttttgaaacagacaaaaaaggaagcaattgcaaatgcgaataatttacttgctaaagtgggcttagcagattacggggaagcctatccgaatgaattatctggtggacaggcacagcgggtagcgattgctcgggcattggcaatgtcaccaaagtatatcttacttgatgaaccaacttctgcccttgatccagaattagaacttagtgtgttgaaggttctattgcaattagctgaagaaaaacaatcaatggtaattgttactcataacatggcctttgcgaaacatgttgcggataagattatttttgtcgagaacggcgaaattttatataatggtactccggatgagttttttgctccagataatccaaataaacgaattaagaactttatcgcctcaatgacaatggaaaatttaaaataaaggaagtttagaataatgaaattttggaagaaagcactattaacaattgcagtcttaatggtcggtacctctgcaggaatcacaagtgtttcggctgcttcatcagctgttaattcagaattagttcataagggagaattgacaattggtcttgagggaacatactccccgtactcttaccgtaaaaataacaaattaactggctttgaagtagaccttggtaaagcagttgctaaaaagatgggcttaaaagctaactttgtaccaactaaatgggattcactaattgccggtcttggttcaggtaagtttgatgtagtaatgaacaatattacacagacaccagaacgagccaagcaatataatttctctactccatatatcaagtcacggtttgcattaattgttcctactgatagtaatatcaagagcttgaaggatattaaaggcaagaagattattgctggtacgggaactaataatgcgaatgtggttaaaaaatataaaggcagccttacaccaaatggcgattttgctagttccttagatatgatcaagcaaggtcgggctaccgggacggttaactcccgtgaagcttggtacgcttacagcaagaagaacagtactaagggtctcaagatgattgatgtttctagtgaacaagatccagctaagatttcagcactttttaacaagaaagatactgctattcaatcttcctacaacaaggcacttaaggaacttcaacaagatggaacagtcaagaagctatctgaaaagtacttcggtgcagatattactgaataattaaaaaagatctccaacgtctgtgtgttacagtgttagagatcttttttgaagggactgtgacataagttaggttacttccataaaatacgaacagcgcagtacaacaatggccttcagcgtccggcaaagtcgaacgctgaaggcctattgttgcttgcgggggctcgaaaacgaagtcacaagtgacttctgtcttgctcccttttcacaaattaatgttaaattattatgctaaagttcccattggatcccaaggcttaagaacgactgggctcttagcgtaatcacgtttaagatcttcgctaaggtacttcttattaataacgacttggtagcagtacttgtccatccaatcgtcactcataacgaagtaacctttatggccgaccttgttaccccatgagttttcaactttccacttggttggcttaccatctacaaggtcaacaccagtgataaccattgcgtgatccatcatgctttcaccataatcaagtgcttcagctttggtcatttcaagatcaacgtcaaatagtttgtcgtagtcataggtgttaagggccataatcccaagtttagtttctgaatatttaataacatctgaaccaaaccaaacactttcgccattctttaattgttcaatcgcaagctgcttgaattcatccattggtaggtttaagtgcttgatttcgcggccaccaacgacattaccaagcatatcgatggtgtaagtttggtggtacttcttatcagcagttggtgcttggatgattgaaatataatcatcaagattccagccaacatacttcttgaagaattcttgtggggtaaggttagtatcgcggtggaattcgttgtccttctttgtccgatattcgaagtcaaagtgactaaccggttcaccaaatgtgtaagcaagcatccggtaattctcgttcaacatcttccggcgcgtttcgttaattgcttcttcatttgcatgatcttcgttaatcatttttcgcaaaataacggcatcgtgacgaagcttgttgtttaagacttcatcaattccccgtgagttagaagagttaaatgattcgggcattgcggcttttggcataaccccatacttgctgataagggcgcaaagcatatcccattggccaccatcgttttgtggttcgttcattaaccatgaaacttttcggctgtcggtaggctttttagcagtcttaattacgttttggtagaagtaattagatttttcaaacttatcccagaagaactggtaggcttgggaaagttcaaaattatcaggtaagttaaatttttgctgcatatcatgacgcattgtgttcagtgctgcaaacatccaacaacgaccggattgtttttgatcagcaacgtcccccgtcttgaggtcaatagagaaatgaggagtattatcagcaattgaatgccaattaaagcttgcattccgtaccccgtttttggtaacagtattttctaagacactgctgttagggtgatgacggtagtttttatgaaaactagcgatatcttctttgttaattgaaaagctcatttgcaatatctcctttgaatagattgaattaacgggcgtgcaatacctttggaccttctggagtaccaacaattacgtcgttaactcgatttaagaataaaccagtttcgacaatcccaaccatgtggatcaattcatcggctaaggccttcggatcgtcaatttcgccaaggtgaaggtcaataatatagttattttcatcagtacggaactttttatctccgtccatccgccaagttggcttgtagcctttcttttcaagaaggtcaaagacatgttgggaaccaaatgggattacttcaaccggaagagggaaagcaccaagtttatggacgagtttgctttcgtcgacaatccacattactttatttgaggcattggcaacgatcttttcccaaagaagggcaccaccgccacctttgataccttggaagtcatcactgatttcatcggccccgtcaatagttaaatcgatgtggtcaacgtcatcaatatctttaattgtaattccgaggtcgcgtgcttgcttagcagttcggtttgaagtcgttacaccgatgatatctttgattttaccttcttggacttgcttaccaagctcatcaaccatatatttaacggttgatccagttccaagaccgacaatcatcccagatttaatgtacttaactgattccttacctgtttgttcttttaatgcattttgatccattaatattccccctaattaaagcgatctgcaactggcaatagttgctgatattctggatgtagtttgaattgcgctaccgcatatggacacatgagcttgacaatgtattgttcttttgttgcataatccacaaattgacgtactaattcagctgcaattccttgcccacggtaagttggttgcacaaaaacgcgttcaacgacaacgtgatcatttgtatctggaacttttggaaaactgatctcgccaactaaaggttcttgatcgtcaaaagcaatgatccgctgaccatcaactcgatattgcatataaacacatcctttcataataattttcgataaactgcttttaaaagtcaagttatcaaagcgataccattaatttattatctagcatataatagtatactggaattattaagaataaaacactatgaggtgaacgtaatgaaacgtggatttaagattgtttctagtaagaaaggccaagatatacatttaccccaacggcaaacaactcgggcggccggatatgattttgaggcatcagaagattttattctgccatcaatttggaaaggcaatttcttgaaggcgctatggcaaatccatcaacaaaaaaagctaattgatgaagaatttaaggctgctgattcctgcttaaagccatacttagtacccaccggcatcaaagcctatatgcaacctgatgaatttcttttattagctaaccgatcaagtggtccttttaaacgccgcttgattctaccaaatggaatcggcattgtggatgcagattattatgataatgatagtaatgaaggtgaaatcttcttccaacttattaactatgggctgcgggattatcatataaaaaagggagaacggatcggtcaggggatttttatgccatatttaatcgctgatggtgaagaacaaccaaccgctaaacggactggtggattcggttcaacaaaagaataaataaacttagagaggaattaaagcgatggcaaaaattcgaacacaatatgtttgccaaaactgtggttacaactcaccacgctacttaggccggtgtccaaattgtggtgagtggaatactttagtggaagaacaggtagagaccagttctgcaccaaccaaaaaagcaactaccaccttaaccggcttagttgccaaaccacagaaaattaatgagattgatagtacagagactccccgtgttaaaacaaaattgaatgagttaaatcgcgttttaggtggaggaatcgttcccggatcactaattctaattggtggggatcctggaatcgggaaatccaccctccttttacaagtttctggacaattaagtgatgagcatcaccgggttttatatgtgtctggagaagaaagtgggacacaaattaaaatgcgggcggaacggttgaaagttgctggggatgacttttatgtatatccagaaacgaatatggatagtattcgggatactattcgtgacctcaagccagagtatgtcgtgattgactcggtacaaacgatgcaggcgactgatgtaagttcagcaattggtagtgtatcgcaaattcgtgaagttaccgcccagttaatgcagattgctaaaagtaataacattacgatttttgtcgttggacatgtgacaaagggcggtgcaatcgctggtccaaagatcttggagcacatggttgatacagtcttgtattttgaaggagacctgcaccatacatatcgtattttgcgatcagtgaaaaatcgatttggttcaactaacgagcttggtatttttgaaatgcatacaaatgggctgacggaagtaaaaaatccatcagaaatctttttagaggaacgattacatgatgcaaccggttcagcggtggttgtttcattagaaggaacgcgaccaattttggttgaaattcaagcgctggtaacaccgaccgtttatgggaatgcacagcgaactgctaccggtttgagccgaaaccgagtatcattgataatggcggtattagagaaacgtgctaacctaatgcttcaaaatcaagatgcttacttaaaagcagctgggggcgttaagttagatgagccagcaattgatttggcaattgcagtaagtattgcctccaattatcgggataaaggaaccaagcccaccgatgcatttgtcggtgaagtaggtttgactggggaaattcgccgggtaaaccgcattgaacagcgggttgctgaagcagaaaaacttggctttaaacgaatctttattcccaaaaataatttaaagggttggaaaccatcaactaatattcaagtagtcggtgtctcaacgcttaaagaggcgttatatttagcgctggggtaaaataaataattgaaaggatgaagcaaatgcggcgtagaatgattactctcatttatattctagttggcgcggcagtgggattttactatttgccattattatgggggattttgaacatcgctcttaatccggcattattagtatttatcgacattattattggtgcacttattttctggctattatccctcccattggttagcggcactgaaaagttgatccagcgaatcgaaaaagaactaaccaagcgtagtcctgtataccttttctttgggactttattaacgattattggcttagttttagcagttcttatttcgattccattgtggagaacgaggattccggtaattaataatattctgccgatccttctaatgattgtctttagttattttggttttcgaattggtacgacgcggttagatgattggcgtaaagcatttacccatgccaaaagtagtaaaaccgatggtggtaatgtgattgaacggcaagatgataattatcaccattataaaatcctagatacaaatattctgattgatggacgcatttatgatttagtcaaaacgggttttctagagggaacattactggttcctaactttgttttatatgaattgcaatatatcgctgattctggcgaaagtattaagcgtgttcgtgggcgccgtggccttgatattttaaacaagttacggaaagaaaaaattgttccaatcgaaatgtatgatggagactttgaagatattccagaggttgatagtaaattaattgccctcgctaaagaagtcaatggggtaattgtgacaaatgattataaccttaataaagtaattcaattccaaaatgttcaagtattgaatattaataacttagcgaaatcattacgaccacgagttattccgggcgaaacgatgacggttgttgttgtgaaaaaaggaactgaacgacaacagggtgttgcttatcttgacgatggaacgatggtggttgttgaagatgggcgttactttatggataaacaaattgaagttgaagtaactagtgctcttcaaacagacgctggtcgaatgatctttgctcgtccgcttcattcacaacgaggaattgacgagcatacggatacggaacataaagaaaaccgaaataataaagataagaaaaaataacaaagaatggctgtgaagaagaaatagagttttcttgcttccggctattttttaaaataaaaaaagaagcagctcgggaaaaagctgcttcttagggagtattacgataatcttgggggagatttcgtaaaaaagaaaatatttttttcggttactattgggaggagtaattgaaaaataataggtttcattgatgtagtaaagttcatctttactacgatatatataatagcagtagaatgtgaagaaagtatgaccaaatgttaaataattttttggatacaaattaatattatcagaaatgctattctaatacggaatgtggtaagattaactgtacaaattaattctttattaatgatttttaaggagcggatagacatgctaacaatttacaatacgttaacaagaaaaaaagaagaatttaagccattgcatccaggcgttgttaacatgtatgtctgtggtccgacggtttataattacattcatattggaaatgcgcgcagtgcgattgcctttgatacagtccgacgttaccttgaattcaaagggtataaagtaaattatgtttctaactttacagacgttgacgataaaatgattaaggcggctgccgagcaagggattaccgttccacaattagcagagaagtatatcaatgcttttatggaagataccgcagcaattaatattgagccggctactcttcatccccgggcaacggaaaacattaccgagatcattaagttcgtgcaaggattagtagaaaaaggatatgcctaccctaaagatggggatgtttattatcgcgcacgaaagtttaaccactatggacagctttctggacaatcacttgatgatcttgaagttggggcaagtgaacatgttagtgcagatgaggttaataagaaggaagatccacttgattttgctttatggaaagcagctaagcccggcgaaattagttgggattcaccatggggaaaaggtcgtccaggatggcatatcgaatgttcagtgatgtctactaagtacttgggcaagacaattgatattcatgcagggggacaagaccttgaattccctcaccatgaaaatgagattgctcaaagtgaagcagaaacaggccaaaaatttgttcgttactggatgcataatggtttcgtaacaattggaaaagacaacgagaagatgagtaagtctctccataatttcattactgttcatgaaattatcaaggaagtagatcctcgggttttacgtttctttatggcgactactcaataccgacgtccaattcaatatagtcaggcaaacttaactgatgcgcaaaataatcttaatcatattcaaacagcctttgataacttgacttatcgtgaacaagatgccgataagggagaggttcaagaagtcactgatcggcttgatcaatttcatcaccaatttattacagcgatggatgatgacatcaatgtccaaaatgggattgctacagtctatgaattagttaaatatgcaaatgtttatgctcaacaagacagtgtgagcttaggtgctcttcatgcaatcaaaaaagaacttgttgaattgatgagtatttttggcgttaagcttgaagcaagtgacaatcaaattaatgatgaaaagatcaagcaattgattgaagaacgaaatgtagcacggaagaataaagattttgcgcgaagtgatgaaattcgagacaaccttaagaaacaaggaattattcttgaagatactcctcaaggaacgcgttacaaaaaggaatagaaaggatccttatggtacaagcagattatcgacaacttaatggaattgctttggcttatttaggggatgcagcttatgaggtttacattcgtcagcatcttttaaccaagggaattagtaagccaacgaaactacaacatattgctacccactatgtttcggcaaaagcacaggcggctcttattgacttgatgaaagaagacgagttactgtctgatgaagaatggtcgtattttaaacgtgggcgaaatgctaacagtcatactcacgctaagaatacatcagttatgacttatcggatttctaccggatttgaagcggtaatgggttacctcaaattagctggtaaagaagagcgattggctgaattagcgcaatggtgtatcgaacaagtagaagcggggcgaacagcacatgaaaaatgagaatacggattttattattggccgacatccagctgtgatggcactaaaatctgaccaagagatcaataaagtttttattcagtcggggttaaaggccgatgctatttcccagattgttaaattagcgaaggaacgccacttagtagtatcgaatgttcctaagaataaattggacttgatgactgaccgacaaaatcaccagggggttgtgttagctgtagcagcataccaatatgcaactattgatgacctctttgataacgcggctaagcatgacgaagatccatttttccttattcttgatgaactagaggatccgcataatttaggttcaatcatgcgaactgctgatgccgctggtgttcatggtattattattccacgccggcgagcagtaggattaacttcagtggttgccaaaacatctacgggagcaattgaacatgtaccagttgcccgagtaacaaacctggttcaaactgctaaagaattgcaagaacgcggtgtttggctgtttggtactgatatgaaaggaaaagattaccgaacatgggatgcgcatggtgccgtcgctttggttatcggcaatgaaggtaaaggaatttcatccttgctaaagaaaacttgtgatgaaatgctaacaattccaatggttgggcatgttcaaagtttaaatgcgagtgtggcggcaagtttgttgatctaccaaggctttaactctcgtcatcctttaaaataattttgattttattgcttttaaaccttgattcgtgctaacctaagtactgtgtggaggtgataagtatgtcccagaaaaaagtagcattggaatgtacaaagtgcggtgcgcgtaattatacgattaccgctaaccctcaacgacaagaacgattagaattacgtaagttctgtaaacattgcggtgagtatactattcatcgtgaaagcagatagtggaggaaaatatgcacttaattcgatttattaagagtgttaaccacgaaatgaagctagttgtatggccaacagctaaagagaatcgtcgtgatacgactattgttgtttcattgactctgttcttcgtactattctttgctctgtttgattggttaattcaattaatgatgaaactctttgtttaacattagtagtcaaatagaaattagtttgttatactaaatctaagggaacttcgtagctattacgaagttttttattttactgaaaaatgatttgaattatgataggaggattcatcgtggaatcacatgaaaaacgttggtatgtgctccatacctactctggttacgaaaaccgggttaaaagtaacttggaatcacgggctcaatcaatgggaatggaagactacatttttcgcgtagttgttcctgaagaagaagttcgccaggttaaggacggtcaagcaaaagaaacaattgaaaagacattcccaggctatgttttggttgaaatggtaatgactgaccaagcttggtacattgctcgtaatactcccggcgtaactggtttcttaggatctcacggtggtggttccaaaccaaccccattgcttcctgaagaagttgatcggattatgaaacggatgggaaccgaaacaactgttagtgacattgatgttaaggaaggcgatactgtaaaagttattgcgggatcctttgcaaatatgactgccaaggttgtagaagttgatcacgaaaagcaaaagattaaggcgactgttgaaatgttcggtcgtgaaacggctgctgaattaggctttgatcagattgatacattttagttaatttaatattttgaaaattgttgaaataaattgagaattgtggtatgttttctaagtatgctattaacatactgtgggagaggtaaaacttactgcctcatcatgaccacaacacggactaaggaggttttgtctcgtggcaaagaaagtagctaacattgtcaagttgcaaattcctgccggtgccgctacaccagctccaccagtaggtcctgcacttggacaagcaggtattaatattatgggcttcactaaggaattcaacgcacggactgcagaccaaaagggtatgttgatcccagttgtaattactgtatatgaggaccgttcattcgacttcattactaagacgccacctgctgctgtcttactaaagaaggccgctggtgttgaacatggttccggtgaacctaacacaaaaaaggttgcttcagtaacgaaggaccaagttaaggaaatcgctgaaactaagatgcaagatctaaacgcagctgacgtagaagcagctatgcgcatgattgaaggtactgctcgtagcatgggcttcactgttgaagactaattactagcagtcgggatgcgctatgaaaatagtgcacccacgtgggaggtataactccgttagaccacatttgcaaggaggaaaacacaagatggctaaaaaacgtggtaagaagtaccaagacgcgctcaagaaagttgacagcaagaaagaatacgctgttaaagacgctgtccaattagtaaaagatattgcctacgctaacttcgactctactatcgaagtagcatttaacttaaacgttgatacaaagcaagctgaccaacaattacgtggtgccgttgttttaccaaacggtactggtaaggatcaaacagttattgttttcgctaatggtgaaaatgctaaggctgctcaagaagctggtgctgactttgttggcgacgatgatttagtagaaaagattcaagacggttggcttgactttgatgttgcaatcgcaacaccagacatgatgcctaaagtaggtcgtttaggacgtgtccttggacctaagggcttaatgccaaaccctaagactggtactgttacgatggatgtagccaaggctgtttctgatgccaaggctggtcaagtaacttaccggactgaccgtgatggtaacgttgctgtaccattcggtaaggtttcatttgatactgacaagttagttgaaaacttggctactttagaagacattgtagctaaggctcgtccagcttcagtacgtggaacatacatcaagcacgcttccatttcttcaacatttggaccaagtgttacgcttgatttaactacattttaatttaaattagttaaaatgaaaaaagactttgagatttttgctcaaagtctttttttgtttcaatttttacttcacaatagagatttgttgtgctatattattaatcaatgataaaaagattaaaaaataattagattttatcatttgagtttaaaattaattaaggagtgacgacaatgacacaatttaaatattcaaagcgtgttccagcagatggtacggatgcggttggtgcaattttacaagcagcggcggatcctaagattatttcatttgctgggggattgccggcacccgaattgtttcctgttaaagaaatgaaagcagctgttgataaggtttttgaagaacacggtcaagaagcgatgcagtatggggcagcgaagggagttacagctttacgtgaagttatccaacaacatgtaaagaaaaaagaaaatgtggattccgaattagacaatgttttagtaacaacgggatcagaacaagccttagatttagtgggcaaggcatttgttgacccgggtgatactgtattagttgaacagccaacgtacctctgtgctttagatgtttttcgttcttacggtgctaattttgcgagtgttgagatggacgaagatgggatgaagatggatgctttagaagaagcactaaaggctaatccaaatactaagctcatctatactgtgccaaacttccaaaatccaactggacgaacaatgactgaagaacgacgaaagcagttagctgaattagcagaaaaatacgatgtatatgtactagaagataatccatatggtgaaattcgttttgctggtcaacatgtaccagcagttaagtcatttgataaatcaggtcatgtcctttacatgagtacattctcaaagacgttagccccaggatttcgtctaggatggttggttgctgataaaaatgtagttaataaattgacggttcttaagcaatcagctgatctccatacagataacttagctcaattcgcggttgcccaattctttgccgataacgatgtggatgcccacgttaaagaaattagtgctttatacggcaaacgtaaagatttgatgcttgagggaattaaaaagtatttcccagaaggagttaaatatacggatcctgaaggtggcatgttcttgtgggtagaagttcctggtgttgatgatacagtagagttatttaaggaatgtcttgaacatgatgtagcctttgttccaggtgatccgttctttgccgatggagttcaacctggtgctttccgtttgaactattcaaatatgaaagaagaccagatcgaagttggtttgaaacgtttaggagcggccttaacagctgcagttaataagtaattatttcagccattaataaatacaatcctaataaaatttcgaatttaaatacttaagggagcgaggcagaagagctctcgtaaacaataataggcctctatcgcttgaaattaccaggcgttagaggcctttatattgcactatttgtcttatgtggacgtaatctgacatatgtccattccttttttagtcattaaaatgtagtaggttaatatactccctctgtactttgagttaattgtgattataattatattaattgctgaaaagttttaaatattcgggtttcttgctatctaattgggatagtaataagcattatcaaaaatttttaagggaaaaggagtttttgatagtgtcaatgatagatttcactaatacagaaatggcagtagccgttatctttactttaataataatgtttgtaatatcctttgcagttagttttttattttggttgatttaccaccaaaatatgaaaaaaggataattagagatgataattataatttttacgcttatttgggggatcgcgctgtttatatttttagtttattcattgattagtctgctatttcggatgatttcgtatcctcgggactttcattacttcgcgggaaaccaacaaccagctaaaattgactacaatttacaatattataatattatgttattgttccatgttttaatgaggcagcagttattcaacgaacaatcaaatgtttgttgcgatttaagcaatttgaaatagtggtagtagacgatgctagtagtgacaattcagttagtcagattactaactcgcatatccaccttttgcgacggcatcttcctaatgcccatacaggcaagggggatgtattgaattttgccctagattatatttgtcagatcactatccgacagagggtttcttttgaaaaggttattattggcgtagtggatgcggatgcccaattagttgataatgccctacagcgattaaatgcctatttttcctcaccaaggacgaatattacccaaatgcgagttaaaatgtatccacattttaaaaattggttgcagattttacaagatattgagttttttagtattaactatatggcccaaattatgcgaatgtatactaaaacagttggtttaagtgggaatggccagttctttcgacttaaaccaactattgataaaattagtgcgcatccatggggtaatgcgctcttagatgattacgaactaacgataaaaatgatgctgaaaaaattgcatgttgattatatgacagatacatatgtttaccaggaagcgttaacgtcccctaaaagatttgttcgacaacgaagccggtgggtacaaggcgatttaaattgtcttaagtatcttcccgagattattaaaagccgcattttaagcaggacacagaaacttggtatatattatttcctgcttcaaccatggcttgattttcttgcagacgttgcgattattattttaacgacgattgcccttactcattggtacaatttttatggccacttgactcttttgactttttcattagtgatggccggcttggtagtcttttcgttattttggagaataatatttggaatattttactatcgtgacttagctcactatcacgaacctcctttaaaaaaaacaccaattggccttattaccgcttggaatttcctatatgtatgttatcttatttttagtattataatggcttattggcggtggagttttcgccaaaattcgtggataaaaacggaacatggaaaaatgtttcttgaatagcggggagatatgatgagaaagattaaagtaatgacggtatttggaactcggccagagggaatcaaaatgaggccagtagtcaaggccttggagcaggatgatcgcttttcatcggtagttgtttcgaccggtcagcatgctgaaatgcttcaacaggttttagctgtttttaaaataacacctgattatgatttgaaaataatgcgtcctggacaaactttaacggaaattacaattgaaacgatgacgaagcttgaaccgattattcaaaaagagcaaccagatattgtgctagttcatggcgatactagttcagcctatgcatcagctttggttgccttttataatcgggttgctattggtcatgtcgaagctggtttgcgaacctgggataaatattcgccttatccagaagagatgaaccggcaaatgattgatgatcttgctgatttatattttgctcccacccaaacaagtgctaacaatctcaaaatgggaaatcatcagcatgggattatagtgacgggaaatactgccattgatgctttgcagtatacgattgaccattcgtatcatcaccaagtattagacgaaattgatcccgacaagaagattattttacttactatgcatcggcgagaaaattggggtaaaccgatggaagaaacctttaaggcgattaaagagattgtggatcaacggaatgatattgacgttatttacccggttcatctgaatcctaaagttcaagcggttgctaataaaatttttggaaacgataatcattttcatttgatttccccattagatgttgttgattttcataatattatgagtaagtctttacttgtgatgagtgattcgggtggggttcaagaggaagcaccagcacttcataaaccagttctagttttgcgtgatactacagagcggccggaaggagtaactgctggaactcttaagttaatcggtacgcaacttaataatgtaatgaaagagttatcgtccctattaaatagtcctgaagaatataataagatgagtgaggcacagaatccttatggggatgggcatgcaagcgaacgaattatagatgctattgctaaatgggcagcaactcaaaaagaattataaaaagtccctttacagaacttcagagaatatgttaaactgtaacagttgattaaatatgactctgcctaagactcaggtggcgaaagccttaatcaaatgcctgccgaggaagaaatgaaagttccttctctatgtctgcggtcatagggatttttttataaatccgatcaaaaaaacattgcaggaggtgaaaattcatgagtgaagcagctattgctaagaaagctgaaatcgttaagcaaactactgatatgcttaacgcagctcaaagtgctatcgttgtagattaccgtggtttaactgttgcggaagttactgacttacgtaagcaacttcgtgatgctggtatccaaatgtcagttatcaagaacaagattcttgatcgtgctgttgaaggtactgactacgaagatcttcgttctacttttgttggaccaactgctgttgccttctctgacgaagacccaattgctccagctaagatcttgaagaagttcgctgatgaccacgacgctcttgaaatcaagggtggtttcatcgaaaagagtgttaagactcttgacgaaatcaacgaatacgcaaatatgccaggtcgcgaagaactgttgtcaatgcttgcatctgcattgcaagatccaatgcggaagattgctcgcgcagtcaaggctattgccgacaaggaagacaaagccgcataattgccgtatatcaatacaatataaaattaaaattaattacctaaatattggaggaaataaacatggcttttgataaggatgctatcattgcttcattaaaggaagcatcaatctctgaccttaacgacttagttaaggctatcgaagaagaattcgacgtttctgctgctgctccagttgcagttgcaggtgctgctggtggcgacgctgctgctaaggacagcttcactgtagaattaactgaaccaggttcagctaaggttaaggttattaaggctgttaaggacattactggtcttggtcttaaggacgctaaggaccttgttgatggtgctccatcagctatcaaggaagacgttaaggaagacgaagctaacgacatcaaggaaaagcttgaagccgccggtgctactgttacccttaagtagtcttaaattattaaataaaaaagagttacgaaaatattgttttcgtaactcttttttatttcagggataccatatgaggtgttcttttgtaatacgaaaatagctcccaccatttattctaaataaggagctattttatgatgtgtgcaaaattttagaagaacaggaaagttaaaagtaaataaatctactttgcaggatgagtagtactatcattgcttgtgcggtaaccaaagtagaattgaatagcagcaatagcgatgttaacccagttcatagcaataaaccaaccgttaattgcgcttgcatcatgagatacaccataataaacccaaaaaccgataacaattgcacaaatattgatccaagcgaaagtcttttgtagaatttgattattaagttggaaccacatccaaatgacattaatgacaaaacaaattgccaagatccaaaaaataacattaaataacataagatatccctccttagggcctcgataaacattaataaacgcgtattgaactgatgaatagcaacattcgaaaaaagtattacgcggtgtggttagcagttgaagttatttacaatgattggtaatactttactaattttgggaaagttgttgcttagcatcttcatacccgtcaacatagtcacgaagagcatgcatcttacctttaataaacttattggtgacattaataattcgttgtggatacttcctgaaaggttctagagccttataatccttaactacttgatcataacctttttggtatgcatttgttgcaccattttggctatttgacgtaggacaatttttttgaacatctttatcacctcttttgttgtcctaccatgatagtaacaagtatacaaactcaattccaatgatatggtataaaaattaaaatattatgcattaataaaaatactggttagaaacttttaaccagcatttttattaatctttattctttttcagaagttcagtaatttctttgaggtacataacttcttcgctaggagtatcttttttgttatcttcttttttgcggaatgtattgattgcttttaccattaagaaaacaacaaaggagataatcaggaagttaatgactgcatttaggaaacttccgtatttaaactgagcatcgccgaccgtcaaaacaagattagataggtcaattcgaccaatgaataaaccaataagggggttaataaggttattaactaatgattttacgattgaggtaaaagctgcaccaacaattatcccaactgccatgtcaataacgttaccacgagcaatgaatgttttgaattcttttaacataaaatagacctccttctagctctagaggggaacaacttcaattatgattatatcaaacagaattaaatgcttagggcttttatgagatgacataaggagatttaatttatttttaaataataattgcatattatatcaaaccattatattatatgacatataatattacagctaaaaaggagggatagaatgaagattcaaattacagctgacttactcgatgggatggtcttagcaattcttgaacacaaagattactatgggtatgccttaactcagcgaatgcaatcagctattaccatttccgaatcaacaatgtatcccgttttacgccggttaaaaaaagacggttatttaataacttatgatcagccttaccaggggcgaaatcgccgttattatcaaattacggaagccggcaaggagcatttacaacgtattcgtaagttatggactgattataaaaatagtttagatggtattttttatgggttaggtgagggagaagataaagatgaatgaacgtcaaaaatacattaatgatttatcaatatatttaagacaattaactgatgaggaacgaaatgatgccttagaattttatgatgaatatattgccgatgctgggctggagacccgaacagcgattgaagaaaggttaggaacgccacgacagttaagtcataagatattagccgattattccattaaagctaataatgagtcgatcaaagaaggacaccctgcttcgcctcattctagttggcgtgtcttttggtgggtgctagtagcaattattacttccccaataacgtttgggctaggaattgccgtattggcactattgttggcagcagggggagtcgccttaagtttgattgttggaatagttgctttaatttttggggttgctgccatagcgatcgtatctatttatattggaattggtttaattgcaacaaacctgtttagcggactattttattttggcttaggattgacactgatcggcttattccttgtttgtttacctttaatttactggttaatcagagttattgttcaagggattgcgaactttgctaagttcatttatgcaaaagtgcaggcaaggaggaaaaagtaaatgaaaaaagtatttaaggtgggagtaattgttttaatcttaggagtaatcctcctcggaataggcttctttaataatggtaacaaggctgtttattttgagaacaatcgtccagcaatttttcattctcacactaaaacaataagtactaataaagcttttgaacggattgatatctcagcatcgacagctaatgtaatagttcgtgaaggcaaaaaatatcaaattacttattctggtataagcaagcattctccggccgtaactgttcataataacgttgcttcaattcgccaaactggtggctttccgcttgtctttaactttaatgattatcagccccaccaagatttaatcattgtgactatcccacatgatcaagccatagctggtcgtattcatttagagagtggtgatctaacagtttctcaagttaaaatggacaatattgatgttaacagtgatgcaggcgaggttgaataccgtcaagttacattacgtggaggaagtacaaaactctcgtcaggtaacttcacaggacatgatttaacagttcaaggacaatatactgttaataatcaatctggtgataatacggtcacaaacacaactgttgatggctacttcctaaagactgatgcaggtgataatgaacttaatggtgaagataagggtgaagaacccttacatcagaatgatgatgcagaaaatgtgctccgcttgataacgcaatctggtgataatgaagtgaattaaggtaactaagattaataaaagcccctcgatatctagaaattagatgtcgaggggctttttaataggagaaaagtcttaatttttaattatgcgctggattatttttcttcaacgccagtaccatcgtagcaacgttcaagtaattccttgagttggctaacaagtggttcaactgggttagtagtagtacattgatcttcgtaagctaagcgagcaagatcgtcaactactttatcaaattcttcacgtgtaacgccattgtccttaagactaagcttaacaccacattcgtgagcaagttcgataactttcttagcatatgcttcagctaattcttcatcagtgttgcctttcaaaccaatgaaccgtgcaatgtcagcgtagtccttagttgcatggtaagtctcatagtgaggccagagagcaagcttttgtggacgttttgcgttaaagcgaattacttgtggcattgcaatagcgataagcaaaccgtgaggaagaccgaatgctccacccatcttgtgggcaagagagtggttaattcctaagaaggcttgaccaaatgccataccggccattgttgagaagtcgtgcatcttacgacgagctaacttgtcaccttgaactgacttaggaaggttttccataacacccttgatggtttgtagtgaccaaccacgagtgtaatcagttgccataacagaaacatatgattcagtagcgtgacataaaacatctagtccagtccatgcagtagtttttgctgggacagtttcaacgaattgtgagtcaacaatcgcaatgtttggagttaaggcgtagtcagcaagtgggtacttaacatgagtttctgaatcggtaataaccgcaaatggagtaacctctgaaccagtacctgatgtagtaggaatcccaataagttgagacttagtaggcttcttgatttggtaagcacgcttccgaatatcaagatacttttgcataaccccataccatgaagtttctgggtgctcatagaacatccacatagccttggcagcatccattggtgaaccaccaccaagagcaataattgtatcaggtttgaagtcgttcatcatggcaacacctttttcaacagtgtttgttgatggatcttcttcaacgtcatcaaatactaagaaagcagtgttgttttgacgttgacgcaattgatcgataacacgttgaacgtaaccacgcttgctcattccaggaccagtaacgataaatgctcggttaatgtttggaatatcttgcaattcttttagtgagttgcgttgaaagtatacttttgggggaatcttaacccattgacggttttcacgccgctttgcaattgttttgatgtttaagagatcccaatcagtaacgttgtgagaaattgagttaccaccgtatgaaccggtacctaaagtaagtgatggtgtcatgttgttgtaaatgttaccaataccaccgataccagatggagagttaacaatgatccgtgaagcacgcatttcaagaccgtacttagttgctaaatcatcatcaagggtatgaatagcagcagtgtgaccttcaccaccatagtgtaataattgagcacaaatatcaaaggcattttcatgtgaagtagccttgtacattgttaatactggtgaaagcttttcagctgaaagtgggtacttgtcaccaaccccttcatattcagcgatgataaccttagtgttttcaggaactttaattccacacatattagcgatggcgttagctgaacgaccagcaattggtccacgaacttggtgacgcttaggatcaatgaagccttcagtgaacttatcaatttcatttggcttcaagaagtaacagttccatttttggaattcttcttttaccttgtcgtagatttcttcatcaacaacaactgagttttcagtagcacagatcattccgttatcaaaagtcttagaaagaacgatatcgtaaacagaacgttcaatattagcagtcttttcaatgtaagctggaccgttaccaggaccaacaccaagagcagggttacctgaactgtaggcagccttaactaatgaaggaccaccagttgctaaaatagtagcagtcttagggtgttgtaacaatgcacttgtattttcgcggctactttcaggaagccactgaatcatgttctttggtgcaccggccttttccgcagcttcttgtaaaatcttagctgttttaatggaagatttcatggcttgacggtggaatgagaagataattgtattccgcgtcttagcactaatgattgatttgaagatcgttgttgaagtagggttagtaactggaacgatacctgcaataataccaagcggatcagcaatagtgatggtttggttttcatcgttgtcttcgatgattccgacagtcttatcatgacggatgttgttccaaatgtattcacttgcgtagatgttcttgatagccttatcttcggcaaccccacgaccagtttcttcagctgcatcaatagctaagtccatgtggtgttcttcagcagctaaggccatggcttgacaaattttatcaacttgttcttgtgagtagtaacgtaattgttcaaaagctgcttcacttttggcaattatgtcattaactaatttttgcgcattttgctttttttcttcttcagttaatacgtttttttcaacttgttttttgttgttagcaggcataattgaaatctcctttttcaattcttttctttgttaacatttgaacatgtataatattactacatttttttgctttgtaaatacccttgtgaacatttaaacaatggttgctttgtatgaattcgcttacaatattgtcttcataatacttgtatagcaacaaaaaacattggtattatttttgagattaagagatgatagatttgtatactgttattaattgaagtctgtttcacaaatagaatataaaagcgaatatattaatttaactcggctagttattaagttaactaatcattaacagattattattgggaataataaaaaagccaccattcagaaatggtagcttttttattaatcgcgggcattaatgtcttttcccgcgtttggatctttaacgtcataatcactatcattcattgcttcaacggcacccatgcgatacccattgccgacttggctaaaaaaatcatggttagaagttgaagtagaaattccattcataacaactgggttaacatcagaagcggtatcagggaatagtggatcttgaccaaggttcatcaatgccttattagcgttgtaacggatgaaggttaaaacatcatctgtccaaccaacttgatcataaagaagatgagtgtatttttcttcattatcgtatagttcataaaggaaattgtacatccaatctttcatatcttgttgttgcttttctgttcgatcacgtaagccgacttggaacttgtatccaatatatgtcccgtgaactgattcgtcccgtaaaattagcttgataatttcagccacgttatttaatttattgtggccaaggtaataaaggggagtgtagaaaccagaatagaataagaaagtttcaaggaaaacattggctactttctttttgagcggatcttgacttggatcaaggtacatatttgcaattttgacagctttattttgcaaatattcttctgtatcggaccattcaaagatttctttgatttggtctggggtattaagagtagagaaaatagttgagtaactcttagcatgaactgattccataaattggatattattaagaactgctgtttcatgaggagttttaacatcttctttaagggcagttaatcctgcttctgattgaacagtatcaagaagggttaaaccaccaaaaacatgtccgacagtccattgatgatcgtcatctaattcacgccaatcatccatatcattggcaactgggatccgcgtatcaagccagaactgttctgttagcttttcccatgtagctttatcgatcatgtcggaaacttcattccaattaattgctttatattgatttacaggtttaaattcttccagtttcattgattgagctcctccaaatacgttgcttttaataaatcgagatgccaaaagccatttgtatacataatatcaagtttaccagtgcccaacgtttaaatcaaattctgattaggcttagataacacagctttcacattggtttgcaccaatttcatcgctatcgtcagtaaacgttcgaatgtagtaaattgacttaataccacgtttataggcatagtgccgtaagatgtttaaatcacgagtcgtcattttatctgttcgtccatttttccattcgtaaaggcctgctgggattgttgaccgcataaagagggtcattgaaagagactgatcgatgtgctgttgtgcagcggcgtaagtgtcaataacctttcgcatgtccatatcgtaagctgaacgatagtaaggcatcgtgtcgtttgaaagatatggggcagggtaataaattttaccgatcatcttttcttgacgctcttcaacacgattaatgattggatgtagactagcagtcgaatcgttaatgtaggaagttgaaccgtttggcgctacagcaagacggtattgattgtaaagaccatcttgcattacattttctttcaacttcttccaatcttcaattccagggataaaaataccttcaaaaagacctttaacaacatctgattgtggtccccaatccttagtgacatatttgttaaagtaggaaccatcagcatatttactgttctcaaaatcgtggaaagtttcctgccgctctttggcaatttcatttgatgccactaatgaccaataatttaagagcataaagtaaacacctgtgaattcaatcgcaaccgggcttccgtattgaatatggtgcttagcgaggtagctatgcaatcccattgcacccaaaccaactgaatgggcaagccgatttccgttttgaatagttgggacaacatctaggtcttctacgtcactgattcgggttaatccccgcatcattgccttaatcgatttaccaaagtcagggctttccatcatattagcaatattggttgacccaagattacaactgatatcaattcccatttcagaatatgattgatcatcatttacttgcgctggtacttgtacttgagcaatctctgaacataaattactcatcacaatttttccattaatcggattatcccggttttctgtatcaatattgataatgtaaggataacctgattcttgttgaagtttactgatttcgtcctccaagtcccgggcattaactttcttcttgcgaatatcatcgtttgctactaaattgtcgtattcttttgtgatatcgacgtaggagaatggcattccgtatactcgttcaacatcatagggactaaacaagtacatatcagcattttgctctactaattcgtaaaacttatcaggaaccgtaattccgagagagagggtctttaagcgaatcttttcatcagcgttttccttttttgctcctaagaattcaataatatcaggatggaaaacactaaggtaaacgactccagctccctgtcgctgtcccagttgattggaataggaaaaactatcttctaacaacttcattacaggaacaactccactagcagcaccttgtattttcttgattggggcaccagcttcacgaaggttgcttaaattaatcccaacaccaccaccaattttagaaagttggagggcagaattgattgttcgaccaatggtattcatgtcgtccgttgtttgaatcgcaaagcaagaaacaaattctccccggcgtttacgcccaacgttaaggaatgttggagttgcgggttgataacgttgatggatgatttcatcagcgagctgcattgctaactcttcatcaccattagcgaggtaaagagcattcattgcgactcgatcaatatagttttcaaggtagtactctttatcatttgttcgtaaggcatattgagcataaaacttataagctgccataaaagaatggaagtggaagttttgggcttttaaataatcgtaaagcttttcaatgaatgcttcactatatttattcataaattcctcttcaatataatcattttcttttaaccattgaaaacgttcttttaatgaagaaaagcttttggtattcggttctacattatttttgataaagtcttctaaggccaatttatctttatctagttgaatttgtccgttttttgggatatttacttcgttgttataatcgtaatatttaactttggtcatatcgatatcggataacgccatattaataactcactttctgaattaatttgattatgtcaataaagaagccagtacaccaatagcgaattgatgcctggcaaaatattagtttatttaaacttaggcaagttggtttaattgatcaggacgaaagccagaaaaagcttgaccgttaggaagttttacaactggagtcgccataaaaccttcagacttaagttgagatatgtattctggttgttcatcgatgttgtgttcaataaatgaaattttgtgttgctcaaggaaacgttttgtcatcttgcattggatacaattattttttgaaaatacagttaccatcttcacgaggcctcctaaacgattagtcgatgttttctagtataacgatgaattagaaaaaatcaattaaaaaagcactatatttcgtgcttgaaaaatagtgaaacacaacatatagtgcttgaactagtggttaacacctgtgaaactttttttgatagaatacttaagcaggtgcttaataaaattaatttgaaaaactaatctattattatacactgaacaacaggggaattttaagtgcttggagaaaaagaatgaaaaaaatcaattcatcattatctgaacaacaaaaatttatgaagatggcaattgcagaagcaaaacaagccagaattttagatgaagtaccaattggtgcgattgttgtccacgagggacaggtaattgggcgtggtcataatatgcgtgaaaagtttcaagatgttacctatcacgcagaaatgcttgcgattatggaagcatgcacgaatttaggaagttggcgtttagaggactgtgacttatatgttacgttagaaccgtgtatcatgtgtagcggtgccattatcaacgcacgaataaaaaatgtttattatggtgctgctgatccgaaagccggggcggttgatagcttataccatttactaaatgattcccgtttaaatcatcaagttaatgtccattctggtattttaggggatgagtgtagtcaaatgttaaaaaactttttccgtaaaattcgtcgccgccggaaagaggctcgacgaaaaaataaggctaacccctagtaatttaaagaaaaatagtgtattatactatttgccgtaaggccttagagcaagggtatgcttacgaaccgtgtcaggtctggaaggaagcagcactaagtatgatataccttgtgctctaagttttattgataattaagctgacccgtaatggtttattgcgggtcttttttatttttaaattttaattaaaatgtattttacctactttatgtgattaattccttgtataatattttatagtattttaaattcagaaagggagtctggcgatgagttatcaggcattatatcgtgtctggcgaccacagcgattcgatgatcttgtcggtcaacagattgttacaagaaccctaaaaaacgccattatcactcaccagataagccatgcatacttgttcgctggtccacgtggtactggtaaaacctcagcagcaaaaatttttgctaaagcggttaattgtcatcattccaaggatggcgaaccttgtaatgagtgtgagatttgtaaagcaattacaaacgggcaattaaatgatgtaattgaaatcgatgcggcttctaataatggggttgaagagattcgtgatattcgggataaggcaaaatatgctcctacccaagcggactacaaagtttatataattgatgaagttcacatgctttcaacaggggcttttaacgcactgctaaaaacgcttgaagaaccaccagccaatgtgatttttattcttgcaactacagaaccgcataaaattcctttaacaattatttcgcgggttcaacgatttgattttcgacgaatttcagcagaagatgcatttaatcgaatgaaatatattcttgatcaaaaggaagttacttatgatgaaaaagcattatgggtaattgcaaatgccgctgaaggaggaatgcgggatgcgttgagtatccttgaccaggttctttctttcagtgataatgaggtaaagttggatgatgctttactagttacaggaagtgttactaaacaattattaaaaaagtactttttggagattagtaagcatgaaggggcgactgctcttgacaccatgaaagatattttggatgaaggaaaagatggtcagcggttcattgaggacttgatttcctttattcgtgatattctgttataccaagaatcaccaagcttgattagtgttgaaagtacgggactaaagcaggaagactttgaagaaatagtccaacttgcttcttcagcgaccttataccaaatgatcgatgaactaaataatattcaagaagagatgcgttttacgacccatccggatgtgtatttggaagttcttacaataaaacttgcacaaatcgaaccacaaaagaatattcaatcggcaccagcggtttcttcggatacaaatactgaagctactaagacgattgaaaaattacaacaagagatacagcaattgcaacaaacagtaaaacagttgcagaatgcgccggcaaaggctagtcgaccatcacctcggcaacaaaatgagcaaccacgagtacaacaaaagaaagtgcaggttaatctcaataagatttacccagtgttagaaaatgcgactcgtcaagatttaataaatgttcgtgagctatggggagatatgttgaatctattgtcggtgccgcaacggtccttacttcacgtttcacaaccggttgccgctagtgccgtgggaataattgttgcttttgattatccgttcttattccaacaagcagctgatgatacaacgttgttagagaatatggaaagtgctctgcaacgtttaactggaaatgaacggcaagttgtttttgtacctaaggataaatggccaaaaattcggcaagactttatcaaggatcatggttttggtaagaatcagcaaaagtcgcaacctattaaacaaaagccgcaaactactgaagaaagcggacaaactcctgcagctacaccagcaccgatggaggaaccaccgctaccaccagaagatgagacactaactgaagaaaagtcacctcaagaagataaccaagtagcaacagcacagaagttatttggtagtgatattgttaaagtagaagataattaagaaaaaggatggatgatattatgatgcgtggaatgaatatgcaacaaatgatgaagcaggctaaggcaatgcaaaagaaaatgatggctgaacatgaagaacttgctaaacaggaatttgttggaaaagcaccggatgatatggtaactgctacgtttagcggggataatcaattaattgacttaaagattaagccagaagcagttgatccagatgatattgatatgcttcaagacttggtaattgctgctgtgaaagacggaatgaaacaagtcaatgatgctactcaacaaaagcttggtaaatatacgcaaggtatggggttgtaaaaagtgatccaatatccagaaccattagcaaaattaattgaaagctatactaagttgccaggaattgggcaaaagactgcaactcgcctggcgttctatactttgagtatgcaagaagatgatgtaacgaactttgctaaatctctcctatctgctaaaagagaccttcataactgtagtatttgtggcaatattactgaagatgatccttgtccgatttgtcgcgataagacccgtgatcattcgcaaattctagttgttgagcagttacaagacgttatggcaatggaacggatgcatgaatatcatggtttataccatgtccttcatggagttatttccccagttgcaggaacaggcccggaagatattaatattacaagtttacttaaacggttaaagaaagataatgaagtaaaggaaattattattgcaactaatgcttcatcagatggtgagttaacggctgggtacctcgctaagctaattaagcctgcgggaattaaggttactcggttggcgcatgggttatcagttggcgcagatattgactatgctgatgagatgacattattcaaagcagttcaagggcgaacggagatgtaagaaaatgttttttaagcggcctactaaagaagtggaacgtgaacggaatcagcgcctgttagaagcggtatattctacgaaggccagttgggatcatgcacgtgaaactgaacgagcagtatatgaagcaaacgttaatagtgaacttcattaccgttcccggattcaagaacaaaaatttttatacctatataaaattgctcgtaagtttaaagttcacgggacgttaaatgatggagtaattgatcgctaggagagagaaatggacggtaaatttatatcatttgagggaccagatggagctggcaagacaagtgtaatccaacagattcaacaacaattggaagatcagcttggcacagaaaaagttatgtatactcgtgaaccgggtggtaataagatttctgagcaaattcgccaggtactctttgatggtcaaaataccgatatggatgggcggacagaagcattgctttttgctgctgctcgtcggcaacacattgtttcagaaataattccggggttgaaagcaggcaaagttattctgtgtgatcgatttgtagatagttccatcgcttatcagggagctggtcgtggccttggtgaaaaagagatttggcaaattaatcagtttgcgattgatgggttaatgccgtcgttgacaatttaccttgatattgaatcggaaattggcttaagacggattgctgagcatcgttctaatcaaattaatcgattagacaaggaaaagcttgctttccatcaaaccgttcgtcaatcttacttgaaactttacaaaaattatccagaacggataaagttaattgatgcaagtcagccactggaaaaagtgattgaggatgtaaaagcaacaattcatgaccgtttttcagatttgttttaataaaaaagggtgattaataatgaaaatgattattgcaattgttcaatcaaaagatagcaatcgtttacgaaaagcatttaataaagctgatattcacgttactcaattatcaacaactggtggtttccttcgtgaaggaaatgcgacatttttaattggaattgaagatgaacgagttcaagaagtattatcagtaattaaaaagaatgctgagtcacgtgaacaatacgttacatcgcaaatgcatatggatgttgaaggaggttcagcatttcctgtcaacgtaaagattggtggggcaactgtttttgtcttaccagtagaagacttcattaaattttaagtaggtgaagatggttggctgaacagggacaaacacgtgcagaaaaattacaaccagcaataattactcgttttcaaaaaatattattaaataaagaacttgctcatgcctatctgtttgttgggccaggcggttcaggaaagatgtcaattgctcaatggttatcgttacggttattttgtcttcatccccaagacaataaaccagacttaacttgtgccgagtgtcagcgaatcctgtctgggaaccatcctgatattgtctatgctgctccagaaggtcgccaaataaaggttgatgagattcgtcacttaaaagcagaattttctaagagtgcggtagaaggcaataagaaaatttttattattaaagatgctgataaaatgacaaatggtgcagcaaatagtcttcttaagtttattgaagaaccggggactggcgtttatatttttatgctaacgactaataaaagtgctgtcttaccaacaatccgatcacgaacacaggtgattgaactgccaccattaaaacgagatgcgttgttaacagttttaactgaacataatattccatcatctcagcaacagattgctgttgggattacagattccgtcgcaatgattgaacagtggcaagaagataattggtttgagagtgcgatcaaaggagtcattcagtggtatcaagatacgacacgaaatgggatgttaggcttcgttgatgttcagacaattctacaaaaagtagctaccgaccgggataaacaacaagtgattttggacctaattaccttaatctggcgtgatacgctaatggtaaattccggaattacagttgccaaccgccttcactttaataatattttaggagaaatgggagaagtagttagaaaatactctcctcaacaattgttagcggctagtcagttaactttggaaactcgtcacatgttagaacaaaatattagctttcaaaatattgttgaacaattgacgattcggcttgtgcaggttttaagcattagttaggagcgaaaagatgagtgaagaatatagttcagataatctttatgaacaatttgcgcaggtgatgaaccagacccaggatttagttaataaaatggagcagttgcaggcaaaaattattgctatttctgaggaaaatgttgaactttcaattgaaaataagcatttgcgtcagatgattaaagaaaagcaatcacatcatagtgaaaaccaattatctggatcacggcaaaatttaaaagagctttaccaacagggttttcatgtttgcagtgagtattatggtaaacgtcttgagcctaatgaatcttgtactttttgtttagatgcaatattcggacatgaacaaggaatgacaaaataggagatagtatgcagcaaattagtagttttaatgatcaccaatcaggaagtttatacttagttccaaccccaattggaaatttagatgatatgacttttcgtgcaattaaaaccttaaaagaagtggatctgattgctgctgaagatacgcgtcatactcagcaactattaaaccattttgatatattaacccgtcaaattagctttcatgagcataatgctgaacaacgtgttccggaattgattgagaaattaaaagctggttattcgattgctcaatgcagtgatgcagggatgccttcgatttctgaccccggcaaggaattggtagcggcggcagttagagaagggttgccagtaatcccgcttccaggagctaatgcaggattgacggctcttatcgcttcggggttagttccccagccattttacttctttggctttttagggcgtaagcatcagcaacaggtagcggcgttggagcaattaaaagagcgtgaagaaacgatgatcttttatgaagctccacaccgcttaaaaaagactttagctacgatggcggaagttttcggtaatgaacggcgagttgttttagcacgggaactcactaaacgctatgaagagtttacgcggggaacgcttgctgaaacaactgcctggtttgaagatcatcaaccacgaggagaattcgttattctagtagctgggaatgaacacccgacagaggagacagataatgatattgaattaccattaacagaacaggttgataaggaaatcttaaatggtctttccactaatgctgcgattaagctggtggcaaagaaaaataatataaaacgccaggaattatataaacaatatcatcaattgtaggagaaaaatatggagttaaagcaagaagcacaaacatttgaaatgccgcacttactaacatattatgagtgtgatgaaacaagtcatccaagcctaagcatgatattaagtatgatttccatggtatccgatgagcatagtatgtctttaggaatgggaaccgaagaaatacaatctactggcggtacatgggtagtaagcggctatgaaggatatctttccgcaaatcaaccttcttttggcgaaacagttattttaggaaccaaagctgtttcctataaccgcttttttgctgttcgtgatttttggataacggataaagaacaccagattgaatatgcacgaattaggtcaatttttgtgtttatgaatctaaagacacggcgaatgcaatcaattccactaggtttaattgaaccatttaatgctcctgttgcgaaaagaattcctcgtctaaagcgacctcaaaaattggatgaaaatggttcgataataaagaaaaattatcaagttcgttattttgaccttgatgctaatcaccatgttaataatgcgcgttactttgattggcttcttgatcctcttggccgtgattttttacgagagaatcagataaaaagatttaatttgcagtatcttcaagaggtacgcaatggggaaattgtggaaagcaaagttaataagctccaaataaatgatggaacggtaacttaccaccagattggcgttgataagcaagttgatgcaattgctgagatagaatggtattaaaaattaatcaatgaataatagcgactggtttctaggcaggaaattagttgctattttattttagtcctaaatattagacgaaaagatcttaaatggtttaatgtagagacatttaaaggaagatggtattctatgaatagtagtaattatgaggagtgagttgacgtgaaaagatctttaacggcgattatttacctcgaacccgatcaggttaatttacggatcattgagatacctactttaaaagtgataaataatgttcgatcgggccttctaaatatcggaaacgctaaagttgctaattattcggaaaatatgactgcaattgttaataatattgaaggatttaagcagattattaatgactaccaggcaacaccagttaaattttatggcgatttagaagaccttgacccagttgcaactaggtatgtggccgaccagttagaagttcggacaggattacagattgaatggttaaacaataaccagctaatggcacagtcgatgagttaccttttaaccttgctaccagattttgaaaaacttagtaaacacaatatgtatcttctaagtatcggtcttagctcgactaccttagcttattttcaccatggaagctttgaacgggcatgggatattgatcttggtaatgcaaaaatcagtcagttggtggggcgtctccgaaaaactgctaccaatccaactgaaattatccaagattatatcagtagtaaattagaatacttaacaccagaactgacaaagaaaaagcatacagtaatgatggtgcaaaatgccctctcactcaataaattatttttgccaaatgatcagcaaatcgcggaagttcccctaaataaatttcatgatgattaccaaaagattttatcgccagtaaaagatggcttaatgaaaaatattcagattgatgaccaacaatttgaattattattaccaaattatttagtaacggcgcgaacagtgcgcttaattcaaccagcaggcctttacgtaactgatatttcaacgatggatgggatttcccatggaattggggttgataatcctaaaacgagacggcaaattaatgaaatgatcagaacagctgccgacaatatttcttcacgatacggtgttgattcagctcatcgggattttgtaacgcgcttttcactccaactctttgatcaattgcgcccaattcatcgtcttggtcagcatgagcgattattattagaaattgctagtagaattgatgacattggtaattttattaatcaacggggacactaccgccactctgcttatattatggaggctaatcctctaattgggctttcagataaagataatcggattattgctgaagtggcgagatatcatagtgcagagtctccagatattagtcaagctcattaccgccatctcgatgatgagatccagatgccagtagcaaaattagctgctattttacgattggtggatgcattagatgattcgcggctgcaaaaaatttcaagtattagattgaagctggtaggagatagccgcttaatcattaaagcaatagccaatgatgaccttgttcttgaaaagtggtcttttagtaaaaaatcacaactatttaaggatgtatacggaattgaaccggtcttaactgagaggagcgatcattaagatgtataaggagttttataagccgcagaattatgttaatcgagaattgagttggattgactttaatggccgagtactgggagaggcaactgatactgctaatcctttgttagaacgtgctaacttcttgggaattactcaaagcaatgttgatgaattttttatggtgcgggttgcatcgcttcataagcttgctgctgccaatgttactactactgatgcgtctggtctgactccagaagagcagttggatgcagtaaatgaaaaagaacaccggatggttaagcaacggtatgaagtttataatcagcaaatcatcccgaaccttgctaaaaataatattcatattctccatgtccccaaacttgacgagaagcaatatgaatttattcgtcggtactttaatgatgagctgatgccagttttgactcccatggcagatgatgcctcacgtccttttccttttatctccaataattctttaaatattgctgttcagctacggcgtcaaatccgttcaacaagtgaaccagttgcagaggaaattctagagggagatcaagaagttcatcgtccacaaatggaaccacatgatgatcgtcaagaagcagatatcaaatttgcaacagtccgtgttccagaaatttataagcggttagttcggttaccagaagaaaatagcttcattttgattgatgaaatcattactgaatttctgagcgcgctttttccaggatacgagatcttagctacagcgtcatatcgagttatgcgggatatggacttagatgtggctgaagaagatacgtctgatttgctccgggcagtcaaacggcaattgcgggaacgagagcatggacaggtgatgcgcctagaagttcctgcttctatcgatgaatggttaaaagatcaattaattgataatctgcatgtaagtgaacggtcactgtatgaagtagatggtcccgtcgatttaactttcttaaaaaaattatcggggatggttgatggtcatgatgacttgcgctatccaccatataagccatacctcaacccagcgttagatatggatcataatattttttcttcaattcgccaaaaggattacctaatgcagcatccttatgataattttcaagccgtggtcaactttattcatcaagcagccattgatccagatgttttggcaatcaagatgactctttatcgggtctctggtaattcaccgattattaagtatctcggaatggccgcgcaacagggtaagcaagtaacggttttagttgaagttaaagcgcggtttgatgaacaaaataacgttcggtgggcacaacggcttgaacagatggggtgccacgttatttacggtttagttggccttaaaacgcactgtaaagttgctttggttatccgtcgcgatgaagatgggctgcggcgttatatgcacctaggaactgggaactataatgatgtaacagctcatttttacactgatatgggattatttacttgtgaccatgagctgggcatcgatatgacaaacctgtttaatatgctgtcaggatttgcacgaccagcttatttcaatgaattacgggtatctcctgatgggattcggacatttattaatgccaaaattgatgagcaaattgaaaatgccaaaaatggtaatcctacgttaattcggatgaagatgaattccttgtctgacaagcaaatcattgcccgcctatacgctgctgctgctagtggagttaaggttgagttattaattcgaggcattacctgtttaaggaacgatttgccagaattgcatgggaatattgaggttcattcgattattgggcgtttccttgaacactcccggatctactactttaagagtaatggtcatgaggaagtctacctcgcaagtgccgatatgatgacgagaaatcttaatcgacgagttgaagaattgtatcccgttacccagccagacacaaaagctcatgcaattcatatttttgacgttatgtggaaagataatgtcaaggctcgacggttagtaggagatcattacgaacggattgatcgtggtgatgtcgcaccattcagttcacaagaatactttgttaaacaagcaatgaaattgaatgcgcgtgagaaaaaggagaagaaagcaaaaaaacatttttcttctgtttttgaaactttaactcgccatgttcccaatcttcatttagatgagcgaaaggatgagtaatttatgagcaatgagcagtaccttgcaattcttgatttaggttcaaattcagttcggcttaaaataacaaaaattcaagataacgggagctttgaaacggttcaatatgaaaaaagatatgttcgcctcgcttctaatatggggccagaaaaaatgttgaagtcagctcctgtaaagcggactattgatgccctaaaagaatttcgaacaatttgtgatcgataccgtaataagaaattgacaattattgcggtggcgactgctgcggttcgtcaagcacaaaatcaactgcaatttcttgaaaaggtcaagcaagaaacgggctttgaaattcatgtaattagtggagaacgagaagcatatcttgactatgttggtgttaatcagactcttccaattgataagggaataattgttgatactggaggagcaagtatggaattaatctcggtgaataatggggaagcagaagaagcgattagtattccgatcggttcagttagcatttcgcaaacctaccatcttgaagatcaaattaatccagctgatttatttgatgccatgattaaaattgatgaagttctttctcaacaattatggctaaatcggatgcgggagacaaaaattgtggcactcgggggatgtaaccgtgcattagcaaaggtatatcggtggcaacaagctcttaatcctaatgaagccagaccagttcatgggctaacaatgcgttcagaagaagcctttttgattatgcggcagctattagaaacggatcgccagacgcgggcaggaatccgtggaattacgaaagtgcgagcggatgtaattgttggaggacttctcccccttatctctcttgtccggcaattgtcaattaatgagatttgctttagtaatagtggattaagagaaggtttattatttaagtaccttgagcagcaaattaattttgatcaattaaaatcctcgctataaaattatccactaaaatttttgcttatttttactaaattttactaattagaaacagtaaaattgtgctacaatcactatgaaagctttagttggagcaaggaggaaacaagatgtcaattttagttgctggtggtgccggatatatcggttcccatatggtaaaagatcttattgaaaatggtgaagatgtagtagtggctgataacttatcgacgggtcaccgggatgcgattaatcccaaggctaagttttatgagggtgacattcgtgatcgtcaattcttagataagatttttgacaatgaagatattactgcagttgttcactttgctgctttctcaattgtacctgaatcaatgagtaagccattgaagtactttgataacaatactggcggaatgattactttgcttgaagcaatgcatgatcatgatattaagtatattgtcttcagttcaaccgctgctacttatggggttccagaacacatgccaattaaggaaacggacccacaaaacccaattaacccatatggcttgagtaagttaatgatggaagaaatgatggcttgggctgataaagcttacggtattaagtttgttgcccttcgttactttaatgttgccggggctgccactgatggtacgatcggtgaagatcacggtccagaaacgcacttagttccaatcattcttcaagttgcgcaaggcaagcgtgatgaattgagtatctttggggatgactacaacacaccagatggtaccaatgttcgtgactatgtccatgttatggatttagcagatgctcatattcttgctattaagtaccttaaggaaggtaacaagagtaatgcctttaaccttggttcatccactggcttctctaacaagcaaatgctagaagcagctcgagaagttactggtaaacctattccagctaaaatggcaccacgccgtccaggagatccagattcattagttgctgctagtgataaggctcgtaatgttcttggatggagtcctaagtatgatgatgttcacgacattattgcaactgcttggaagtggcattcaactcatccaaagggttatgatgatcgcgactaataatcggctttaaaataacaaacaggctctcagtaaaacttttgctggggcctgttttgtcgtaaataaacaaaagaaattaaaagagaagtcaaagcggatccagtgtgataagatgtaagatgattgaaaggattgataaaagatgaagattctagccgtcgatacatccaaccacccaatgagcgtagcgttggttgaagatgagcaattgttggcaacgacaacccttaatatggttcgcaatcatagtatttatttaatgccggcaattagtaagttatttaagttagttcagtggcagccaacagatattgatcgggtagtggttgcacagggaccaggatcttatacaggagtacgaattgcagttacaaccgctaaagtattggctgatacagaaaagattgacttaattggcgtatcaagtttagcagtattagcacgtaatgtagttccaacatcatcagcaattattgttcctttctttgatgcacgacgaggaaatgtatttgctggtgcttaccagtgggaaaatggcgagttagtaaataaaatagaagatcaacatctagggattgatgttttgcttaatcaacttgcaaaattagatcaacaagttgttttggtaggtcatatgactgataaaattcaagccaaatatgatcaattaccagctaatgtgacccttttgccacgatcttatagtattccgtcaacttatcaattagctcttgcaggtaaaatgaaggaaccagttaaagagattgacccttttgttccgcattatttacgaattactgaagcagaggctaattggcaaaaacttcatcctggagaaaaaagaaaaaattatgttcgagaagtttaaagaatggtttatcaatacgaccaatcctactaaacgaccgatccttgaatttacacgacgaatagtaatgatatctggtcatcaatacatggtccggatggcaaaggaacaagatattcaaaccttggtagaaattgaagaaagaatctatggaaaagcaccatggagttatgctgctttccgcattgaactccaacggccgtgtgatcgactatatttagttgttgaggatgaccagcagattgttggctttatgggaacagccattgattggtaccattatgatttgcatattacgaatattggcattacaccaagttaccaaaataaaggaattggaacgtatcttatttcaactgccaaaaactatgcccggcacttaaaattacattcgctgagtttagaagtacgagtgtataacgtatcagctcgtcgcttatatgaaagtttaggctttcgtaatcagcatattaaaccacgttattacttagataatcacgaagatgccgtggatatgcaagcaaacttacttaggtagaggtgaaagtattttattatgacagaacgcacattaaccttagcgtttgaatcaagctgtgatgaaacaagtgttgccgtaattgaaaatggaactaaaatcctttccaatattgttgcaacgcaaatcgatagccatcaacgttttggtggagtagtaccagaagtagctagtcgacatcatattgaacaaattaccaagtgtacaaatgaagctttagagcaagcggctgtaggctatgatgacctagatgctgttgcagtaacatacggtccaggattagtcgggtcattattaattggtgtgacagcagcaaaggccatcgcatgggctcataaccttccgttaattccggttaaccacatggcaggtcatatctatgctgcacgctatgttggggaattcaaatatccacaaatggcattgttagtttccggtggacatacggaattagtttatatgccatctgaacatgaataccaaattatcggtgaaacacgtgatgatgctgccggtgaagcttatgataaaattggtcgcgtgttgggagtcaattacccggcaggaaaaacgattgatgaatgggcggctaagggtaaggacacttttaatttcccacgagcaatggaaaaagaagataattatgactttagctttagtgggctgaagagcgccttcatcaatacagttcataatgcagaccaacgtggagaaaaattagataaatatgatcttgcagccagtttccaacaaagtgtcattgacgtgcttgccgaaaaaacaatgcgggcgttagatgattacccagtaaagcaactgattttagctggtggggtcgctgcaaatcatggtctccgtgctcgtttagatcatgacatgaagaaatctcatcctgatgtaccgatgctgcaagcaccgttgaaattatgtggtgataatgctgcaatgattggggctgctggttatgttaactacaagcatggcgaccgtgcaggattagatttgaatgcagtaccgggattaatgttcgatcgaattcagaataaataattataaacataactctcataagcaatgatggcctccagtgttcggtaaaaccggacgctggaggccattattgtactgcgctgtatggatgtaaccgcggtctttttttgcgtttatgattcaccatttgctttgtcaacggcatccatcatggcgtaacggaaaccatttttctccaatgcttccacgcctttgattgttgtacctgctggtgatgttacttgatcacgtaataatgctggagcaagcttgctatcataggctagtgtccccgtaccttttaccatactagcaataacttcatatgcagtttgacgatcgaggccatgcttgacggcggcatcgctcattgcgtccatcatcacatcaacaaatgcagggccacagccgccgataacaccaattatatctagttgtcgttctggaactttgatgacatcaccaagactatctaaaacagtcattacttttgaaattgcttcagcagaaattccggttggcaaggcaagaccaattgtgccggcattaacttcaactggtgtgttgggaataatattaacaatttctttattcggaagcactttggctaagtcttcgtgagtaattccagcagcggcagagataaaaatagtgtgatcgttaaggacggctaattctttagcgactacggttgtaataggggccggggtagtcaaaattacgatatcgggtgtaaggttaactacttcactgtttgtattaacgagtttaaacccgagcttcttagcaaggcttgtaacacgtgaattaacagggttcatcgcactgagggtaaaattttgcgtacgacttaatcccttcataattgcgcttcccatatttccgacaccaataattgtaattttcatctaaaaaacctcctaaattatttccgaacttgcccattaccggtaatttcatatttgattgttgttaattgttgtaatcccattggtccccgggcgtggagtttttgggtactgataccaatttcagcgccaaagccaaattctcccccatcagtaaaccgcgtagaggcattaacataaacacaggcagaattaatggcttgttggaagtagcgtccccgggtaatgttgtttgtaataattgattctgaatggtgagtactatggtgattaatatggttaattgcatcatcaagggaatcaacaatttttacggccataattaaatcattatattctgtctcccaatcttcctcagtaacgggacggatagttgatactaattggcacgccatttcatcaccgcgtaattggacgccatgttccattaaagctttggcaataacaggaagaaattcagcggcaatatcgcggtggataagtaatttttcagcggcattgcatacagaaggccgttgtacttttgcatttacagtaatattggtcgccattgttaggtcagcatccttatcaatataaatgtggcaattacccgcaccagtttcgataactggaaccgtagctgttgttacaacccgctgaataagggcctggccgcctcgtggaatcaagacatcaatgtagtcagtgagattcatcatttcatcagcaatcgcatgactagtgtcggtaataagctgaaccgcatcgaccggtaaatgttgactttgtaatgattcacgaagaatttttactaaggcagtattagtctggatagcttcttttccgccccgtagaataactgcattgccactcttgaatgtgaggccggtcgcgtctacagctacgtttggtcgtgcttcaaagataatgccaattacccctaatggtacgcgccgttgaaggatttgcaacccatctttggtaatccatcccttatcgatttgggaagtgggatcgttcaagtcggcgattgttcggagaccattagccatgtctgcgatacgttgggaattgaccattaaacgatctgtaaatttagttggcatctgggtagcggcgaccaagtcttgttggttggcagcgataatttggtttttatttttgattaaatcatctgccaattgaagcaatgccttatttttggtggcagtgttcattaaagctagtttgtttgcagcgatttgggctctttttccaattgtaattaaatcttggttcattatcatcactcctattttccaaaatgagtaccaatagtatgaccatcaaaaatatcaaaaagaattttagggtcacgaccattgcataaaatcatttgtttacctgcttgcatcattgtggcagctgcccgtaatttagttaccattcctcctgttccaaacctagtgctgctaccgcttgcgacgttctctatttccgtcgttaggaatggaacttctttaatgatttgtgcgtcaggaaatttatgcggatctttgtcataaagggcatcgatatccgaaagaatgattaactcgtcagcgtcaatggcaatagctacctgggaagagagttcatcattgtcactgaaagtagtgtaatgatcaagctcatcaactgacacggggtcattttcgttaacgattggaatcacattttgctgaagtaaagcattaattgtattaagcgtatgctggcgactgacgggataagtgagcacatcacgggtaaggagaagttgggcgacgtgcgtttgatagtctaaaaatcgttgcgaatagattcgcattaaagcagcctgaccgatagatgctaaggcttgctgttgtgctatttcggcgggacgatctgttaatcccaaacttgcaagaccaacgccaattgctcccgaggaaacaagaataagttggtatccttgattgtttaatgtcgcaaggacaaatgaaagttggtcgattgttcgtaaattaatttttccattaggaagaacaaggctactcgtaccaatcttaacaactactttttgtattttatgagtcatagaaaatcctttcagaaaacaaaaagcgcccttaaccgagacaccaattatggcggtaccattctcgtttaaagacgcactttacacttttaaattattttattattagaatatattaaagttgtagcagggcttcggtactggcgatagcttgcagtcgatggctatcgttcctggactgacctacttttatctacaattaaaattttaattggaagactaagcttttgtcaagactaattatttttgagattcaattaaaaatgaattgacaaataattaaaaataaattagaatacgagcaacaattaaatattagtcgtttaagaagagtaaaagcaatgtagtattaagagagttttcgggtggtggaagaaaattacaaattgctttgaagatggtcttaaaaaatacaacaagtgtgaggaaaaaactaagcacttgtcggctgatatccgttatcaagtatcgaagtttattatgaacttcctgaggctattcatgtgagtggatagtaaattaaggtggcaccacgaaaatactcgtccttatttaagttaaggacgggtattttttatggaggtgaaagtgatgaaacgcaaaattgcattagctcaacttgatattcaattaggaaatcctgccgaaaattatcaaaaagctaaacaagcgattgaagaagctgctagtcaccatgcagatatcgttgtcttgccggagatgtggaatgctggctatgccttagatcaattagcagaattggcagatgaaaacggtcaaaagacacaaaaatttcttagtgagttagcgttagaaaatcaaattaacattgtcggtggttcagtagcggtgagatgtggacaatcttttttcaatacaacctatgtttatgatcaaaagggaaatctaattagcagttacgagaaggtgcatttatttggactaatgaatgaagaccgatatctaaaagccgggcaaaaagaaaatcactttgaattagctggggttccgagtgcaagttttatttgttatgatttgcgattccctgaatggattagaacagtcactcgttatggaactgatatcttatatttttcggcagaatggccaagcaaacggattaaacaatggaaaataatgcttcagtcacgggcaattgaaaatcaagcctttgtagtcgcggtcaatcgtgttgggacggatttagagaatagctttaatggtcattcgttagtaatagatccgcttgggcagattatccatgatgcaggagaagttgaacaagtaagttatgcagaaattgacttagcgcagttagcacaggttcgggggccgattccggtgtttaaggatcgccgaccaagtctttatcattaaggggatggaaaagatgaattttgcacaatcaaaattattagacactttaccgaaacaattttttgccaatttagttgccaaggttaataaaaaaataagtgaaggggtcgatgttattaatcttggtcaagggaatcccgataagccaacgccagattatattgttaagagcacgcaaaaatgggtagcggatccgcaaactcataagtattcactatttcggggattgccagcatttaaagaagcagcggcaaaattttattctgaaaaatatggagctgactttgacccagaaaaagaagttgcaattttgggtggttccaagattgggcttgtagaattgccatgggcattgatgaatcccggcgacacttttctgcttcctgatcctggctatccagattacttatcaggagcagcattaggagaagttaattttgaaacagtaccattattagcagaaaataatttcttgccagacttagaggcaattcctgaagaggtggcgcaacgtgctaaattcttctatcttaactatcctaataatccaacgggtgctgtagctactcccgagttttatcgaaaattagttgcgtgggccaaaaagtaccatgtgggcattattagtgactttgcctatggcgcaattggctttgacggtcaagctccagttagctttatggaaacaccaggcgctaaagatgtggggattgaattttataccttttctaagacgttcaacatggcagggtggcgaatcgcatttgcggttggtaatgcagatattattgaagccttaaacttaattcaagatcacctattcgttagtctttttcctgccttacaggaagctgctattgatgctttaacgctgccacaacgtgatgatgcaattgccgaaattgtaggtcgttatgaagaaagacggaatgcttttattaatgcggccgaaaaaattggctggcatgcatttactccccagggtactttctatgcttggatgccggttccaaaggattataccagtgaaagctttgcagatttgttattggacaaagctggcgtggcagtagcaccaggcaatggctttggcaagcacggtgaaggttatgtgcggattggccttttgattgagccagcacgactgacggaggccgttgagcggattgctaaattgaatttatttagttaaggaggaaaaattatggctttgaaatatacggttttaggtgcaggggcaatgggactacgatttggggtattgcttcaagaattagcaggtgcgaaggttgattttgttgataactgggcttcccaagttgaaactattaaacaacagggtggggtttacgtttctcgagaccatgagaatcgacatcttgtaccaattaatatttactcaccagaagaatatgatggtgatccagatgtgtttatcgtttttgccaaacagatgacgcttagtgatttgttacaacgcagtgctcatttcttccgtcctgaccatcaatatgtcttttccgggatgaatggcatgggacatattgaaaaaattaaccaatattttcctaaagaacatgtcgtggccggaacttgtttaattggcacggtccttaataaggcggggaatgtggattttattggtaaacctggtgctggttcgatcaacttagctccccaagtcggcgaaccagatgagcgggtaaaacaaattgttgaggactttaccacggcgaatattaatccccaccttaatgataatttttatggtaccctcctaacaaaagtagtttttaattctgttattaacacgatctgcacgctttttgagattcaaatggggcaatttatcgattacgatggtgcagaaaagcttggcaaacagttaattaatgaagcattcgatgttgccgaacgggctggtattcagctcttaagcactcgtgaggaggagtggcaaacgattaaatatgttagtgaagttaccagcccgcttcattatccatcaatgtaccaagatatgagtaaaaatcgaccaacagaagtagattacattaatggatatatttatgatttaggtaagaagtataactatgaggcatctactcacgacttcttgcgtaatttagttcaccttgcagaaaatactcgtaaattccgacaaaactaaaagaagaagcggacctgtccgcttcttcttttagttttcttgatcaaattcttccagtttttctgctgcttctgtccatgcaagttcaaattcttcagatttagctgataattcatcaagttctttttgaagatcggttaattttccaatatccgtagcgatctctggttgactcatttgttcttggattgcggtttgtttttcttctaattccgccatctgttgttctagctcatcgacttgtcgctgaatttttcggcgagcgcgctgctgttctttgctttgctgataagattgtttaccagctggtgctttagtaatggtggtggaattatgtgaagcagcttcagatgaactttctttttccttagcaattaggtagtcatcataattgccttcgtaatgtttaattccgtcgtgttccattgctaagatatcggttgcaacctgattaataaagtaacggtcgtgagaaataaagagaacggttccgctaaattcgttaattgcgttttcaagcacttctcgactatcgatatctaagtggttagtcggttcatcaaggataagaaaattaatcggtttaaatgagagcttagttaactccaatcgtgctttttcaccaccagataggtcatgaacaactttataaacatcatcaccaacgaataagaaactacctaataatgagcgaatatctttttcaggtacttctggatggtcatcccatacttcttctaaaactgttttatttggatgtaattgttgctgttcctggtcatagtaaccgatatcgaggttagcaccgagtttgattgttccactaattaacggaattttatggagaatagatttaagtaaagttgattttccgattccatttggtccgataatcccaacacgctgcggcttgcggacattaaatgaaagcggcccagcaaggatctgttcatcgtagccaacttttgcctgctccacatcaagaacttcatttccgctatctttttcagaatggaattgaaaatggattgatttatcatcagtttctggacgctcaagccgctccattttttctaattgctttcgccgcgcctgagcacgtttagttgttgaggcacgaacaatatttcggttaacaaagtcttctaacttagcaatctttttttgttgttggtcatagtgtttccactctgcttctaatcgttcttgcttgtgtttaacaaattgcgtgtagttaccagtatagtgggtgagtgttttattatcgagatcataaacatcgttgacaacacgatctaagaagtaacggtcgtgagagacgataagcaatgcaccttgataacttttaagataatcttctaaccatgaaagaacgttcatgtcgaggtggttagtcggttcatctagaatcaaaagccccggtgcttgcagaaggatctttgctaaggcgagtttagttttttgccctcctgaaagggaattaattggcgtatcataactatcttcgccaaaaccaaatccatgtagaattccccgcatacgtgattcgtattcgaaaccaccctgtttcttaaaggcagcttgtaaattatcgtatgttgaaagaatttgttgataattgctatcggaactatcaaggtcagcgaactgttgttcaagatcgtggatttgcgtttccattttgtggagaggagcaaagacagtatctagttcagtccaaatgctattttgactatcgagtccttgatcctgggccaagtaaccaattgtcaaatctttaaccttcgtaattgttccttcatctggttcggtgattccagcgatcatttttaacaaggtcgttttaccagcaccattacgcccaacaagcgcagtacggccatgctcttggatttgcatgttcatattgtgaaataaaacgtccgcgccaaatcgacgcacaacgtcatttgtctgtaaaagtaacatattgaaacctcatttaattcgttgatttaatatggttttattttagcagatttttaattttaaataaaaatttgaaaatatttttgtattttagttcacaaaaaagggtttaattgctagaatatactcagacttaaatttcacaaagtaaaaattagtaacattatccttgtcaaaaacttagtaattagttggcaaactaggttgagaagggcttgttttaggaggaacaaaagtagaatggctaataaaaagattccacgcgcgactgcgaaacggttaccaatatatttccgttatttaaatgtattgaaagacgcaaataagcaacgggtatcatcaactgaactttcggaggctgtgcaagttgattcggcaacgattcgtcgtgacttttcatattttggtgaattaggtaagcggggatacggttatgacgttgaaagtctattaaagttttttaaaggaatcttacaccaagactcattagttagtgttgccttagttggagttggtagtttgggaagtgccttgttaaactttaatttccaccaagataccaatttacggatcagtgcggcatttgatactaagccagaatatgccaatacagtcaaaagcggtattccaatttacccatccgaggatatggtaaagcagttaaaagagcaacagattgatgttgttattctaaccgttccaggaatcaaggcccaacatgttgcggaccaattagttgaagctggtgtgaagggaattcttaactttactcctgttcgtttatctgtgccaaaaaatgttcaagttcaaaacattgacttaacaaacgaacttcaaacattaatttacttcattaaaaattatactgaagattcaattgaataaattaggagagcattggtttgatgaaagcgtccaaccaatgctttttgtttactaaattattaataaaagtcatggattgtaggtatgatctcttaagttttaaaaaatggtcaaaaaaagtcaaagtatttttgttgcattttaaagagaacatgttatatttaaacatgtggttagcacttgaagagtttgagtgctaaaaataaaatttattaacaagatggagggattaacgtgttaaaaccattaggagatcgcgttgttctaaaagctgaaactgaagaagaaaagacagttggtggaattgtccttgcttccaatgtgaaggaaaagccaactactggaaaggttattgccgttggagaaggtcgtactttagaaaacggacaaaagcttgctccagctgttaaggaaggcgaccgcgtattatttgataagtacgcaggcaacgaagtagaatacaacggtgaaaagttcttagttgttcatgctaaagacttagtagcaatcgttgaatagttaaataagcgaattaagagcaggagacagaaagaatgaaattccttcaccgtctcttttaaataatgaatttaattttgaggtgacataaatggcaaaagaaattaagttttctgaagatgcacggagcgctatgctcagtggtgttgataaattagctgatactgttaagacaacaatgggtccaaagggacggaatgttgttttggaacaaagctacggcacaccaactattactaatgatggtgtaactattgctaagagtattgaacttgaaaaccaatttgaaaatatgggtgcaaagttagtagccgaggttgcttcaaagactaacgatattgccggtgatggtactacaactgctactgttttaacccaagcaattgttaatgctggtatgaagaacgttacctctggtgcaaacccagttggtattcgtcgtggtattgacaaggctaccgaagttgctgttgaagctttgaagaagatgtcacacgatgtaaagaccaaggatgatatcgaacaaattgcttctatttcagctgctaatccagaagttggtaagctaattgctgatgcaatggaaaaggttggccatgatggtgtaattactatcgaagattctcgtggtgttgacactagcgttgatgttgttgaaggaatgagctttgaccgtggttacatgtcacaatacatggtaactgataacgacaagatggaagcggaccttgacaatccatatattttgattactgacaagaagattagtaatatccaagacattttgccattgcttcaatcagttgttcaagaaggccgtgctctcttgatcattgctgatgatattactggtgaagcattaccaactcttgtattgaacaagattcgtggtacctttaatgttgttgctgttaaggctcctggctttggtgaccgtcgtaaggctcaacttcaagatattgctgttttgactggcggtactgttatttctgacgaccttgggatgagtcttaaggacgctactgttgatcaattaggtcaagcaaacaaggttacagttacaaaggatactactactatcgttgatggtgctggttcaaaggaagctatccaagaacgtgttgaccaaattaagcaagaaattgctaagtcaacttccgactttgacaaggaaaagcttcaagaacgtcttgcaaagctttcgggtggggttgccgttgttaaggttggtgccgcaactgaaactgaattgaaggaaaagaagtaccggattgaagatgccttgaacgctactcgtgctgctgttcaagaaggatttgttcctggtggtggaactgctttaattaacgtaattcctgctcttgacaagattgaagccgatggtgatgaattaactggtatcaatattgttaaggctgcccttgaagcaccagttcgtcaaattgctgaaaacgctggtgttgaaggctctgttattgttaatgaattaaagaacgaaaaagaaggtattggttacaacgctgcagatggcaagtttgaagatatgatcaaggctggtattgttgacccaacaatggttacccgttctgctcttcaaaacgctgcttccgtatcagcattgcttcttactactgaagcggttgttgctgataagccagatccaaatgctaataaccaagctcctgctgctccacaaggcggcatgggcggtatgatgtaataccatttgactaaaatttaattttgtgggcagaaaagattctaatgtttgttttttcaaatgttgggatctttttttattggaggaaaatcaatgacgaaaaatgcaaccagtgtctataactatttagacaacgaaaaaataaactatcaaattgttactcatcccccagtctatacagcggaacaagcagacaagtatgttcaagaatatcaatttgcccgtacgaaaaccctttttctaaaaaataaagctggctattatttagttacaatcttagaaaataagcgtctcaatatgaaaaaattgaaagagaatctatcgactagtcggttttcatttgcccacccagaagaattagctatgaagttaggaataacaagtggggctgtttcaccctttaacttgtttaatgataaacaacatcaggttacctttattattgatgctgatatctttaagaacgaggagttaatagggtgtcacccaaatattaatacggccacagtgattttgagaacaaaagatttgcttcaaataataaagttgaatggtaattcagttaaggcggttcaactataaagttaatctaaaaatcttaaattgtggtaaagtaaattagtattaatttttaaccaaactataactgaaaggaactaagaaatggaaaaaatgaaattccagaagataacgctattttctggtgtaatgcttgccttaaattccttaattggttcagggtggttgtttggtgccggaactgctgcaaaggttgccggaccagctgctattttgtcatggatcttaggagcaataatcattattagcattgcccttacttatgttgaattaggggcaatgtttccagaaagcgggggaatgagtcgttatgctcagtatagccacggtccgtttttaggctttattgctgcatgggcaaattggatttcattaatcactttagtcccaatggaagcagtggcctcggttcaatatatgagctcgtggccgtgggcatgggcaaattggactcaccactttatgaaaaacggtaatattacgactcctggattgttagttgtatttggctttatgctggtttttactttgatcaatttctggtcggtaaaattgatgactcgctttactaacttaatatcaatttttaagattttattaccgacactaacaattgtgatgcttattgcggcgggttttcatcctagtaattttggtcatagcgtaactacttttataccatatggtagccggtcaatctttgaagcagctgctatttctggaattattatgtcttatgatgcctttcaaacggtaatcaacatgggaggagaaatgattaatcctcataaaaatatcgtgcgaggcgtattgatttcaatgattattaccgctgtgatctatgtcatgttacaagttgcctttattggagcgattgatccgaatttattagcgcaaaaaggatggcatgggattaactatacgtctccatttgctgatattgcgatcctgctggggatgaattggcttgcaattttgctatatatggatgcttttgtttcaccatttgggacaggggttgcgttcgtggcgactgcctcacgagcattggcagcaatgactcatactggacatttgcctcaatggttgggacggctagaacggcgctacatgattccgcggcttgcaatggttgtggatctaattttagcggtggtaatggttagtctcttcagaaattggagtttgttagccactgtaattaccggttcaaccttaattgcttatcttaccgggccagttactgtaatgtcgcttcgcaaaatggatgctaatttaaagcggccgtttcatccgcattttatgtcctggttggcgccatttgcatttgtcttgacgagcctttcaatttattggacaatgtggccgacgactgttcaggtaattggggttatcttattaggcttaccaatttatctttattatgaagttaagtatcgtcacgcatcagggctacgtgacttacgcaatagttattggatgttggtttatcttgtttttatctcaatagtttcttacattgggagtgaaggatttggcggcaaggactggttgaagtacccatgggattttgttgttattatcatctgctcgctaggattttaccggtgggctgtggctagccggatgaaaaaagtcgatcctgcggcagaaaaggttaatgccaaggtaaagatgccaggaaaagatcaatagatatatttgtaggttgcaaaattaaagaataaattgtaatattgtcacctacttaaaaagtgtaaaaatcaaaggagaaatagtatgtggcgctatttgaaacgtgttttaatcgggaaaccgttaaaaacccttgatgaagggcaaacacacttaactaaatttaaagcattagccatgctttcttctgacgcaatatcgtcagtagcatatggaccagagcaaattacaactgttctggtaactttatccgcagcagcaatctggtattcaatcccgattgcggcagttgtgttggtccttttgttagctatcacgttatcataccaacaaatcattcatgcctatcctagtggtggtggtgcttatgtcgttgccacacggaattgggggagtaatgggggattatttgctggaggatcattactagttgactatatgttaacggtggctgtttcaacgacatctggagttgaagcgattacttcggcagttcctgctttatataaattttcaattccaatcggaatcgttattgtccttttaatcatgtttatgaatttacggggaatgagtgaaagtgcaaacttccttacaattccggtatatttctttgttattatgatgattgtgatggtagtgtggggtggctataatattgccactggtcatattcattaccgggcaattgttgattatggaacaccggtatcgggaatgtcatttgttttgcttattcggtcattctcagctggttcgtcatccttaactggggtggaagccgtaagtaatgctgttcctaactttaataagcctaaagaaaagaatgcatcaactaccctggcaattatgagtgctattttagcgttcttctttattgccattatcttctttagtttttatctgggggtagttcctaattcacggacaacaatcctctcccaaatggccgcacaaatctttggtgggcatgggctaggcttttacctcttgcaactttcaactgcaatgattttagcggtcgctgctaatactggtttctcagcctttccaattcttgcctttaatatggccaaagataaatatatgccgcacgcgttcatggatcgtggggatcggttaggttactctaacgggattatttccttggcgattggagcaattattttgatcttgatcttccatggtcagactaatatgttaattccgctttatgcagtaggggtatttgttccatttactttatcgcaatctgggatgattattcactggtttagagaacgggaaggtttctggttagggaaagcctttattaacctagtaggagccttgatttcatttgttcttgtcatttgtttgttctggcaacactttgcaaatgtttggccatacttaattatcatgccgctgcttttatggatgttccattcgattcaccggcactatgtaaaagtagccgctcagttgcgggttactgaaaagacgaaagttcaattacatgattacgatggtgcaacggtgattgttttagttggtaatgtaacccgggtaactcgtggtgcaattaattacgctcggtcgattggtgattatgttattgccatgcatgtttcgtttgatgaaaatccaggcaaagagcataaaacagcaaatgaatttaaagctgaatatccagatgtccgttttgttgatattcactcttcgtaccgttcaatcgcaaaaccaacgttacgttttgttgatgtgattgcaaaacgagcagaagcaagaaattattcgacgactgttcttgttccgcaatttattcctaaacatccatggcaattggccttacataatcagaccagtgttcgtttacgggcgttattgaattcccgagagaatattattgttgctagttataactatcatcttcaagaatagtttatttagagagaaagtattgatttaatgaataaaaagcaactattatgggggcttttgtttgcagttggccttttcatggcggcaagttataccattgataatcgtggctttcattctggaatatacggtatcattggctgtgctttgatcttaatcgcgtatgcgggaatgaattgggaaaaactgcaatcaaaagatcaacatacgagaaaaattttagtgcttttgagcagtattttagggattatcattgtccttgatattgctgaaatgattttaggataattaaataaagcttattgagggagcgagacagaagtcacttgtgacttcgtttttcgacgcgaagctagcctctgggagcccccgcaagcaacagtaggcctccaatgttcggttttgtcggacgttggaggccattgttgtactgcgtatttgctttttatgaaagtaacttaacttatgtcacagtcctttttatattaactaataagctaaatcatattatcctttttgctagtcggctaacaaaaaggagagatgaaaattgctaataggtcgtctagtaaaacaagctaacaatgcgatgaatcaagaaatgaatgcatttgcgcagcagtatggattgacaggaacgcaaatgtcgattattgattttttaacgcatttcccgggaaatagttgtgatcaacaccagattgaaaatgaatttggaataaagagatcaaccactactgtattacttcaacgaatggcaaagaaaaatttaattgaatgttatccgtcaccagaagatcgccgtcaaaaaatcgttacgcttactgcagaaggccaaaaattatcttcagatgtaagtgcgtatattacacaatacgaagagaaattaaaagcagattttagtgaacaggacatttcgaaaataagacgattcttatcaacgatgatagaggagaaataatgagtacgaatactgaaaaaatttcggcaaaagttgttgcagcgattgtggcaaccggattgatgtcattttgtggggtaattgtagagacagcgatgaatgtgacttttccgatcctgatgcgtgaattttcgattactactaatcaggcccaatggatgacttccatttatttgctcttggttgcaatcgttgttcccttatcggcaattttgaaaagctcttaccgaacaaagatgctttttacagttgcaaacttgctttttatcagtggaataattattgatgcactggcgccattatttggggtgcttttagttggtcgtacaattcaaggaataggaactgggattgcattaccattgatgtttaatattattatggagcaagttccaacaagcagaattggctttatgatggggagtggaaatcttattactggagttgccccagcgattggtcctacttttggtggaatcgttgccagcaagcttaattggcggtgggtattttattcattaattccgcttttaattatttcgtttgtgcttggtgaatggggaattacccaaaaatcaccgattaaaaagcaacaaattgatctttttagtatattaatgattgtattcatgttctgtggttttgtaacagaatttagtaacctgggaagccaagccttcatgaccttttcagttggtagtgcattgttaatcgggatcttaggaatgggactttttgctcggcgttcattaaccctaaaagaaccaattttacaattacgattatttagaaataaaaaattttctgggcatattcttggtttctttttaacccaacttatttcgttaggctttgcatttcttttaccaaactatattcaattggtaaatggtaatagtgcaatgacagctggcttgattgtccttccggctggttttgtgggtgcgatatttgccccattgggaggaggattttagataaatttggcgctcgcaagcctattttgattgggacttcattatgtctaattgcgcttattgcttttacaatctatggatagcatttaacaaatatatttattgcgcttgtttatattctctatatgggtggaatgggaatgtgcatgggttgcgtaatgacaagtgcattaactgttgttggtaaagcaaagcaatcacaaggaaatgcgatccttaatactttgcagcaatttgccggggcaattgggacctcattagtagcgatgattgttgcagccagtcagagtcatctccacacgactagacgtatctctacggcaattggtactcaagaagcttttggcatgttaacgattttttgtattataatttggataagttactatcgaagtgtgaaaaaataaaatatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaattatcaaacaattaataacgagctcaaccgtggtacggtccgccagcttcgtcgtcaaaaatctaatggtaagatttacgaatattcttactacatctatagttatgaagctggtcaggccacatatcttgaacatcaccgccattctggtcgtcgttgcttatgttattcttcaaagcaatttttacgattagctgatcagctaatgcttggtgagtttgacgaccaacattactccccacaagcggttatttataaggctcaagatttaatgaatgatggcaccctgatcccaaagtcggttgtaactttatatcaatggattaatgagggtgtgcttcgtacgtctaatttagacctctttgaaaaacctaaacgtaagcatcgtcgaactcatccgcaagctaaaaggtgcttagggcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcaattctttataaatttacgccagaaaatgggcacagatgcttactatcgcatctttaagacaataacctctgacaacggttcagaatttagtgagttaacacaagttcacgatcatgttttctatgctgatccgtattccccttgggaacgtgaatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaaaaataaaatattaaaaaattcaggctagaaaattctaacctgaattttttaatatggaatttcgttaaatcgctgatcgccctcagttatttgaagctggtcgttaaaacgattaatgagcttttctttgacatcttttaagtccgtttcgtttacataaatacttgtttcaacattaaccccgtactcctcactagcaacctcaagattgttctccttgaggtagtaaagaaggagatcgtgaagagcataggtaacagtgatttttagaatttcttgcttgatccgttggacgagaccagcctggtggattgcttcagtagttgtattgctatatgcccggatgagaccacctgcgcctagcttaatcccgccgaaataacgggtaaccactgctacgacattgtggatctttgcaagtttaagcgattcaaggatcggaattcccgcagttccgcttggctcgccattatcactttctcgctggatctggtcgttgtcaccaatcatgtatgcaaaacaattgtgagtagcttttttattagctgcttgaatactggcaataaactgttgagcttcttcatctgaggagacacgggcaatggagcaaataaatcgtgattttttaattatttgctcataagtagtgtttttggcaattgttaaatatggttctgtcatttttaaacttccttcgtgctattttaattagtttacgtatatataaagtaggaggtgaataatggatctagaaaattattatgggagacgagtcttggcttcgcgtcatgaggtgaaacaatcaggaattcaagaactgccaacaatcagaattgacgctggtaatatcagatgctatcgctgcaatcatgtcacggcaaaatcgctgggcgctttgccacaaggcgagttctattgtccgcattgtattaatcttggacgcgtttcaacgttaaataaattttatcatgttccagagccaaatcaatttacggttaccgaaccggtattaacctggaaagggaaattgtcgcctcttcagcaacaagcttcagaaaaaatttcccggggaatggctgaccatgtccaacaattattatgggcagttacaggtgctggaaagactgagatgatgtttgcaggtattgcggcagctattgaacgtggtgagagaattggaatagcttctccacgagtagatgtttgtttagaattatttccccgtttaaaagctgcctttgctaattgtgatattgctcttttgcatggtcgacaagaattaccttatcattatgcccaactgactatttgcacaacccatcaattgcttcgtttctatcatgcttttgataatttaattattgatgaagtagatgcctttccgtatgctgctaatgcttcgttattatatgcgactaagcaagcaataaaagagaacggagggtgtctttacttaactgcgaccccaggtgatgctttgctgcgagaaattaaaagtaaacgattagttgttaattatttgcctcttcgttatcatgggcatttacttccacaaataaaagttagactagcttttggatggcggcgacgattagaacgtcagcaattacccccgcaagttattcaacagttgcaggaaacgctaaaggaaggccatcactttttgctatttgttcctcatattgcagatttagcattggttgaagctgcattacggcattcttttacaactttccgctttgctactgttcatgcaagtgatctagaacgattagaaaaagtccaaaaaatgcgtgatggtgattacgactttttagttacgacttctattcttgaacggggagtcacttttccagaaattgatgtctatgttttgggtgccgatgatccagttttttcctcctcggcattagtgcaaattgctggtcgagctggacgttcgcaaagtcgaccaactgggcgggttattttttggatcaattgtaattgtcgacaagttaatcaagctgtttcccaggtgaagtacttgaatcggaaaggtcaaaggttaatagatggagtgtcttttgtgcaataaagggatatctttccaactaactttgaaagatatttttagctttcgcgaaattatcacgccagtagtctgcactaaatgcaaagaaagttttgtgcgctgggatgatcacggatgtgcaggatgcggtaaagaaaatgttaataaaaatggtttcttatgtgcagactgtcagacttggaagaaactttatggttggtacttgcatcatcgaggattatatcggtataacgaggcgatgaaagaatatatgcaacgttataaatttaatggcgattatcgtttatgcgtggtatttcagcgtgaacttagcaaagtggttaatgaacagaaagcagatttaattgtcccgattccagtaacgtcgacaacgatgcaaacgcgtggctttaatcaggttattggtctattatgcgaagtaccttaccaatcgatcttacgaactaagataagttcaaaagtggcacaatcaagcaagacaaaggaagagcgacttgcaactaaacagccattcatacttgatgcaccagaaaaagtaattaataaaaaggttcttttagttgatgatgtttatactacaggaaggacactgtatcatgcggcaaacctttttaagcaagctggctgtaaagagattggtagcgtttcactagcacgttaaattcttcttaaaatgtattaataaaatttgttaattaacacaaactaatctataataaaaataggatatgagaagagtggtccttctgatatcagatcaagcaattgcttggctgaaaggagagaagtacaatgttaaagttcaatattcgtggtgaaaatgtcgaagttactgagtcaattcgtgattacgttgtaaagcgaattagcaagcttcaaaagttctttgaagatagtgttgaagctaccgcccacgtgaacttaaaagtttatccaaaccggacgtataaggttgaagtaacaattccacttccatacctaacgttgcgggcagaagagacttctaatgatatgtatggaagtattgacttagttactgataagcttgaacggcaaatccggaagtacaagacgaaggttaaccgtaagtcacgtgaaaagggcttaaagaaccttgaattcatcccatctgataatgatggaacagatggacaagatgatgaattaaagattgtacggacgaagcaagtttcattaaagccaatggatcctgaagaagctgtccttcaaatggatatgcttggacacaatttctttatcttccaagatgctgaaactaatggtacaagcattgtttaccgtcgtaatgatggtcgttatggcttgattgaagctgaatagtcaatgccaatatgaagagcgcggatgagaaatcattggcgctttttgtatcttataacttatagccaccttgtaatatccatactaataatttttatttatactatgaacgtggtaaaatattatggttagagtaaaaaacataattggcttgagtagtacttttttattgattttggacttaagccagaaagtaggaaggacgcttttatggccaatattctaaaaaaatggattgaaagcgatcgtcgtgaattacggcgaattaacaaaatagcaaataaagtcgagagttatgctaaacaaatgtctgaactaactgatgaacagcttcaggcaaaaactgatgaatttcgggaacgttataaaaagggtgaatccttggatcatatgttgccagaagcattcgcagtttctcgtgaaggggctaagcgggtcctaggactttacccattccatgtccaaatcatgggagggattgttctccacgaaggtaatattgcagaaatgcggactggtgaaggtaagacattaactgccacaatgccggtttaccttaatgcaatctcgggaaaaggtgttcatgttattactgttaatgaatacttgtcaaagcgtgatgctactgaaatgggacagctttataattggcttggatgttctgttggtattaacaactcagagatgagccctgatcaaaaacgagaagcatataaagctgatattatgtattccactaatagtgaaattggatttgattaccttcgtgataacatggctgtttacaaagaagaccaagtccaacgtggtttaaactatgctttagttgatgaagtggattcaattttaattgatgaagcgcggacaccattaatcatttcaggtccaggaacgggcacttctaagttgtacaagcaaactgatcggtttgttaagcaattaaagaaagatgttgattataagattgatcttgaatcgaagacagtttcattaactgatgaaggaattaaaaaagctgaaaaatacttcaacttaaagaacctatatgatccagaaaatactgcgctgacccaccacttggatcaagcgttgcgtgctaactacatcatgcttttggataaagattatgtggttcaagatggtgaagtattaattgttgattcctttactggacgtgtaatggaaggtcgacgtttctctgatggtcttcaccaagctattgaagccaaagaaggcgtagagattcaagaagaaaacaagacaatggctaacattacataccagaacttatttcggatgtataacaaactggcggggatgactggtactgctaaaactgaacaagaagaatttcgtgaaatttacaacatggaaactattactatcccaactaaccgtccagttcagcgaaaagatgagcccgatttgctttacccaacgttacaaagtaagtttgtagctgttgtcgatcggattaaaaaacttcatgctaaagggcaaccaatcctagttgggacagtcgccgttgaaacctctgaatacttatcccaactgcttgataaagagaatattccgcatgttgtcttaaacgctaagaatcacgctaaggaagcggaaattgttaaaaatgccggtcaaaagggtgcagtaactatcgctaccaacatggcgggacggggaacagatattaagttaggccctggcgttcgtgaaattggcggactagcagttattggtactgaacgacatgaatcacggcggattgataatcagcttcgtggacgttctggacgacagggtgatccgggattatcacaattctacctatcgcttgaagatgatttaatgaagcgatttggtggagaccggatcaaagccttcttggagcggatgaaagttaatgatgaagatgctgtcattaaaagtcgtttcttgactcaccaggttgaatcagcacaaaagcgagttgaaggtaacaactacgattcacggaagaatgttcttcaatatgatgatgttatgcgtgaacagcgtgaaatcatttataaagagcgacaacaaattatcactgaagataagtcgctgaagtgggttcttatgccaatgtttagacggacaatccagcgtgaagttgatcaacatactcttggtgacaagaaggattgggatttacaaggaattgttgactttgcagaagaagtcttaatcaagcctgataccatcacagttaaggatctagaaggtaaatcacctcaagaaatggtagattacttgatgacatttgcccagggagtttataaggaaaagcaaaaacaactttatgatccagcacaaatgcttgaatttgaaaaggttgttattttgcgggtggttgactcacactggactgatcacattgatatcatggaccaattccggcagtcagttggtttacgtggatatggacaattaaatccattggttgaataccaaactgctggttatcacatgtttgaacaaatgattgctgatattgagtatgaaactactcgactcttcatgaagtcagaaattcggcaaaatgtaacacgttaattgttaattactactaggtacggcagtaaggtaacccatggcggtaccgctgccgtattgttgtataacggaggttcgattgtggaattaaatgaagcaaaaaaacaagtagaatcaatgcaaaaagaagttacgcacttcgggaggtctctttgacttagatgcactagatgagcgcattgcagaaattgaacaagagatggctcaaccagacttttggaatgataatgagcaggcacagaaggtcattgcggaaaataatattttaaaagaaaaacgggatacttttgtgaatttacgtgatcagattagcgatcttgaaacgtcgcttgaattgctcgcggttgaaccggacgatgatttacaaaaagatttcgaagcatcatttacaaatacacaaaaggctttagaacagtatcgcttaacgcaacttcttgatggggagtatgacgctaagaatgctatcttagaaattcatccgggagcaggtggtactgaagcccaagattggggtgaaatgcttctgcggatgtatattcgttggggtgaacagcatgctttctccgttgaaacagcgagttatgaagccggtgatgaagcgggtatcaagagtgttacgctgctaattaaagggcataatgcgtttggttatcttcgtagtgaaaagggagtccatcggcttgttcgtatttccccatttgatgcggctggtcggcgtcatacatcatttgcttcggttgacgtaatgccggagttggatgatagtgttgaggttgatattgatccatcagatttacgagttgatactttccggtctagtggtgctggtggtcaacatattaataaaacagaatctgctgttcggattacgcatattccaaccgggattgtaacctcttctcaagctgaacgatcccaacttcaaaaccgagttactgcaatgaatatgttaaaatcaaagttgtatgaactagaagaagaaaagaaagctaaaaagcgggcggaaattgagggcgaacaacttgatatcggttggggttctcaaattcgttcatatgtttttcatccatacactctagtcaaagataatcgaacaggttatgaaacccataatggacaagctgtaatggacggggaccttgatccatttattgatgctttcctacagtggaaacttagtcaaaagaatcctcaataagttatttagtttggaaggaagtgagtaaagtgcgcgaaagtcaacataaaagattaactcgctcaggatcagatcgaatgatagctggtgtatttggtggaattggccagtactttaagattcagccaaatattttacgtactttatatgtcttactgactatttttaccggttttgttccaggcattattatctatattattttgataataataatgcctgctgatccgcaaaatcccgatttactaggatttttaaagtctttcagtgaatcacaaaaaacatctcaacagcctcaccaacgttctcggcggactttaacgaatgtcgaggaaaaagacattaaaagaaatggaagatcatgatggaattttggaaaagagtattgattgatacaatcctttttattgcccttgctggtttatttgccggaacagggatgttttatattacaagtgcttggattgcaccattggcaagctttgttttagcaattttgaacgttgctattaagccaattttagtaattttatcgttgccgattaatattttgaccctgggcctttttagtgttgtaattaatggaattatgctacaactaacatcgatgcttgtcgggtcggcaaactttcatttttcgtcatttggttctgcaatgttgattgcgattattatggcaattttcaatgcagttattacaagtcacgaggatagattgtaaaggagtggagaaaatgccaaacaatgtaacggtgcaagaattagttgataaggtccggttgaaagtcttacaaggagaagattacctccaacgtaagataacaactagtgacatttcacggccagcacttgaatttgcgggatattttaagcattaccccgcagcacggattcagctgttaggaatcaccgaaacctcatttgctaaagacttaactcatgagcaacgtgaagagtacatgacaaaaatgtgtatgccacaaacaccatgttttgttatctcaactaatctgccaattcctaaggagctaaagaaggcggcggaagatgcaaaaattccaatcttaggaacgcatttaacctcttcccaaatattaagtaacatgacttcttacttgcttgaacgtttggcaccacgaaaatctctccacggtgtattagttgatatcagtggggttggagtactcattactggtgattcgggagtgggtaagagtgagaccgcgttggaacttgttcgtcgtgggcaccgactgattgctgatgatcgggtagaagtttacgctcgtgacgaacagaccttggtagggactgctccgcaaattttaaaacacttaatggaaattcgtgggattgggattattgatgtctctacgctttatggaacaggagcaattatgccttctgatcaaatcagtttaattgtacatcttgaaacgtggactccagatgtacagtttgatcgtcttggtgatcgtggagatactcaaataattcaaggcgttattgtgcctaaagtttctgtcccggttaaaactggtcgtaatttagcgattattattgaatcagctgcaatgaattatcgggccgagacaatgggctatgatgcgactgaaacatttgatcgaaaccttaaccagttgattaagcagaattcagaacgtgatagtaaaaataacaaggggtcggcaaactagatgattaatccaggaataaaagccgctttaaacccaattgctttccaagctggtccatttactattcactggtatggcgtcattattgctagcggggtagttttggctctcttgttagccgttcgcgaaggaaagcgagaaggaatttctgaagatgatttttatgattatcttttatgggcgctcccaattgcgataatttgcgcacgaatttactatgtagtatttcagtggagctattattctcagcatccaagtgagattattgctatctgggatggtggaattgcgatatatggagcgattttaggaggctttattgttttacttgtcttttgccattaccgtcatttatctagttggctgatgatggacatcattgccccaacccttattatggctcaaggaattggccggtggggtaactttatgaatcaagaggcatttggtgatattacgacacgggcgcatttaatggctcagcatattccaaattggataataaaccaaatgtatattggtggtcactatcgaattccaacgttcttatatgagtcactatgggatttaactggctttgcattactaatgttacttcgtcatcgcaaacatttatttcgtcgtggtgaaattttcttaacctatgtaatgtggtatgcatttggacgtttctttattgaaggtatgcggactgatagtttaatgctcggaaatattcgcatttcacagttactttctgtagtgttttttgttagtgcattagtaatactaatagttcaacgtcataaaaacattccgtggtatgataacggaataaacaaaaattaattgaattggataaggagaaagaattatggcagaaaaaattgctgttttaggtgctggttcatggggcagtgttttagcaaacatgcttacagaaaatggtcacgatgttacattatggtctcgtaatgaggaacaagttaagcaattaaatactgaacatacaaatcctcgctatatgaaagattttgtttattctactaaattaacagcaacaacagacatgaaaaaatctgttaagggtgccagcgtgatactgattgtgattccaacaaagggtcttcgtgaggttgctaagaaattaaacacaattttgactgaattacaccaaaaaccgttaattattcacgcaacaaaaggcctagaacaaaatacatataagcggccatcagaaatgcttagtgaagatatttctcctgaaaatcgtcaggcaattgttgttttatcaggtccgagtcatgctgaagatgtggcaattaaagatatgacagctgtaactgcagcttgtgaggacctaactagtgctaaaaaggcgcagaagttatttagtaattcttatttccgtgtttatactaacgacgatgtaattggtgcggaatttggagcagccttaaagaatattattgcaattggtgctggagctatccaaggccttggctaccatgataatgcacgagcagctttgattactcgtgggcttgcagaaattcgtcggctgggggttgcttttggtgctaacccaatgacttttattggtctttctggtgttggtgaccttgttgttactgctaccagtaaaaattctcgaaattggcgtgctggctatcaattgggacaaggaaaaaagcttcaagatgtaattgataatatgggaatggttatcgagggggtctataccactaaggccgcttatgaattaagtcgtaaacggcaagtacagatgccaattaccgaagctctttaccgtgttttgtatgaaggtgaagatatcaaaactgcaatttctcagttaatggaccgagatcttacttcagaaaacgaataaatatggtaaaatactagaggatggatattgagagaaattgaaacatggaaagggttttacaagtatgaaacgtgttagaaaagccattattcctgctgctggtttaggaactcgttttcttcctgcaacaaaggcattggcaaaggaaatgttaccaattgttgataagccaacaattcaatttattgttgaagaagcgcgcaaatcaggaattgaagatattgttgttgttgatggaaagaataagcggtctattgaagaccactttgactctaatccagagctggaagataatcttcgttcaaagcacaaggacgagatgttaaagatggttgaagaaacaactgatgttaatatttacttcattcgtcaatctcacccacgtggtttaggggacgctgttttaactgctcgtgattttatcggggatgaaccgtttgttgttatgcttggggatgaccttaataacattaacaacaagaatgaagctttaacgaagcaattaattgaaagttataaccaaactggcgcatctactcttgcagttatgcgggttccacatgaagatactgcaaagtatggtgtaattaaccctagcaaggaagttacgccagggctttataacgtaactagcttcgttgaaaaaccagctcctaaagacgcaccaagtgatttagcaattattggtcggtatgtctttactccagaaatctttgatgtattagcaaagactaagccaggtaagggcggcgaaattcaattaactgatgcaattgatactttgaaccaaactcaacgggtattcgctcgtgaatacaagggtgaccgttacgatgttggtaataagttcggctgggttaagacaaacattgaatatggtttggaacacccacaagttaaagaagaattgcgtgaatacattaaggaattaggcgcaaagcttgctgctgaagataagcaaaataattctaagaagtaagactagcattggcctgtaaaaaataaaccttcaagattcgttatagggatcttgaaggtttattttttacatatcttcaacaactacatattccatatcaagtgggccgtgaacaccaacgattaacaccatttcaatatcaccagaattggatgggccggtaataaagttgatgtttgatgtttgtaaactaccatcctgaattgccttttgataataatccattgcttgccgtgaacgtggtaaaattttgctttttggcacaatagctaggtaatgagttggaagaaaatgaaacatccgtccttgttgtgggtaggtcgcaactgttacggtccctgactcagctaatagaaagtccgcaaagccaattgctccatcactgttatttgcatttacaatgttttgccgcccaaattcaggttcccaatagtaaataggatctactcgtaaattatcttgccatttccccaatgaataatcttgccatttttcttcatcaaaggagggaagcattaaacttttaatctccttttcttggataaaatcattaagagtgtggccaagatcggctgatttaacaacatggaaatcaacatgaacttcttcgctatttttgcgtgcaagttcaagaagttcatcttggctttttccagcaagggtagtttctggaagattattaacggggacaaatggattttcaccaagcgtatggcgaggacgattggcagcctttgcaattcgatttaagaagtcttcttgatttttagcggtgtttgcttcttgtaagtaatcagtcattttcttgctcctcctcttcttcgtaatgacgataccaatgccggaagttttggtggtactttggtggaacagcaagatcacgaacatctacccagccatgagctagtttaggagcaattgcgggaaggtggttaattttaccatctggataaaggttcttaatgtctttaggagttgtcttcttgccaaatggctcaagagcaatatgagcaaatcgcattgcatcattaaaaagcgtaggggagctcgtacctttaccaactgccttcaaaagagcattcgaaggactgtgatctaaatgaagttcatccatttctacataacggtgatgacggattaactcatgaaggggaattttaacaggacaagtttccgtgcaagcagcacataaactacatgcatatggcaattccttgaattcttgataaccgcctaaaatcggcgaaagaacttcacccattggtccaggataaatcgatccatatccctttccaccgacttgccggtaaacggggcaaacgtttaagcaagaaccacaacgaatacattgcagcattggttcaaagtcagtgttaagcatcttagaacgaccattatcgactattacaacatagaagtcatctggtccatctgcttcatccgcttctttaccttttgagaaagtacagtaactagttagtttttgaccaactgcacttcgacataaaacattgtcaaggacttctgcttctttcaaacttggcacaattcgttccatccccatgactacaacctgggttttaggaatggccatactaatatcggcatttccttcgttggtaacaaggttaatcattccattatcagcaatcgcaaagttacagccagtaatgccaaagtctgcttgcataaagtaattacggagatagtgacggacaaacctagccatatgttcaggatcattgtcaccgtcataaccaagcttttcaaatactttttgaatttgattgcggtttttatgcagcgtggggaaaacaatatgtgttggttcatcccaattatcttcttgcaaaataaattcagctaaatctgtttccattaatgaaagtccggggattgtgagtaattctttatccaatccaatttcagtagtcaccattgacttagatttaacaacatgatgaacgtttttcttgattgccaattgtttgataaaggcacttgcttcgttaccatccttggcaaagaaaacatgaccaccatttttttgaacattatcgctgaattcttcaaggtaatccgggagatgcttaatgacgtgttgacgaatttcagcagaaagatcacgccagccttcccagtgtcctaattgacgccgtgcttcagttcgtttttgaaattgagcgtcttgtgctttagcaaccgatgcccgcataaatttatcggcttctgcgtctttaattcgttcagtaaaaggcttatcgcttgtggctattcccatctaaaacaccccgtttccgtttgctggtaccattacatgatccgtatctttgacataagtgattcggctagtatcaacgttatgattaaggacctcagcaatgtgcataattgtaatatgagagccatcacggcgacggttaattcgtccaccaatattcattaaacatgtttgctcgcaagcaataagaatatgtgctttcgtcttcaaaacattatttgctttatcatcaaccatcgcttcagagagaaggggttctttagcagagaatgttccaccaaagccacaacataattgaatgttatgaaggggaataagctcaagtcctttaacatgttcaagtagaacgatgggggctgtccgttcaccaagaagacgggtcatgtggcaagaacggtgaaaggttgctgtatcatctagttctgcaccacaatcaagaataccgagaacccggtaaataaattgcgttagttcaaaagatttatcataaaggatttgcgctttcttcgaatactctggatcatctttgaaaatgttcttgtattcatgaagcatggcaacacatgatccagaaggcccaacaatataatcggcgtcaatacttaaaagggcatcgagttgatttttaaatgtagtaattgtttcacgatcataaccgctattataagttggttgtccgcagcaaatttgtttatcggggaaaaatgtttcgcagccaaaacgttggagaagttcaaccgttgcctttccgacatctggataaagcagatcaacaatacaagtagaaaaaatacagactttcatacatgcgtgcattaattggatgcacttcgcctccttaaaaatcgaaaaaatataattgcttatcataataagtataactcaaatatgataatattagagttgaaaacgatttaattatttgaaactaatatataaaatcataatattgattatagttcgacaagaatattactattaaaaagtaagcaaaatgatagacaaaaagatccaaagtctgtatgatatggatagtaaaaaaattgttcgaggaggaagagagaaatggctgaaaataagcaatatgatgttgtaatcatcggtgctgggccaggtggaatgaccgcagcgatgtatgcatcacgagcaaacctatctgtcttgatgcttgatcgtggaatttacggcggaaacttgaataatactgctgaaattgaaaattacacaggattcaagagtgtgaagggtcctgaacttgcccaacaaatgtatgaaggtgcaactcagtttggcgcagaatatgcttatggaacagtaactaaagtagaacttgatggtgacttaaagaagatcactactgacatggatgaaacatatactgcaaaggcggttgttatcgctactggctctgatcagcgccacctcaatgttccaggagaagaagaatttggtggccgtggtgtttcatactgtgcggtttgtgatggagccttctttaagggaaagcatttaatcgttgttggcggtggtgatgcagctgttgaagagggagtttacttaacgcaattagcctccaaagtaacagtgcttgttcgtcgtgatgagctccgggctgaaccaattattcaagcagaagcgatgaataatgacaagattgagtttgtttataacactagtgtgactgaaattgttggggatgatattaaagtaacaggtgttaaaactcataataataagactggtgaagatggtgaaatggctgcagatggtgtcttcatttatgttggtaatttcccaaagaccgctgcttttaagaatttagatattcttgatgatcaaggctgggtaaagactgatgagcgaatgcggacagcagtaccaggtatttttgccattggggacgttcgtgaaacaccattacgacaggttgcaacagctgttggtgatggagcgattgctggccagcaagtttatcaatacattaaatcgatggattaataaaaaggtgttagagaaaagctctagcatctttttttatttagtggtatagttttgattaaaatttagttagaaaaggagggcgattaccattggaaaatgatgaaaaaataaaactattacagaagttaattcagattgatacagtaaatggtaacgaaaaggacgaagcaagttatattaaaaggaccttagaagatcatcatatttcctgtgaattagttccttttgcacccaaccgcaccaatttaattgcggagattggtgatgaaaaggggccggtactcgctctttctggacatttagatacggtagctgcaggtgatttccaaaaatggacatatccaccatttgctggccaattagtagacggtaaaatctatggtcggggagcagttgatatgaagtcgggattggcagccatggtgggtgctttaattgagcttaaagaagcaggtttgccaaaacatggaaaggttcgcttgattgccactgttgatgaagaagttggtggtcaaggttctcttgaaatgactgataaagggtacgttcatgatgttgatgtgatggtaattggggaagcaactactggccaaattgaatatgctcactgtggctcttttgattatattgttgagtcttatggaaaattggctcatagttcgcaaccagaattgggaattaatgctgttacaaatctagtgaaatttatcaataaagaatcacgggcgtttgacgatgcagcagtaagtcccaccctaggaaaattaattcatagtgtgactgtctttcatggtggagagcagttaaattcaattcctgattacgcatatttgaaggggaatgttcgcacgattccagaatgtgataatcgggaaacaggaaaaagactacaatcaatcattgatgagttaaacaaggagacaggggttgaattaaaactaaagatagttgctagttttatgccagtggttacaaataagcaagatcgcttcattgcacttgctcaaacggcaattaaaaaggttagcggcaggcaaccggatgtagtgatttctcatggggcaacggatgcatcccgctatgttttagacaatcacaattttccaataattgaatacggaccagggattgaaaagttatcacaccaaattgatgaacgtattgcgcttgatgattatttaacggctcagcaagcttacgttgaaattgctaaacaatatttgaataatactaaagacgatgaacaggctagtagttaagcatgaccgtacagagactccagctggtggaaaaggagcttttatgctaatgaatcacacctgggagtaaagattttttgactgaaagaagaatccgggagtcacccgttatcacaaagagtttcgtcgcaaatgactgaacttaatgaggcagttgctgtgaggtagctgtgaaaaaaggtggcaccacgcatactaaatacgtcctttgaagatttattcttcagagggcgtttttttgataaaggagaagatacgtatgaagaaaaagataattaatttcggattagttttaatattgcttttacctttaattgtttttgcaagtggctttaagattcaaaatgagaattaccgggcaaaccacacagatacgtgggaaagaataaagaagcggggaacattacttatcggggttgatgatacctttgttccgatggattttcgaaaaaagaacggtcaattggttggttatgatgttgatttatctcgcgcagttgcgaaagttttaggattaaaagctgattttcagtcaattgattggtcaatgaaggaaaccgaattaaaaaatggcacaattgattgtatttggaacggttatacagctactccttcccgacaaaaacgaattgcatttagcagagtttatgagctatctggccaatcattggtggtacgaaaagatagtaaaattaaaaatttcgcggatatgaaaggaaagacgttgggaattcaagaaagctcaactgctcaaactgattttgacaaatatccccaagtattgaagaaactagttaaaggacagaagccaattctttatcaagataactcgagtgctttcatggatctgcaagcaggccgcacacaaggagtacttgccgggactgtctatgccggctattatgcgacccacattgcaaataataataattataaattgatttcagcatctgcttatcctgcagaccgggttgcgattggaatgaggaagggggaccggacgcttattaataaaattaactatgctcttggggttcttcaaaaagatggtaccttacgacggattaataaaaaatggctaggaattaatagtaattatctgggaccggttgctgaatttcaaaaatccaacaataatcgttaatgatttgttaaaattttatataacaaggactaaggaggttttttaatgggtgcaatcaaatgtaatgatacattagcggtgtcaattcatcggattcgtaattcagatttaaacgaacacgggacagtatacgggggacgaatcttggaattaattgatggtcaagcctcggtagcagcaatgcgagtagctcgaacaacagttgcaacagtatcaatggatgagatccaatttctgcgaccatttgaccttcaagattcaatgtgtatggaggcatacgttaccggctttgggaagcgatcaattgaagtatttacaaaagtaattggtgagcacttgatgaccggtgaacgtttcctcggcttttattgttttatgacttttgtaattcttgatcctgaaaaacaaacggcatttaataaattaattccggaaactgaagagcaaaagacgttaatggcaacatattctcaacgtgttaagcaacggcaaatccagcggcaaaaacagcaagaatttctgcctcatatttcaatttccaagccgtggtaaaactttagtaaatttttaagtaaaaagcgacagatagcattttatgcggtatactaaaaagcagagtatgacataaaggagacattattgtgagctggaaagatacttataaggtttggcaagaacgaacagatcttgaatcagacttaaagcaagaattagctgcaatgagcgacgataaagaaattgaagatgccttttacggtccattatcattcggaactgcaggaatgcggggactaatgggaccaggaattaaccggatgaatgtttacactgtccgtcaagcaactgaaggtttggcaactttaatggattcattgggtgatgatattaaaaaacgaggagtcgctattggttacgattctcggcacaactcccgtaaatttgctcatgatgctgctcgtgtattaggtgctcatgggattaaggtttacatctatgataatttacgcccaacgcctgaattgtcatttgcagttcgtcacatggggacttatgcgggaatcatgattaccgctagtcataaccctaaggaatacaatggttacaagatttacggtgaagatggcggacagatgccacctaaagaatctgacatgatgacaggttacatccgtaagattgatgatatttttgacattgctttagctgatgaacaagaaatgcttgacaatggtttggaaacaatcatgggtgaagatgttgatgctgcataccttgctaatgctaagggtgtaactgttaaccctgaattagccaaggaatacggtaaagatatgaaatttgtctttaccccattatgtggaactggccgaatgcttggtgaacgggcattgcgtcaagctggttttacaaattatgaaatggaaccaactgaagcacaaccaaatggtgatttccctggtttggaacatcctaatccagaattcccagaagcatttgttcgttccattgcccttggcaaaaaagttgatgcagatgtgttgatcgccacggaccctgatgctgaccggcttggatgtgcagttcgtcaaccagatggtgaatatcaattgctaactggtaatcaaattgcttctatcatgcttgcctacattcttgaagcgcataaacaagcgggaaccttaccaaagaatgctgctgcggtaaaatcaattgtttctactaacttcgctgctaagatcgcagaaagttacggcgttgagatgatcaatgttttaactggtttcaagtggatcgctgaccaaattcatcaatatgagactggcaaagctgatcatacctttatgtttggttttgaagaaagttatggttaccttattaagccatttgttcgtgacaaggatgctatccaatccttaactttacttgctgaggttgccgcttattaccgtagtcgtaacatgaccctttacgatggcttacaagaattgtttaagaagtacggctacttccgcgaaaagacaattgctaatacttatgctggtgttgatggcccagctaagattaaggctttaatgaagaagttcagagaagaagccccaactcattttgccggtcatcaagtagtagttactgaagacttcgctaatgggactaaaactacagctgatggcgaagtaagtgaattaggtatcccagaatcaaatgtattgcgttacattcttgatgatgatacttggattgctattcgtccatcgggaactgaaccaaagcttaagttctacattggtacaagtgctgataccttagataaggcaaatgaaaaattagctgatttcgaaaaggctttacaagagtttgctgaataataataactgagagactgttgaaaaaactttgcttttttcaacagtctctgtttttatatacgatattggggatgtcactaagattaaatttttcctcacctttcttgaaatttcgccaaaaaattgtatgattgtacaaattaattattttttgggaggacttcatcgtgggaatgcatgaatatctgaaaagtttaagcgacctcgaaatgattaaccgtgctccaggatattttaaatttgaggaacacaatgtggctgcccattcatttaaagtaacgcaagcagcacaaatgcttggtgatattgaagaacaagccggaaatgaaattgattggcgttctttatatgaaaaagctcttaatcatgactatacagagcgatttattggtgacatcaaaacaccggtaaagtatgctacccctgaattgcgctcaatgctggcgcgggttgataaatcattaacagaaaacttcattcaatctgaaattccggctgagttccgggcagcttatgaacgacgatttgcggaagggaaagatgatactttagaaggtaaaatcctcgcggttgctgataagattgatcttatgtatgaatcatttggtgagatccaaaaaggtaatcctgaaccagtttatatggatatttataagtcgagcttgacggcaattatggattttcgtgatatggctagtgtccagtatttccttaagaagattttaccagaattattaaaagataatgcagatggtaatgctaaaaaccaattagcaattattactacgcaaattattcaacaataatttatgcttttaggcttccttttatcaaatagttgatttttgaaaacgctttcttataatagaagtagaaggtaaaaattaacaaagtaaagggaggcggcaaggatgacaccaagtttatttgcaggaacatttgcaattttagtattgtggctaatcgttgatattatctgggaattgagtcgaccaagagacattgtaatgcggcgcctctgtgcttggcttaatcttattgcgattattggtggtttttctgtattttatggagtaacccattttgataatgctaatcttgttccgtggtttatttgtttgaattggattaatgttgttgccgcgggcttacaattttactttggttactttcggcataattaaatgataaataaaatattttaagaagtgagtgaaaatgggcttgtttggagagattgttttctactcacttttttactgtaaatttatagacgaatacatgtttgggtgataaactaataacagtaaataataaatagttagtgataagtgggatgcggtaatttatgaagttgcgattccactttattttatttaactgcgacgtaagggaggaatttcttttgatttaccggcaaccagataaaaaatttgaactagtgtcagagtacaaaccaaccggcgatcagccccaagcaattaatcaattgacaaaggggattgaagatggtgaaaaagctcaaatcttattaggagcaacaggaacaggaaaaacatttacaatctcaaatgtgattgccaatgttaataagccaactttgattctttcccataataaaactttagctggacagctctatggtgaaatgaaaaaattcttccctcacaatgcggttgaatattttgtttcctactatgactactatcaaccggaagcatatgttccatctagtgatacttatattgaaaaagatgcgtcaattaatgatgagattgataagctgcggcactctgccaccacttccttactggaacgaaatgatgtaattgtcgttgcctctgtttctagtatttttggattaggggatcctcgagaataccaaaatagtgttctttctttgcgcgttggtcaagagattgaacgtgatcgattgttgaccgaactggttaatattcaattcgatcgcaatgatattgattttcaacgggggcgtttccgcgttcgtggcgatgtagttgaaatctttccggcgtcgcgtgatgaacgagcattgcgaattgaattctttggggatgagattgatcggattcgtgaagttgatgcgctgacaggcgaagtgattggtgaccgggaccatgtttctatcttcccggctactcactttatgactaatgaagaagtcatggatcgggcattgccacaaattgaagctgatatgaagaaacaagtaaagaagtttactgatgagggaaagcttcttgaagcagagcgaattcaacaacggacaacttatgatattgaaatgatgcgtgagatgggctatacaaatggaattgagaattattcgcgttacatggatggtcgaaagcctggcgaacctccctataccttattagatttcttccctaaagatttcttattagttgttgatgaatcccaccaaaccatgccgcaagtacggggaatgtataacggggaccgagcgcggaaacaaatgttaattgattatgggttccgcttaccaagtgctcttgacaatcgaccattaaaactaccagaatttgaacaacatgttaatcaagttgtatatatgtctgcaaccccaggcccatatgaaatggaacagacagaccacgttgctcagcaaattattcgaccgactgggttacttgacccaacagttgaggttcgcccggtaatgggacagattgacgacctagttggtgaaattaacaaacgtattgagaaaaatgaacgtgtttttgttacgaccctgacgaaaaagatgtccgaagaccttactgattatctaaaagatatggggttaagggtcaaataccttcatagtgatattaagactcttgaacgaacgcaaatcattcgtgatctccgtcttggtaaatttgatgttcttgttggaattaacctcttgcgggaagggctagacgttccagaagtatccttggtcgccattcttgatgccgataaggaaggctttttacgtaatgaacgttcacttattcagacgattggtcgcgcggcccggaatgagaatggggcagtaattatgtatgctgataccgtgactgactcgatgcaaaaggcaatggatgaaacaaagcggcgacggacgattcagatgaaatacaatgaagaacatcatattacgccgcatacaatcatcaagccaattcaagaagcaattactgttactaagaaagcaacggatgaagctgaagcagataacagtgctgaatttactgacaaagattttgcaaagctagataaagaggcccaagcaaagatgctggatgaattaacagagcaaatgcgctctgctgctaaacgccttgactttgaacaggctgctacgcttcgtgatacgataatggaattaaagacaaaagcaaaaaaatagaggagggattatttcgtggcaaatgataagatcataattcatggggcacgggctcataacctaaaaaatattgatattactattccgaaaaacaagttagtcgttataactggcctatcgggttctggaaagagttctttagcttttgatacattatatgcagaaggacaacgacgctacgtggaaagtttatcggcttatgcgcggcaatttttaggccagatggataagccagatgtagattcgattgacgggttatctccagcaatttcaattgaccaaaaaacaacatcccataatccgcgttcaacggtcggaaccgtgactgaaattaacgattttctccgcttactatgggcacgggttggtacaccaatttgtccgaacgataatattccaattactagtcagtcaccagaacaaatggtggatcgggtactagaattgcctgaacggacacgtctgcaaattctttcgccggttgttcgtgataaaaagggaacacaaaagaaagtctttgaaacaattaagcgtgagggatttgtccgagttcaagtggatggcgaaacttatgaccttgattcagtccctgaattagataaaaataaaaaacatacggttaacgtcgtgattgatcgaatcatcatcaaagagggaattaggtcgcggttatttgactcctttgaatcagcgctccgcttaagcgatggttatgcaattgctgatgtgattggtggagatccaattccattttctgaacaatatgcttgtcctatttgtggctttacagttggtgaattagaaccacggttattctcctttaatgctcctactggtgcttgtccagaatgtgaagggttaggattgaagctcgaagtagatattgatttagtagtccctgaccgaacaaagaccttaaaagaaagggcgattgttccctggaatccaatctcatcgcaatactatccccaaatgttagaacaattctgcaagtcggttggcattgatatggatactcctttcaataagttgcctaaaaagcaacaacaacagattttgtacggtaatggtgaaacgccatttcacttccattatgagaatgactttggtggcattcgggatgtcgatgtgccatttgaaggtgttatcaataatattagccgacgataccgggagactaactcagattttacaagggaacaaatgagaaagtatatgactgagcttccatgtccagtttgtcatggttaccggctaaaccagcgggccttagcagtaaagattgatgggcgaaatatcggtgaagtttccgctttatcaattagtgattcccttgaattctttaagagcatcaaactttctgcacaaaaaaatgaaattgctaagccgattttaaaagaaatcattgatcgattaacctttatgaaaaatgttggtgttgaatatctaactttaagtcgctcagcacgaactctttcagggggagaagctcagcgaattcgattagcaacccaaattggttctaatttatcaggagtaatgtatgtccttgatgagccgtcaattggacttcatcaacgagataatgaccgtttgattgagtcgttaaaggctatgcgtgaccttggtaatacacttgttgttgtagaacatgatgaagatacaatgcgcgcggccgattacattgttgatattggccctggagctggtgaaaatggaggccaagtgatggcagccggaactcctaagcaaattatgcgatcacggaaatccttaactggccaatacttatcagggaaaaaatttattccagtacctcaagagcgtcgaggaggtaacggtaagaaaattactattacaggagcagcagaaaataacttaaaggatattacagttgattttccacttggtgagtttatttgcgtaacgggggtttctggttcagggaagtcaacccttgttaatatgattctcaaaagggtcttggcacaaaaattgaataataattcagcaaaacctggtaagtacaagtcgattagcggggtcgaaaatattgagaaagttatcaatattgatcaatcgccaattggtcgtactccacgaagtaaccctgcaacttatacgggagtctttgatgacatccgtgaattatttgcccaaaccaaccaagctaaaatgcgtggttatactaaggggcgttttagctttaatgttaagggtgggcgctgtgaagcctgccgcggggacggaattattaaaattgaaatgaacttcttgccagatgtttatgtgccatgtgaagtttgtcatggaacacgttataattctgaaacacttgaagttgaatacaagggcaagaatattgctgaggtccttaatatgactgtttcggaagctcttgaattctttagtgcgattccaaaaattaagcgcaaattgcaaactattgaagacgttgggctgggttatgttcaccttggtcaaccagcaactaccctttcaggtggggaagctcaacgaatgaaattagcagctgaacttcaccggcagtctcacggtaagagtttctatattttagatgaaccaactactggattgcacatggatgatatcaagcgcttattagctgtcctgcagcggttagtcgatgcgggaaatactgttttagtgattgaacatgatttagatgttgtgaaatcagcggactggttaattgaccttggccctgaaggaggagctggtggaggtaatgttgtcgctaccggaacaccagagcaagtagcagaagtaaagggaagctacactggtaaatatttaaaagagatgctcgaacgtgatcaaaaatgggcagaagaacgagaagccaagcaaaaaaagtagttgcaatctaattcttctaatggtattctaataaaaattaaagtacacgaaacgagggaaaagaaatgttattttttaataatcagaatcaacaattttcttcctcctcagcctctaacactattaaggctgagtgattttggtgtacccaatcaataggtttatacagactcgggttctctattaatcatttggcgtgaccaaattgcattaatagatgatacccgggtttttattttgcctaatattaagaatggaggaatgatgatgaatcaacaaccaacagatgaactaaaaaggtcgcttggattttggtccgctatttcgattgttgttgggacaattattggatcggggatattctttaaacaaggatctgttcttgatagtgctggtacatctacgcttgcaattgcagcctgggtatttggaggaattattactttaactggtggattaacagtggcggaaattggtgcccaaatgccatatacggggggattatatgtatatatcgaaaacttgtatgggcgccttttaggatttttagctggctggatgcaagtaattgtttatggaccagcaattattgcttcggttgccggattcatgagtattttaatggcaaacttctttggtttaggaacccagtggcgaatacctttagcagtgattacagtgattgccattggcgtaatgaacctttttgaaaataaagttggggcaattttttcgattgttacgactgccggaaaaatgattccaattgcggcaattattatctttggtttgttctgggggcatcaagatgcttttggtcaaacggttaccgaaattcaccaatcaactggtgggtttggggtagcagttttagcaaccttatttggttatgatggttggattttaatcgcaaaccttgggggagaaatgaaaaatccccaaaaattattgccacgagctatcattttagggattactgctgttcttattatttatactttaattactgttgggattcttaagttccttccagttaacactattcatcggctaggtgaaaatgcaactgcatacttagcggtgaaagcttttggcgcaattggaggaaaattgctgtcagccggaattattatttcgatgatggggactttgaacgggaaaatgattactttcccccggattgtatacgcaatggcgcgtcgtcatgatttgccattctcacgctatctcgcatatatcacgccaaagggtaagtcaccagtagtcgcaacgatgtttattatcattcttgcaacggttatgatgttcttctttgaccctgatcacttatcagatttgtgtgtgtttaccgtttattgtttctatcttttagcattctttgggatcttcattttaagatataagaataagggaccgcgcccattcagcacaccgctttaccccttagtgccaattattgcgattgctggtggaatctttgtcctcgtaagtgaagttatgaatgatcctgctggtgtaattctttttattggaatcgtcatcgtaggattaccaatcttatatattgttaaacgaatggatcaacgacggatgcattaatatttaaggctgagtttgacttggccttttttgttgctcaaataagacacacccggcttgatgtgataaaatagttgggtagctgtatgcgaaaagaggaactagtgatggtagataaaaaattaaaagtagtaattattacagggatgagtggtgcggggaaaaccgttgccgttcatagcttagaagatttaggatatttcgtaattgataacatgcttcctggattggcagaacgttttgttgatgtgatagaagattcgagagagtttgataaaatcgccatggtaatggatatgcgttcacgcggattttacgatgaggttttaccaaactttgaaaaactgaaaaaacgggctgatttagatgtgaaactactcttcttagatgctaatgatgtcacgttaatttcacgttataaggaaacaagacgttctcatcctttatctccgcaaggtcgaattcttgatggggtagaattagaacggaagctttcaactgatcttaaaagtcaagcagatatagtaattgataccactaatgtgacaccacgaaatctaaagttaaggcttaataaattattcggacaaggtgaaggcaatgacttttatgttgaagtaatgtcatttgggtttaaatatgggttgccacttgatgcagatatcgtaatggatgttcgtttcctccctaatccattctatattccagaattaaagcacttaacggggaatgatccagctgttcaaaattatgttgtgcagagtccactggctaaagaattttaccagcatttacggtcgctcttagagattgctcttccgggttacattaaggagggaaagagcagcctgaccattgcaattgggtgtacgggcggtcaacaccggtccgtaactattgctaacaaattatctgctgatttaaaagaaaagggatataaagtaaatacttaccatcgcgatattgagaaggcaaagtaaagaggagttttaattatgttgcataaaccaaagattgtagtgattggcggaggaactggtctaccggttgtccttcgtggattgcgcgatcaaaatgttgatgttacggcagtcgtaacagtagctgatgatggtggttcttcaggaattttacgaaactatattaacgtggttccacctggtgatattagaaacggtttagttgcgttatcagaattacctgatctcgaacttgatatttttcaatatcgttttaagagtagtgaccagttctttgccgggcatgcgattggtaatttaattatttctgctttgtctgaaatgaagggtggtatttttaccgctgttcaagagttatcagaaatgatgaagattaatggacatatttatcctgttgctaatgagccgttgactttaaatgctgaatttacagacggtacaaagttaagtggtgaatcggaaataacggctgcccataagcaaattaaacgggtctgggtaacaccttctaaagataatgatgggcatcctgctcgtcctgtgtcagaggttataacagcaataaagaacgcagatcaaattgtccttggccctggaagcttatttactagcatcctgccaaacttgatgatttctgaagtagggcaagctgtttacgaaagtaaggctgaagttgtctatatttgcaatattatgacgcaaaaaggtgaaacggataactttacagatgctgatcatgttcgggtattaaaccatcaccttgggaagaattttattaatacggtcttagtcaatattcaacctgttccagaaaattatcttgattttcaggaatggaatgaaatttctcaaccagttaagcatgatttccaagggctacgagcacagcattgtcgtgtaattagttcaaattttctgcggctaaaagacaatggtgccttccatgatcgcgataaagttgtagcagaattaatgaatcgacttcaccaagttcacgagtagttaggagactgatgctagatgtcatatgcaagcgaagtaaagaaagaattaacgggaattactgttcatcgggataatgcaaaggcagaattgatggcccttattcggatgaacgggtcgattggcattgctgaccaccagttagttttgaatgttcagactgaaaacccggcaattgcgcgacgaatctattcacttttaaaacaattttacggggtagaaagtgaaatcgtggttcgtcgtaaaatgaaattaaaaaagaataaccaatatatagttcgcttacgctatcatgcacaacatgtcttagatgatcttggtattttacaaaattatcaaattaaagaacaagtacctgtagaattacttaaggatgaatggatggtccgttcatatctaagaggtgcgtttttagcggggggatcagtgaataatcctgaaacttctcgctaccacttggagatatactccctttatgaagaacataatgagatcattgctcagatgatgaacaagtttggtttgaatgctcaaacaaccgctcgccgtagtggttttatcgtttacttgaaagaagccgaaaaaattgcggattttatgtcattaattggtgcaactaattcaatgcttcaatttgagaatgttcgaattgtacgagatatgcggaattcagttaaccgattagtaaattgtgaaaatgctaacctgaataagattgcaaatgcgtcaacgcgccaaatcgaaaatattgaatttattgattcacgagtaggtcttaacagcttacctgataagttgcgggaaattgcagaaacgcgattagcccatcaagaggttagtctaaaagaattaggggaattggttcctggtggtccaatttccaagtcgggtgttaaccatcgtttacgtaaattgaatgcttatgctgatgagttgcgtgcatcgcaggttaaacaataaaaaacctttgaggggactgtgacataagttaagttactttcataaaaagcaaatacgcagtacaacaatggcctctaatgtccggcaaaaccgaacgttagaggcctattgttgcttgcgggggctcgaaaacgaagtcacaagtgacatctgtctcgctcccctcaaaggttttattttatcttctttaagtgaaatttatttcttatttatactttcgctaattagtgctaattcagctgctgcgcattcttgatctaattcgttccagttagcggtaacgttaaaaacgtttaatttatttactgacattataacatcctccttgaccttatacctttattctctttcatctacattttgtatcatactacaattggtctaaaaaattaaacattataatatcggcatttgaagaatacttttttaaataggtatagttatattgctgaaattaataatgtaatagcaaagttaatcgtttgtcaaagttagataaattgttaaattttggaaatggcattcacgggatagttgttttggattaagggagacttgctttttaaaacaatgaccggtataattggaacgttaattaatttacgtttaatattaaaggaggcaaagtaacatgcgtaaagcacacccatacggcgtacaaggccgtcgcccaatcgcttcaaagtacaagcgagcattaaaagaaaagaagatcgaagctattcgtaagtgggctaaggaaaagccagctgaagaaaagtaattcagtctataaaagctatgcaattcagtgcatagcttttattttttaataacgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgttgttccgaaaccgtttatcgcgtttatcgttacctggaaaccggtgccttaattgctgattatcaagatcactagcaacgttgtggccgaaaacgtactcagttgtcactggctgaactcacttatatcaacgacaaaattgcccaggggtggacgcctgataccattattgggcgcgctgagcgcccaattagttgtaaccagcgaactctttaccggatgtttgaacgtggccagttcggcttcgatgtccgttccttgccgatgcgaggtaagcggcacccgaatggctatgtcgagcgccgcgggaaggttggccaattggggcgaagtattcacgagcgtgccaaggactttccgcactatgccactgaatttgggcaccttgaagctgataccgtccaaggcaaaaagcaccaaggggcggtaatgaccctgaccgaacgctaatcgaaggtcgaaattgtactcaatgtgcacaaaaagacggctgatgcgattaaccaacacttaagtcagcggcttcggaaattctcgtggcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgccgggatggcttaacgaaacagctagatttccgcaaccttcctgatgaattggtaacccaactgatgagtaagcgaaataacctgccccgtaaatcactaggctatcgaactccatatgaagtattcatgtcttacgtcactgatgagcaactattttctttctaacttaaattgacatttcgggatttaatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggttcgggatttaattaaatggtcaagaatattttgcaaaaaaagattaaataatagttaaaacatttgaccttttttgaccaatcgagtatagtattattatccgttagcatataagactaacgagtgctaatttattaaggaggccatattatgaatttagtacctactgtcattgagcaatcatctcgtggtgaacgtgcttatgacatctactcacggcttctgaaggaccgtatcattatgctctctggtccaattgaagacgaaatggcaaattcaattgttgcgcaacttttattccttgatgcgcaagactcaactaaagatatttatttatacattaattcacctggtggagttgttacctcaggaatggcaatttatgacaccatgaactttattaaggctgatgttcaaactattgtaatcggaatggctgcttcgatggccagtgtactagtatcatctggtgctaagggtaagcgttttggattaccacactcacaagttttgattcatcaaccatctggtggagctcaaggtcaacagactgaaatcgaaattgctgctactgaaattttgaagacacggaagatgcttaacggaatccttgctaagaattctggtcaacctatcgagaagattcaggctgatactgaacgtgatcattacttgacagcacaagaagcagtagattacggcttacttgatggtgtaatggaaaataattcaaaattaaagtaaagtgataattaaaaagatctccaattattcgattaatttcgaatgacggagatcttttttattatcaaaacgtgcgtggaaattaacagccttgtggcgactgtaatatcttaaaaatgaaaaaaggctgtcgaaaaaattcaacagccttataaaaatgcgccccccgagagtcgaactcggatctcgagaaccggaatctcacgtgcgatccattacactaagggcgcgtcaacaaatattatactatcttaaataagaatgaattgcaagcattatttgaaaattttaattaaaataacgcttacatcagaaaaatgttgtgattgaatagacaatttttttgaagatggtatcataagtatcgtaggagttgtattattgcttagaccttaccactgcgtcacttacaatggttgagagttgcgatgctgatgtaatgtgataaactaagcaagtacactaattatgttttttcctaaaggaggaatttgcagtatgactgtaaaaattggtattaacggttttggccgtattggtcgcttagcatttcgtcggattcacgaacttaacacaaatgatattgaagttgttgcaatcaacgatttgactactccttctatgttggcttacttacttaagtatgactcaactcatggtaagttcccaggtgaagttacatctactgatactggtattgttgttgatggtaaggaataccctgtatacgctgaacgcgatgctcgtaacattccttgggtaaagaacgatggtgttgactttgttcttgaatgtactggtttctacacttctgctgaaaagtcacaagcacacattgacgctggtgcaaagcgtgtattgatttcagcacctgctggtaacatcccaactgttgttcctggtgttaaccttgatactttgactaaggatgacattatcgtatcagctggttcatgtactactagctgcttggcaccaatggctaaggtcttaaatgacgaatttggtgttaaggttggtactatgactactatccacgcatttacttctactcaagctatccttgatggtcctcgtggtaagaagatgcgtaacaaccgtactgcaagtgtaaacactattcctcactcaagtggtgctgctaaggctattggtttagttattcctgaattaaacggtaagctttcaggtcacgcacaacgtgttggtgttgttgatggttcattaactgaacttgtttcaattttggacaagaaggttactgttgaccaaatcaacgatgctatgaagaaggctactaacccagcattcggttacactgaagatgaaattgtttcaactgatattatcggttcaacatacggttcagtattcgatccttcccaaactgaaattatggaaggtgacgatggttcacaattagttaagactgttgcttggtacgacaacgaatacggtttcactagcaacatgatccggactttacttcactttgctactctttaatttgaagtaaaattaaactaatttgattaaggtgggaggaggactactccgcccgcctttttttatcaagagaagaggagacataatacaatggctaaattaactgttgaagaccttcctttagaaggcaagaaagtattaatgcgtgttgactttaatgttccaattaaagacggcgttgttggtgacgacaatcgaattgttgcagctttaccaacaattaaatatgttattgaccatggtggtcgagcaatcttattctcacaccttggccgaattaaaaaagaagaagataagcctggactttcacttcgtccagttgcagaacgtctttctaacttactaaacaagccagtaacatttgttccagttactgaaggtaagcaattagaagatgctatcgacaacatgaagaatggtgatgttttacttgtccaaaacacccgttacgaagacgttaaggatggcgaatatgtaaagcgtgaatctggtaatgatcctgaattaggtaagtactgggcttctcttggtgatgtatttgtaaatgatgcttttggtacagctcaccgtaagcacgcttctaatgttggtattgctactaacatgccaggcaaagcagcagctggttacttgatggaaaaggaaatcaagttcttaggtgatgcagtagataatcctgaacgtccatttgttgccattcttggtggtgcaaaggtttctgataagattggtgttattgataaccttcttgacaaggcagacaagattattatcggtggtggaatggcttataccttctacgctgctaagggaatcaaggttggtaactcacttgttgaaaaagacaagattgacgttgctaagcaaatcttagacaaagctggcgataagcttgtattgccaattgataatgtagtagctgataagttcaacaatgatgctgatacaaaggttgttgaaggtgatattgacgacggttggatggctcttgatattggtcctaagtctgttgaagagttcaagaacgtattaaaagatgccaagactgttgtttggaatggaccaatgggtgtatttgaaatgccaaactttgctaagggtacgcttgaaattggtaaattccttggtacattaacagatgctacaacaattgttggtggaggagactcaactgctgcagttaaggaattgggtgttgctgataagcttactcacatttcaactggtggtggtgcatcattaacttaccttgaaggtaaagaattgcctggaattgccgcaatttctgacaaataattaatgtttaactactatttataattcttatataagaggctgagaaaacttttgcttttctcagcctcttaccgtatcttggtattaacaataaaatggtagataggagggtcaaataatgagagtaccgattattgctggcaattggaaaatgcataaggatgtacaagaagctgtctcttttatcgaaaaaataaaaaatcagcttccacctgccgaccaacttgaaacagcaattgctgctcctactctttgtttggtaccaatggttaaagcggctaaagaatctccgttaaaaataatggcagaaaactgctattataagaatgaaggagcctatactggtgaaacaagtccatatgctttataccaagcaggaatccatcatgtaattttaggccattctgaacgccgaacttactttaatgaaactgatgaattaattaataaaaaagtgaaagcagcattagtaaacgggttatgtccgattgtttgttgtgatgatactatgcgtcgacgagttgctggaaagaaagttcattgggtggtgagccgaattctcgctgatcttcatggattgaccaatgacgaaatttgtcatgttacggttgcttatgaacctagttgggcgattggaacaggcgagagtgctgatccagaacaagcggcggaaggttgttaccttattcgccagacgattagtgatatgtatggcgatgaagttgcaaataatgttcgaattctctatggaggaagtgtgacaacatctaatatcaatgcactaatggcaaaaaatgatattgatggtgttttagtcggagcggcgagcttaaatccagaaacatttttacaattagttcaccattaggcggttaaatgcttgtttttaattgtgtaaaataatacaatgttaagtggaattgctttccaaataaatgacagaggagagattcatcaaatgtcactcattacagatatttatgcacgtgaagtccttgattcgcgtggtaacccaacagttgaagcagaagtttacacagaagccggtggtgtaggccgcggtatcgttccttcaggtgcttcaactggtgaacacgaagctgttgaattacgtgacggcgacaagaaccgttttggcggtaagggtgttttaaaggctgtttcaaacgtaaacaacattattgctaaggaaatcgtagggatggaagttactgaccaaatcgctatcgataaggcaatgattaagttagacggtactccaaacaagggtaagttaggtgctaacgctattttagctgtttcattagctgctgctcgggctgctgctgacgaattacaagtacctctttacaactaccttggtggtttcaacgctcatgtattgccaacaccaatgatgaacgttattaacggtggtgctcactcagataacaaggttgacttccaagaattcatgattatgccagttggtgcaccaactgtacgtgaagctattcgttggggttcagaaactttccacgctttgaagaaggaattggaagctgctggtaaagtaacctctgttggtgacgaaggtggatttgctcctgactttgctaacaacgaagaaccattcgaatacttaatcaaggctattgaagatgctggttacaagccaggtaaggacattgccattgcctttgacgttgccgcttcagaattatggaacgacgaagacaagaagtacaagcttcgttggtcaactggtgaagaatacaccactgaagaatggattaactacttatccggtattattgaaaagtacccagtagtatctgttgaagacccaattgacgaaaacaactgggatgattgggtaactattactgataagttaggcaagaaggttcaacttgttggtgatgacttctttgtaactaacactgattacttgaagaagggtatccaaatgggtgctgctaactcaatcttaatcaagcttaaccaaattggtactttaactgaaactgttgaagctatcgaaatggctaaggaagctggttacactgccatcgtttcacaccgttctggtgaaactgaagacactactattgctgacttggttgttgctacaaacgccggacaaatcaagactggttctatgagccggactgaccgtcttgctaagtacaaccaattaatgcggattgaagatcaacttggtgatgttgctcaatacaagggtatccactcattctacaacttgagtcaacaagctcgtcaagacatcgaaaatcgttaattttaagcattagttaaaaatcaaaaggactatggagaaaattccatagttctttttagttacaaattatttaattaagattaaaaacgattacatcatttatattaaaaaataatgagaaagaagcgttggaatttagtataaaatataatataatctttaagagttaaatacaatgaaaggataatgatacacatgaaaaaatcggcaccagaacttaatcgttcgatgactgctggtcagatggaaatgatttcccttggtggagcgattggtgttggactgtttatgggatcaacatctacaatcaagtggaccgggccatctgttatcctcgcatatacgtttgtcggcttaattctatatattgttatgagagcgttaggagagatgatttacattaatcctggaacaggttcttttgcggattatgcaactgaatatgttcatccagtagctggataccttgctaaatgggctaacgtatttgagtatattgttgtaggaatgtctgaagtagtagcagcaactgaataccttaaatattggtggccacaccttcatacttgggtagctggaattgttattattattttcttggtcctcgctaatttagcgagtgcaaaagcatatgggtcgcttgaattttggtttgcgatgatcaaagttattactattatctttatgatcttacttggatttatgattatcttctttggctttggtaatggcggtcatccaaccggtttcagcaatctttggtctcatggtggatttttcactggtggctggagtggtttcttcttctcaatgtcaattatcgttggatcttatgaaggaatcgaattgctaggaatttctgccggggaagtagcaaatccgcaaaaagcaattgttaaatctgttaagtctgttttattccggattttaattttctacgttggcgcaatttttgtaattgtaacaatttatccttggaatgaattaagcagtgttggatcaccatttgtatctacttttgctaaggtcggaattacagctgcagcatcaatcattaactttgtggttttaaccgctgcattatcaggtgctaattcgggtatttacagttcaagtcggatgctgtttaagctatctcatgaaggggatgctcctaagatttttggtcgtctttcaaaacggatcgttcccgatgctgctatccttggtatttccggtggtattttgattggctttattattgatatgatttcggcaacttatagccattcaactgctgatatgttcgtggttgtcttcagttcttctgttttacccggaatgattccatggtttgtaattttactggcagaattacgtttccgtcgtaataataaagacttgatggttgatcatccattcaaattaccactatatccattttcaaattattttgcatttctcatgttgattgtgatcgttatctttatgtttattaatcctgacacacggatttcggttattgttggtgctgcagtattgattctagcagtcactgtataccttgttcggcatggttttaaaaacgaaaaagcataagataaataagaagctaggaaaaaatccctggcttctattttatttttaaattaatttcgtctcactaagctcatgtagtacaatggcatgtagacttttaataaattggagaagaacaatggagagtagaaaagaggtatttcatcgctataatcagttcaatcaactaattcgggcgatcattattggaatattgactggtttagtagttagtgtatttagactcataattcaacactttttacaattagtaacagcaagttttgcatattttcattctcatccattatggctaataccatggacaattggatcaattattttagcattattattaggatggttagctcaatcctatcctgatataaaagggtcggggattccacaggttgagggacagttgactaaccaatttgatgaaaaatggtggccagtgttatggcgaaaatttctcggcggagttttcgccattggatctggattatatctcggacgtgaaggaccatcaattcaacttggggcaacaattgggcaaggagtagaggaaaaggccaaagtagggcaccttaatcgccaaatagggatcgcaagtggagcagcagcaggattatctgcagcctttaatgcgccaatcgctgcgactatctttattttggaagaagtgtatcataatttttcaccggtaatttggttggcaacatttgtgagttcgctttgttctaatatggtttcgatgcagttttttggcttacgaccggttttgaatgttccttataatcatatgcttcctaataatctttattggcatttgatcgcgcttggtattttattaggtatcttagggcgtctttaccaaattgttattttgcatttgaatggttggacggcacggattcctaaactatctcctattgcttatccaattattccgtttttgctggttattcctatcgcctggtattttccaatcacgttgggcgggggaaatgaattaattattattttacgttccttgccattttctttagcgctttttgtggggctttttgtccttcgctttgtattttcaatgattagttatggttcgcaattaccgggtgggatatttttgccaattttaactcttggcgctattttaggcgcagtctattgtgcgttaatggtccgtttgggattaatgccagttcgatatttacctaattttattatctatggaatggcaggttattttgcatgtattagtaaggcgccatttactgctattttattaattactgaaatggttggctcacttgcgcacttaatgccattagccttggtagcagtagtagcttatcttgttgtggatgcgttacacggtgaaccagtatatacagcaatgtttaacgcctttattggaaataatccgcaaccagcacgccataaagaggatgttacgatgtcgattaccatttatgctggcgcccagttggatggttgtaaaattaaagattttccatggccaactgattgtattgtgatggttgtctatcggggagaagaaaagatcattccgaatggtcaaacaaagctgcaagctggcgatacgttaattttgcgggctaattcagcaactactagacaagtttaccatgagataagtcgggctgcgcattatgcacaaggatagcaatagaataataaatatgatatgataattaagataaaagcgtgaaagtattaggaggaaaaatccttgtataacacattaatgactttattcttaattgattgcgttgtattaattgcttgtgtaatgatgcagccagcaaaaaacgataatgatgcaatgtcagctttgacaggtggtgcgggtgacttattctcacgtcgtaaagcgcggggatttgaagctgttatgcagattgttacaacaatttgtggagcactcttctttattctggcattagcgatgatttacgtttcgtcacattaaatttaaagtgcctcctgaaattattgtgattccagggggcttttttgacgctacggttggagtgcaggggatgatgtagtgataacgtatactggtgagtcttttttctttccccatagtggacggcatggagttattttgcttcatgcatatacaggaaatacgaatgatgttcgaatgctgggacgtcagcttaactggcaaggatatacggttttcgcaccgcttttgcatggtcatggtggtgatccgcaaaaggtgctggaaagcaatggcccagatgattggtgggatgatacccggatggcaatttttcgtttacgagatgccggagttgatcaaattgcaatttttgggttatcgcttggtggtttacttgcaacaagagctcttgagaatgatccgcaattattaggtggtggtgtttttgcatccccaattaccacctggggacaatcgaatgttccggaatacttccctaaaattgcggcaaagtattatcgtcagcaaaaaatcaacccattaattactaaggaaaaggttgctaaattgactgaacgactcccccaacaactagcacaaattcaaacaatggcgcatcaaatttgtgaccaattagatcagattcatcagccattctttattgcacaaggaggcacagatgaaatgattgatccagcgtctggactgcaattaaaaacaaaattacaggagaatggggttgcagttgattaccattactacccaaccgctactcacttattaacagttaataccgctcatcgtcaactatttgccgatgtagaaaaatatttacaaaatttattcgaggtgccttctaatgacaacaaataatttaaaagaaaaaatattaacacatttaacagataatgcaggtgtgagttactcagcagaaaaacttgctcatcaattagggatggatgatgctgagcagtttacaccgatcgttcaatctcttgctcaattggaaagagagaaaaaggttcaagtaactgatcatggtgaattcgaagcagttattaaacagcaaccacttattggaactttccacggaaacgataaggggttcggttttgtagactatgaccctgatcttccagacatgtatattaatcctgatcatactttgcatgcattaaatggggaccagatagaagttaaagtattacgtccagcaaaagcaggtagtgatcagggtccagaaggtcaagtaacccggattgttgaacataaatatgaaaatgtagttggtgaatttaagcaagcgactatcggcgatgattacattggtgaaattttgcttaaagataagaaattatcgcagtatcatttctatgtaacggacaagggattaaaaccacttgacggccaagtagtaacagctactgttgagacttatcctagtgatgaggcaccggaagtaatgacgggtgccgttactgaagtgattggtgataaggatgagccgggtattgatattatgtcagtaatctatgctcacgacgtccctcatgaattccctaaagaagtgatggaacaagctaataagattccgcttcatgttctcccagaagaaaaaaagggtcgggtggatattactgaccaaccgcttgttaccattgatgcaattgaatcaaaagacctggatgatgcggtggtagcttggaagatggataatgggcactaccaccttggggttcatattgcggatgttactcactatgtaaagccaggtacaccgcttgatcaagaagcatttaagcgtggtacatctgtttatctaactgatcgggtagttccaatgcttcctaagcggctttctaatggaatttgctctttaaatcctaatgaagaacgtcttgctatgagttgcgaaatggaaattgatgagcaagggaaaattgttaatcaccgaatcttccaaagtgttatgaaatcacatgcccgaatgacttataaagcagttaataagattctggagtcgcatgatgctaaaacgatgaggcaatatgaagatctcgttccaatgtttgaaacaatgggggagattcacaaattactgcttaagaatcggaaaaaacgtggtgctattgactttgaagctcctgaagcaaagattattgtggatgaaaagggtcacccaactgatattcaactacgagatcggggactttctgaacggatgattgaatcctttatgttagctgctaatgaaacagttgctgaacactactttaaggaacacgttccattcctttaccggatccatgaaacaccagatagtgaacgtattaaatcatttgtggactttttagctgtgtttggaattgaggttcatggtgatattaagaatgttaaaccagggatgcttcaaaaagtattgaaggatgtggctggtactcctgaagagcaaatggttcaagtgatgatgttacgtagtatgcaacaagctaaatactcggatgaagagctaggtcactttggcttaggcgctaaatactacactcactttacttcaccaattcggcgataccctgatgatacggttcaccgtttgattaagtggtacgaagaacatggtaaaaacgaaccagctaaggaccattggcgtgataagcttccagaaattgctgaacatacttcggttaccgaacggcggggaattgataccgaacgtgatgttgatagtatgaagaaagccgaatacatggaagaccatgttggcgaaacctttgatgccgtcgtaagttcagtgatgaagtttggtttgttcgtcgaattgccaaatacagttgaagggttagttcatattagcgtcatgaatgatgattattatgaatattcagaaaaacacatggccttaattggacgaaactctcatcgaattttccaaatgggacaacctattaaggttaagttagttcgggcagataaagatcttcgtgaagttgattttgaaattgttaaccctgaagaagcaccaaagacaaagattcgggtcccacgtaatgatgaatatcggggtcgaggtcgtggccgcaaaggacgtgccaataataattcccgtcatgagaacactagcagtaatcattaccgtaatactcaaggaaaatggcgtcgaactcaccaagaaaatggtcgtcaaaataatcgtcaaataaatcggggacaaactcgtcaccacaataattcacgtgatcatgaaggcgtttgtcgccaccattaagagcggggagggatattatggcaaaaaaatcccatcaagaaaataatgacaatttaattgcacaaaataaaaaggcacgtcatgattattttgtcacggatactgttgaagcaggattagttttaacggggacggagataaaatctgttcgtgctcaccgggtgaatttgaaagatggatttgcccaagttcgtaacggtgaagcttggttaatgaatgtgcatattagtgagtatgataatgggacttacttcaatcaagatccattaagaaatcgcaagttgctattgcacaaaaaggaaatcaataagcttgtaggagctttacaggataagggagttacgcttattcccttgaaaatgtatattaaacacggctatgcaaaagttttattaggactagccaaaggtaaacaccagtacgataaacgtgaagcaattaagcgtcgtgaacaaaaccgtgaaattgaacgagttatgaaacattattaaaacgaaaagcctaggtgaaaatcacaaattttcacctaggcttttcactttaaaatctatttgtttctacgttctttacagtttaagtttaactgattgctaattgaaaatgacatgctggtattaagattaggggaacgcttcattaatcgtgctaataaaggttcttgttcacttcgtcgagcccaatggttaagaatactagcgattagaattgctaaaggttcatcttcttttttatttatctttaattcatgacaatatccgcttgatagtttaacgggttgaattgaaaaaactaagtgactaccggaaaaaacacggtaacggcttgttaatggtgaaccaacaacgatccagttaataccgcgtatataaataacctgttgaacaaatccaagacctttcccaattgttccaacgcgttgtcgattaacatataatgcgaatttgggtaacagtccaagagttaattgctttacttcagctaataaggctccatcaattgcatacaatgatagggcatcgtacctcattccccacttaccgacaagaagatagcacgatttaccattcttatcgcgaatgacggtcgttccatgtaaatcacttgaacgatcgcgaatatataattgtcgcactttgccaccaccattctttgataatctaccttttattttaccagcttcttagcaaatttggtgaagaaacttctaagttaaaaaacgcttccaatttatcccatgatgatgtttaattatgctaaaataataggcgaggtgctaataatcgtgaaacaattaattcataacgactggtgggaagttttaaagccccagtttgaaagtgcatattatgcgcaattgcataatttcctaaaagaagaatatacccatcaaacgatctatccagaaatgcatcatattttcgaagcatttgaatggactccttttagtaaggttaaagttgttatccttggtcaagatccttatcatggaccaaaccaagctcatgggtgtagtttttcagtactgcctggggtgccggtcccgccttcattacagaatatttacaaagaattgcaaagtgatttaggttgtataccggtaaatcacggctatttaaagaagtgggctgatcaaggcgtcctgttattaaattcggttttgacagtgcgagcagggcaagcatattctcaccgtggacatggctgggaacaattaacagatgcagcgattcatgctttatctgaacgtcctaaaccagttgtgttcatcttatggggacgggctgctcgaaataagaaacagttaattaatacgaagacaaatatcgttcttgaatcagctcacccgagtccattatctgctaaccgtggattctttgggtctcgaccattttctaaaacaaacgaagcacttcaggcaatgggagaacagccaattgattggcaactgcctgccaaaccaaattatcgttaaagatgtgattgttagtcacaactttaaaatgtttagtgaccataaggaggtacttgcattatggaattatttgatgagattgctgcaaagattaagggacaaaacaagaccattgtttttcctgaaggtgaagataagcggattttaggagctgctgtccgtttaaagaaagataatttagtagagccaattttacttggtgatgaagaagcgattaaagaagttgcaagtaaaaatggttttgatcttgctggccttcaaattatcgatccagcaacttatccagaagacgataagcaagcaatgtttgactcattaatgaaacggcgtaaaggaaagaatacccctgaagaaattcaaaagatgcttgaagatgtgagctactttggaacaatgcttgtttatatgggaaaggctgatggaatggtttctggtgctgttcattcaactggggcaactgttcggcctgcattacaaatcattaagactaagcctggtgcccatcgaattagtggagctttcctcatgattaaaggcgatcaacgttatatctttgctgattgtgcgattaatattgaattggatgccccaacaatggccgaagtggcaattcaaagtgcggaaacagcacgcttatttgaaattgatcctaaggttgcgcttcttagtttttcaactaagggttctgctaagggtgaaatggttaccaaggttgcggatgctgctaagctagttcatgaattagatcctgatttaccagctgatggtgagttacaatttgatgctgctgttgtcccatcagtaggtgaacttaaagcccctgattcaaaagttgctggtcatgctaatgtctttattttcccaagtctggaagcagggaatattggctacaagattgcacaacgatttggcggttttacagcagttggtcctatccttcaaggacttaacgcaccgattgcagatctttcacggggatgcagtgaggatgatgcttataaggttgcaatgattaccgcagcacaagcattgtaaatattgatgaaaaggaagtgggactaaaaactcgcaagcgagtttagtcccacttcctttgctttttaaacatgagatgggtacaataaggctagtattttaaacttggagagagtactatggagagcttaacgttaacgaatcgtgacgcaacaattgcccttggaaagaaaattggtcagcaattagttgccggggatgtgctagtcttagacggtgatttaggagcaggcaagactacttttaccaagggattggctgcagggttagaaattcctgatatcattaaaagtcctacttttacaattattcatgaataccaagatggccgtctccctttataccatatggatgcatatcgcttagaaaatgggggagcagaagacctcggacttgaagaatactttgatggtgatggagtttcagttgttgaatgggctgaatttgttgaagatgaattgccagctgactttttagctattcacttcaagcgaacaggtgatgataatactcgtattctggaatttgaaccccatggacagcattttgaccaaattgtaaaaagcgtggtgaaacaatggcagacgacatttcgataaagttagcaacgagtgaggatgccggggctgttttacaatttctacgggcaactgcaactgaaagtgacgcggtattagttccgcatttaaatgagattagtgaaaagacagaagcaaaaaatatcgatttaataaatcaatttgatgattgtgttattttacttgcgatgctcggcgaagagattgtggggatggttactgtaatggtattagatcatcaaccgacaaccggtgaattaggagtcgtggtacggaaaaagtattggcgaaacggaatcggtcgcttattagttgatgaagcagagtattggtttaatacttatagtagtttagaaaatttgatcctgacagtttttgaggataatattccggcaattaatctttatcagcaattacactttgttacaatagaaaaaacggttgagcagggtcgtaatgtcctgcaaatgcaatacgataataaaaaagaggaaacaatggaaaagtaagccattatttcccctttcttgtgcgcccggcatgggtattagctaggtggtgaaagtccgctatgggccgtagtagtcggaaccatgagctgaggacaagggtgtccaccgtgaggtggaatttgaaggaagtctaaggcaaagtactgcatcgatgaacaagaagtagctataaggctgaaattaactggataaggctgctagacaagttgaagtccaatactactcgaagttggtctcagtaaagctaacgatgacatggtacgaaagctaatattcttacccggggagatctggcctacacgtttccgacaagaggaataagtttaatttccacagaaacaagcggtgcagtgatgcagtgttgagtaagccagaagtcagccgaggtcatagtagtttgaataatcagatgaaggactgaacgacaataacttgtaacttatatcggagatgtaatcaggtgcgacaatcgcagaaaacagaacaacaagctgaccgcttgtcgaggataggtttggaaaaccgaaagtacacaagggcgcgtagtaccggttatggtgaaggtaaaggtatgagtgtcactatccaagacctggtcttagatcgcaataaccttaatcaggcttatttgcgagttaagagaaataaaggagcagcaggcgttgacgatatgacagtcaatgaccttctgccatatctcagagaaaataagacggaactgatcgctagtttgcgtgagggcaagtataaaccagctccagtcaaacgggtagaaattccgaagcctaatggtggagtaagaagacttggaataccaacggtggtggaccgaatggttcaacaagctgtagcccaaattcttacgcctatctttgagcgtgttttctctgataatagttttggcttccgtccccaccgtggggcccatgacgctattgcaaaagtagtagatctttataatcaaggctatcgaagagttgtcgacttagacctaaaagcctattttgataacgttaatcatgacttgatgattaagtatctccaacaatatattgatgacccatggacactaagattcattcgtaagtttctaactagcggagtcttagaccatgggcttttcgctaagagtgaaaaaggaaccccacaaggagggccattgtcaccactactggcgaacatctacctaaatgagttggacaaagagttgactagacgtggtcaccactttgtgcgctatgcggatgattgtaacatctatgttaaaagtcaacgagccggagaacgagtaatgcgaagcattacccagtttctagaaaagcgcttgaaagttaaagtgaacccagataaaaccaaagtcggtagcccgctacggttgaagtttcttggcttttcgctgggtgtagaccacaatggggcctacgcccgtccagctaaacaatcgcaacaacgagtaaagaaagcactgaagttattaactaaacgtaatcgtggaatatctctgacaagaatgtttgaagaaattcatcgaaaaatgcgtggttggcttcagtactactcaattgggaaactaactaactttattcaacgccttgacaagtggttgagggtccgaataaggcagtatatttggaagcaatggaaaaagtttaaaactaaggtaactaacttacagaagttggggctgtcccagcatgatgcatatgtcttcgctagtacccgcaagggctactggcgaactgcacatagtaagaccttgagctattctctaactaatagaaaactggaacaactcggacttatgaatatgtccaagacgctccagtcaattcaatgtgattaagttgtcgaaccgttgtatacggaaccgtacgtacggtggtgtgagaggtcgataatcgaactaatcaattatctcctactcgattgtacatatgtttattttttatgtaggacttgcataatgtttcgccagaaggatccctttgtttgctgtttactaacgtcttgtgttacctctacacatccgaggtatttattttgatcatcacgtaaggcgtaaaaagcaatatttacaggttgaccatgatgcttgatcataatgctaattgaatcacggtctccggtatgcatatcatgaagtacttgcttaacatggccttgactatgcccgggatgaacctcaagcacatgtttacctaagtctgcatccgttcgcttgaataaacgatgccgattagctgatgaccagcgaatgatatcattttcatcaatgaaatcgaattctacggggatggtttcaaaaatagtattaagttgttcaatacttagttttccacctttaagattaatatctgtcatgattatctcctttagccgattaaattaataaagggctgaatctgttgtggggtaaaatgcttgctttgataaagcagaatgttagcgcaagcctgggcatcatcaagagcattatggtggtgatgaaggtcaatatttaacgcgtcacaaacagtattaagtttataatttgttaatcctggaatcaactggcggcttgaagcaacggtatcgagcgtctggtaggcggggacttcgatattgtaatgttctaacgtattccttaaaacgctattatcaaatcgattattatgggcaataactaatttatcaggagtgtagaattggttgatatgttcccatacttctggaaaatcaggcgcattttggacgtcacgttcatgaataccgtggatctgtgtattacgccaaaagaatttagtatgaggattaattagggtgtaaaattcgtcggcaatttgtccattccgaacgattgtgagtgcgagcgaacatgcactgtaacgcttaccattagcagtttcaaagtccattgctataaaattcatcatacatcctccttgcaaaagtcgataattttattttacaatcaactaatcatttttcaaaacttttacttttgaaaaatgatacaatagctcttgaaagtaaatataaaaaaggaagaaatagagaatggctaatttgatgaacgaatttcctgatattgaaattaaacaagatgaaccattaatgaattacacctatactaaaacaggaggtccagctgactggttggcttttcccgaaacgattgaccaggtaaaaaaattggttgattatgttcgtgagcataaaatgggcttaacggttttaggaaacgccagtaatttgattgttggcgatggcggtatagatgatttaacaattattcttacgcggcttaataaaattgaagttcatgataataaggtaacggcacaggcaggagcatcttatattgcaacaaccgaggcagcccgtgatagtgaacttactggattagaatttgctgctggtattccgggcagtattggtggggctgtcttcatgaatgccggtgcatatggtggtgaaactaaaaatgttgtttctgaggctaccgtaatgcttcccgatggaacgatcaaacactttactaatgaagaattggactttggttatcggcatagcagtattcaagataataatggcgtcgtgttagatgctacgtttgctttggaaccgggtaagtatgatgatatcaaagcaaggatggacgacctaaatgaacggcgagaggctaagcagccattagatctcccatcttgtggaagtgtctttaaacggccagaaggatattatgccggaaagttgattcatgatgctggattgcaaggatatacttcaggtggagcgcaggtttcgactaagcatgccggctttatcgttaatattgaccatggaaccgcagcagactacgtaaatgttatccatcatgtccaaaagacagttaaagaaaaatttggtgttgatcttgaaaccgaagtaaggattatcggccggcaagattaaaaagataaagtgtaagtttattaaaagattattaataagcttgcacttttattattttaaagatagtgaagtgatgaatgaatttaacttaatagttaggtgccgttaaaaagggaaaaaataatttaattgatcttattatttgctaattatgaaaaaatctcacaaattgctcattgaaaaattattattatggatgaaaagcgattccaaaggattttgaagtataccgattcactgactgataaaaataactttgtaatcactttcaaaatatgataggatatttaagtctcatttttgaaaaaattcacaaagtaaggagtatatttatgagcaataatgtagttgttttaggaagtattaacgttgatactacttatcacgttgatcgcttccctcaacctggtgaaaccatttcagcagtaagtaagagttctgctcctggtggtaagggtgccaatcaagcagttgcagcagcccgctctggtgccaagacggcttttattggggcagttggttctgataaagaaggagcttacatgcttgaatcattggctgatgatcatattgatacacgccatatcatgactgataagttacatggcactggtagtgctgcgattactttagatgctaatggtcaaaatgacattatggtatatggcggtgctaatcaagcaatgaccactgatgttcttgcaggtattgatgatgttttagaagatgctgactttttaattagtcaatttgaaacaccacaagaagtggctttagatgcatttaagcaagctaaaaaatacggtgttactactcttttaaatccagcaccagctcatgagattttaccagagttattaaaatatacagatgttattacgcctaatgaaagtgaatgcgccttattaacaggtattgaaattactgatgaagaatcaatgttaaagagtgctgattacttccgtgaacggggagttaagcaccttttgattactttaggctcaaaaggagtattttactctacacctacagctcatggattagttccagcatttaaggttaaggcagttgatactacagcagctggtgatacattccttggtgcattaagttcacaattagaaaaggacttatcaaatgttgacaaggcacttgtctacgcacaacgagcatctagtttgactgtccaacaaatgggagcaatgccttctattccaaaccatgatgcggttataaaagcattagcagaaaattaaggagtactatcatgaagaaaacagggattattaattcagaagtttcagctgtcgtggctaatatgggacatatggattggttatcaattggtgatgccggaatgcccgttccatttggtactaagaagattgatttggctgttgataaggaattgccaagctttatggacgtattgaataatgttcttaaggaaatgaaggttcaaaagatttacttagctgaagaaatcaaggatcaaaatccagaacaacttgaaaatattaagaaggcattaccagatgttgagattgcatttatgcctcatagtgagcttaagaagagtcttgctaagacgcatgcctttattcggacaggggaaatgacgccatactcaaacattatccttgaatcaggcgtaacattttaatattaggggttagttttttatggaaaatgaagtaaaaaaagataagggacaaagttgggttcaactgtcagacggttatttaagtcggacaccaatgttccaatttgttattttatgtttaatcttcccattatggggagcagcggccagtcttaatgatattttgattacacaatttaagacggttttcaccttaaatgatactgcaacggcctttgttcaaagtgccttttacggtggttatttcttaatggcaattccggcttcaattcttattaagaagacatcatataagttagcaattcttattgggctattattttatattattggttgtggaatgtttttcccagcttcacatgttgctacttatagtatgtttttagttgctatttttgctattgctattggtttgagttttcttgaaactagttgtgatacgtatgcaacgatgtttggaccaaaagaaactgctaacaaacggttaaacgttgctaatgttttgattcctcttggtgatatcatgggaatcgttcttggtaagtaccttattttcggtgaaggtggaaacattgccgacaaggttgctaagatgtcaaaatctgaggcagaagcttacaatgaacacttgcttcaattgactttgcagccttataagtacatcttgattgttttaatcatcatctttatcgttttggcagttactaagatgcctcgcgctaaggccttctcaactggttctgaaactaaagaagaccaaccatcacttggcgaaactttcaactacttattccacaataagcggtacatgaaaggggttctctgtcagtttatttatgctggtatgcaaacgactgtatggtcattcactattcggttagcattacgccttgattctcatatttctgatgcagctgcttcaactttcatgatctatagttacatcgcttggttctttggtaagttagttgcaaactggttccttgaccgttactcaattactaaggtattaacttggttctcattacttggaacaatttcattagtaattacctttactgttcctaacatcacagcggtaattgcggcaatcgcaactagtttcttctttggaccagaatggccaacgatctatgctcatacccttgatcaaattcatgaaaagaagtacaccgaaactggtggtgcatttatcgttatgtccttaattggtggggcaattgttccaacaattcaaggacgggtatcagatttaactggttcaatgcagttatcattcattgtcccagcaatttgtttcgcacttatcactatttacttctggactgagcaccgttgggaaaaggctcatccaaatgaagtgcaagaacactaaaatttcccaggaaataaataaaggcccagcggttatttaatcagctgagcctttatttatttccaaaactttaaagtaatttttttctagattaagctaaacacgaaatgaaatgatataatatgaacgtgatttagaggatggtgaatgcgatgcaatttataatttcgcttctaacatggcagaatctgattcacttaattgatatcttagtaatttggtttttaatctacgagttattaatgttgattcgtggtacaagagctgtccaactatttcgtggtattctgatcattattttggttaagattgttagttggtatgttggtttaagtactgtttcgtgggtaatggaccagattatcaactggggtgttattgcaattgtcattatcttccagccagagattcggcgcggactggaacaccttggtcgaggaactttctttactcataatcaaacagcaaatgagaaagaagaagatatgattaagcaattagaccaagcgattcagtacatgtcaaagcgaagaattggtgctttaatgagtattcaaatgaagactggtctagaagagtatattgaaacaggtattccactcgatgctgatatttcaggggcattacttattaatacttttattcctaatacgcccttacatgatggagcagtgattataaaaaataatcggattgcagtagcggctgcttatcttcctttgtctgatagtaaattgattcctaaagaattagggacacgacatcgggctgctgtcggaattagtgaagtgacagatgcattaacaattgttatttcagaagaaaccggcgaagtttcaattacgaaagataatgaattaattcgaaacatgtcgcgagatgaatacctaaagttcttacgtgctcagttgtatacgcatgagcctcaacacgaaaacttggtaacagaactttatgctaagtttcaacgtaaaggaggtggccgtcatgggcaaggacactaaaggcttctttcgccggaaatggtttttgagaattatttcgttaatcctagcactctttctattcatgtatgtaaatgggagcaaaagcggcttccttcgtcaaaatactcggaataataaccagagtagtgctttaatgtcgaataaatccgttacccttcgaatgccccttgatgtaacaattgataataataagtatattgtcagcgggtatcctcaatatgttaaggttaaggtaaccggtccttccgcattggttacaactacctctaatactcaaaattttaaggtgtatgcggatttgtctgacttgactcctggtaaacaccgagtaaagttaaaaacgagtgggttaaattcagaattaacttctaaaattgagccacaatatattaatgttaatattcaaccacgcaagacgattacaatgaaagtaactattcgtttgagtactagagatttggataatggctataagcttggacgtccacatagtgatattcagactgtccaagttactggttcacgagatgaagttaataaagtaaatcgaattgttgcttttgtagcaattccgcacgatgcaaaggatagtattgcacgacaggtaacactacaagcaattgatcggaatggtcaaacacttaatgttgtgatttcaccaactactactaatgtttctattcctatttctgcgggttcacaaagcagcagttcaaatgatagttcatcaagtagtagtggtagtgaagagagtgaagaagcaaagagtaattcaagagcaacatcgcgaaatgactcttcagattcttcatctgaaacatcccaatcttcaagcagcataagtaatgaagattcaagttcaagtagtcgaaatcaataataaagatacacatagaggagaagtgaaatgaagttaaaatattttggaactgatggagttcgtggagttgcaaatcaagatttaagtccagaattggcgttccgtgttggtcgcgcaggtggatatgtccttactcggcactcggaacgaaaacaacctcaagtattagttgctcgtgatacacgaatttcaggtgaaatgctagaaaatgcattgattgctggattattatccgttggtattgaggttttacggctaggggttgtcactactcccggggttgcttaccttgttcgggcacaagaagctgatgctggagttatgattactgctagtcataacccaattaaatataacgggattaaatattttggtggtaatggatttaaattatccgatgaattggaatatgaaattgaacaattactagatgctgaagaagatacgttgccacgaccatctgatgcaggcttaggaacagttgctgattatcatgagggagcattaaagtacacttcattcttggaacaaactgtttcaagtgatcttgaaggattaaaagtggtagttgatgctgctaatggtgcaacaagtggctttatctctaatctttttgctgatatgaatgtggactttattccaattaatgatcaaccagatggcttaaatactaacctaaattgtggatcaactcacccagagagcctccaaaaagcggttgtggaaaataatgctgatcttggagtagcatttgatggtgatggtgaccgttgcattgctgttgataatgagggaaatattgttgacggtgataagattatgtatatctgtggtaagtacatggataagaagggattacttaagaaagatacagtagttacaactgtgatgagtaatctgggaatgtacaaagctttagaagcgcacaacttaaagagtgttaagactaaggttggtgaccggtatgttgttgaggaaatgctgaaaaatggttataaccttggtggtgaacaatcaggacatattattttcttagatcacaatacaactggggatggaatgcttaccgcactgcaactcttgtctgtagttaaagactctgggaagacactcgctgaattggcaaatgatgtaacaacttatccacaagagttattgaatattaaggtagcagataaaactactgcaatggaaaatcaaaaattaaaggaaattattgcgcaagtcgagaaggaaatgaacggggacggacgggttcttgttcgtcctagtggaactgaacctcttttgcgcattatggctgaagcagctacgccagaattagttcatgaatacgttgaacggatcggtgatgttgcccgcgcggaattagaagtagaataacttgagaagtgaaaaagcgaggctggaagaaaatttattcttctagtctcgctttttaatcttttaataaattttaaatcatatagaccaatctaataaaataattgacaagataatctaaaaactgtactatacaatacagttgattagatctagtgataatcactagttatctataccaattttatttaaaggatggaatttaattatgtgtggaattgttggagttacaggaactgacaagagtttgtcaattctaattgatggattaaagcgtcttgaatatcgtggatatgactctgcaggagtttatgttaatgatcaacaaggacatgattaccttgtaaagcggccaggtcggattgctaatctagaagcggctcttggagaagaagtccatggtttagccggtattggccatacccggtgggctactcatggtgaaccaaatgaagccaatgctcaccctcaatactctcaagacgaacggttctacttagttcataacggtgtaattgaaaattatgctgacttaaagaaagaatacttatctgacgttaaatttgttagtcaaactgatacagaagtaattgttcaattagttgataaatttgtagttgaatctggaatgtcaacagaagcagcccttcttaaggttcttcgtttaatcagcccagattcttcatatgcatttgtattgatggataaagaacaaccagatacattatttgttgctaaaaataagagtccattattagttgggattgctgatggttacaacatggttggttctgatgcaatgtcaatgattaaggaaactaatacctttatggaaatcggtgaccacgagttggtaatcgttaagccagatcacgttactgttaaagactttgatggtaatgagattgatcggccaacatttaaggttgatatggatgctaatgccgcagataaaggtgcttacccatactacatgttaaaggaaattgacgagcaaccagctgttatgcggaagttagttcaagaatactttggtgacaatgatgtagcacagattaatgaagagatgttaaaagatatggcagatgctgaccacctttacatcgttggtgccggtacaagttatcatgctggcttagtaggtgcgcgcatttttgaaaaactttgtggaattcctacatctgttcacatttcatcagaatttgcttatgagcaaccactcctttctaagaagccgttctttatcttcttaagtcaaagtggtgaaacagctgatagtcgggaagtactggttaatgttaataagcataactggccaagcttaacaattactaatgttgacaagtcaacgctttctcgtgaagcaacttacactgaattactttacgctggtccagaaattgccgtggcttcaacaaaagcctacactgcccaaattgctgtcgaagctattcttgctcaagcattaggcgtttacatggataagcaagcagctaaagactttgatgttaagcaccaattaggattagttgctaatggtatgcaatcaattactgatagtaagaagaaagtcgaagaaattgcttctcgttacctctctaaatctccaagcgccttctacattggccggggaatggattggtcagtttcacttgaagctgctttgaagttaaaggaaatttcatacgttcaagcggaaggttttgcatctggtgaattgaagcatggaacaattgctttaattgaagatcagactccagtgattggaatcattacccaagatcggactgctggtttaacacggagcaatcttgaagaaacgcaggctcgtggggccaatgcaattacaattgtttcacggcaccttgcaaaagaggacgatacattcgttcttcccgatgtcgatgaagtgttgacaccacttcttagcgtaattccagcacaattgttggcttactacactagtcttggtaagggacttgatgttgataagccacgtaacctcgcaaagtctgttacagttcaataaaaattataaaggaagttagagaagctttagttggtttctcaacttctttttatttttaaagtaatttgatattttctttagatttgtttaataaaagggttgacttacttttatggaaacgctaccatgatagttgcaaggtataaaataattaccttctaatcaattctctttctctcttatgccgatcatcgtcttttagacgatgatttttttatttaaactcgctataatgataagggttgaaaggggaagaacaacgtggaagaacaacacgaaacgttaacattaattgaggaaattacccgtaatgacggctcaaaatattatgaaattggtaatatggttcaaaatggccgtgcagaattagcagctgaacggaattttattaaagaggttcgtattttagaactaaatatccctcattctaaaaatattattaaatatgaacactttataaatactcactataagatgcaaaccgaagcaatggatcattgggaagaatggaaacgtcccccagagattgaagaggttgttcaaacgatcttgaaagaaaatcatattgggtaaaccaggaagctgagttatttggtagtactaaaaatggatataaaaatgtggaggttaggcaatgaagccaaattttaatccatcacaggggatgaagtcgcactatttcgttacagggatagacggcttacgaacattagctgtcttaggagttattatttatcacctattgcccaatgttttaatgggtggttatttaggagtgccgctttttctattagtctctggatattttgtaacctatcaatttagtcggcagcttaaatatggtagtcatattaatttagggcatttttatctaaaaaggtttcggagactatatccgacattaattgcgatgttaattttaacaacagcgtacattacattatttgcacgagagctactccataacattcgggcagtaattgttactaatttaacttggatatataattggtgggaaatcagtcatgggcagtcctactttgatcagtttggtggcgtttcaccttttacccatctttggacattaggggttgaagcgcaattttaccttttgtggcctttgattattacgttattgtttgcggtttttaaaaagctacagaatgtgcggcgggtagttttcatattagctgtattgtcagcaatagaaatggctcttctttacgatccggcaaatatcaaccgggtttattatggaaccgatacacgggccttttcacttttacttggctcatggttagggcttgcgtggccattaaatcgacttcggcctaatttacaggcaaatagtcgccggttacttaatattataggaattattgcaacagttttgaccattgttggttttttctcattgaatggacagtccgcctttacctaccgcgggggaatgtttctctatagttttattggaatgatattaatggctactatcattcacccaggtgcggggatgaacaagtggtttacaaatccggtttttcattgggttggccagcgttcttatgggatttatgtttatcaatatcccgttatggtcttttatgaacgagtaatcaaagtcggcaatcatccacttctcaatgcattagtagaaatcattattattttagtagtaagtgaagtttcttaccggttaattgaacgcccatttgctcagtatcagtggtcaaaattaccggctgatctccagcatgtgttagaaacgcatcactttagttggcaaagcggggctaaaatgatggtaagtgcattagttgttgttattgcatttatcggtttgtgccaaccaaaccgtgcaccaaagaaaacagcggttcaacaacggatagagcaaaaccaccaggctgctgaagaacacaataagaagattacaaagggggataatgttgcggaagctagtggtaatacttctaagcttcagaaacagtatgatttaacccctgcacaaataaaagcagcgcagaagttaaaggtaacggccatcggtgattcggtgatggctgatgccgcagatagtattcagaaattaatgccaaatacttatgttgatgcacaagttgggcgtcaaggttctgccactcctgatgttatcaaacaattaaagacagatgggcatttaaataagattgttgtcttgaatttgggaacgaacggccctatgacacaagatacgttagacgatattttaagtacgattggctctgggcaccagatctattgggtaactgctcatgttccaacaaagccatggcagcaaacggttaataacgaaattaaagatttagcaaagaagcataagaatatccatgtggtcgattggaataaggcaagtcaaggacactctgattggtttgcaagtgacaatgtgcatatgggaccaagtggaaatgatcattttgcacggctaatcgcaaaggagatcttgacaaaaaaataggaggttagtaatgacacacgaagatcaattattagacaaagctatcaatatttacttaacaggattaaagggcatcgaaagctttatttccgaaccagcgagtgaatataatttatcttttgaacaattcttgattttacgaaaaataattaaccatcctaatatcaaactaatggatattgccgagcaacggcaagtaacaaggagtgccgtctctcgccaattaaaagttctttttcaacaaaaatatgttgaacaaaaagctgatccagccgatcgacggcgaatgttcttagttgcaacaaaaaaaggcaaagatgctgaaagtgagatttggcaaaggattaatcaccgctttgccaattgggttcagatttatggtgaagatcgtgctgatcagtttttaacactttttgaagactttaatcaacaaataattcaggggaatatccgaaagaaggaataagaaaatgattaagatggttgcgctagacctagataatacgcttttaaatagtaataaagaaattagtcaacgtaatgaacatgtcctaaagcaattacatcaagagggaattaaggtagtgctttgtactggccgcccaatcaatgcaatttggccatatattgaacagcttggtttaactgattcagatgattacacagttacgtttaatggcggattagttattaataatgaatcacgtgaacatctttttgaattagggatgaaaaagagtgatttactgccactattttcttatgttaaacgaaaaaagattcccctcaatgttttagactttgaacgggtatacgaattaaatgattatccaggatctatttatcggacagtgttaaagaatattgaattccaatctttgccaatgagtgatgtgccggaaaaaacttatagtaaagctgtaatggcaatcacccctgaaaaattgtctactattataggagaacttccagctgatcttaaagcgcagtatcatgcagttcaatctcaaccaatgataatggaatttttacctaaaaaattaaataaggcggttggactgaaggcgctactagatcattttggggatgattttagtaatttgatgacatttggggatgctgataatgatcttgaaatgattgaagcagctgcccaaggaatcgtaatggaaaacgggcttcctaacgttaaagcagtggcaacagtaattacagatacaaacgataatgacggggttgcaaagtattgtgaacgttattttgcaacacttttgtaataaagattgttataaaaagtaaaataaagagtatttttggcgcaaatatgaattttttgctaaaaaaatactcttttttatgtataatttaatgacttttcaataaaagttatggggccctaaaagctaactagcacaaggacttacagattttataatcatattaattgacaacttatattacgaaatattacaaaaagtcaacggggagtagtaaatagaaatggtgctgttacagcttagtaatattaagagtgtaatatataaggtgttgaaacggaaaagataatttgttgaataataaaggatggttgtttaatttatgatttctaagaaaaactttgctaaagtatctgctactcttggtgcagtggccttaggtgttagtgcaacggctactgctgctaacgctgacactatttacaccgtacaaagtggtgacacactttcaggtatttcttacaaattcgcaaaagacaacagtatggttaatgatcttgctaagaagaacaacattcaagatattaacaagatttatgttggccaaaagttaatcatcaagagcgatggtgaaattcaagaatacaacgctcaaaacgcagctaatgcaaacgtcgctaataacaatactcaagctactcaacaacaagctgcacaagctcaaagtcaagctagccaaagctatacttcaaatgcttcaggttcagaagctgctgctaaggcttggattgccgctcgtgaatctggtggtaactacggtgctactaacggtcaatatattggtaagtaccaattatcagcatcataccttaacggtgactactcagcagctaaccaagaacgggttgctgaccaatacgttgcgagtcgttacggttcatggcaaaatgctcaggctcactggcaagctaacggctggtactaaaatttaaactgaattattaggacaaagtaaaacgagactaagaaggtaatcttcatagtctcgcttttttatacaaatgtggtataataggtgtacctcttatggggatgtttatggattcgacaggtataggtcgagtttcaattgcgtttcgaaggttgcgtcttcgtaaaaacgctcagttttaaattataactgcaaacaataattcaaactcttacgcatacgctgcctaacaagtagcgcgcgtagatccattccgggttcgtccatggtgcggcaatgggttttataattagtggactacgcttgttactcccgtttgaagtaataagaagagattaatcaagctagctaaccatagttgccctgatcaacggcgttttggttagtgaaatctaaatagttgagatatgaacgtagagattgaaatggcgatatgcttggacacgggttcgactcccgtcatctccactatagggttgcacccagtttcaaatagcttcaaaatgctgatataataagatttctcaaaatgtaagatttaaacaatttcattaaattgcatttaaatgttgtatgaaatgttgtacagaaattaaatatcatttaagcatgaccaccacagtaatatgtggtggatttttttattttaaaatttattgagttgttgctgcttatcatttttgaaattgattttggtagtgtaaagatattaaattgtaaaggatgatgaatacaatgcttagtgatatagacagttggcgagatcttgtagcagcgcgtgaagatgatgaagcagaggcaaaggcaatcatgcaagatgccaagtttgaagatggttttaatgaattacagaaaatagatgataaaattattaaattgtatcgagaattcaatttaaaattaaagtatttacaagataatccacctgctgatacttccatgttgcaatggaatgaattaaagggactaaagccatttcctgttaacgaatattaaacaattagcttgcactaaatgcaggcttttttatttaccgaacgtaattatctaagttttaacttagataatgaaggtgaggtttagcaactggagctatagcgaaaggcggtagttttgtcttatattacttctgatattagaagtaatctgtttgtttacttgacaggacaagtaaatgattgtctgcttctcttcatcagttgaaagagaagggtctgtttggttcattttcgacaaggaaaaacgaacttgctttatccagatttacaattaaatctggtcaattttgattcttttggtgagtcaaaagaatgttcaattataagtctcaaaacggttagtgtttgaacgaataattgaaccagcgtaggggtgaaggggagctgattaagcgcccctccaagaagtatattagctgtattacagctaatattaactacttgcaaattgatcatcaatgttatattattggtatagaccaataaatggtatagctataacatagatgatcaaaccgacgaattacgtgatttagtcaaccgataattaccaaaaggtataggttgaaaatcacttaaaatttttagaattttactggtaatgaggagggataaaatgtgaatacaaatatcaaacgtaatatgattcaagtacgcttaagtgataccgaaatgaaaaatttcgaagcaataaaatcaacgttaaacgaaaaaactaatgctgcaactttacgtgaactaatccaattagcaccattagttggaaagcaatcgcaagagcaagttaaacatttattgaatacctacgatgacttggaagctaaagttagcgcgttgctgtgggatagttcgaatgttacaaaaaatctaaatgaaattgctcatgctgctaatattgcgaagaataatgatccagcaaatgaagacacttggaattggattattcaacaattaaaggaaattttcttaagtattaaccaattaaatcaaataggtgagcagactaaaaagttcttgaaagaaggactggaaaataatggcaattcttaattcgacagcatgtaaatcttcttatggtcgattaacttacatttttaatcaatctgctcataatacaagtaagacgaatcaccgtgttttagcttgttcaggaactaatattaatatgttgcatactcctaatggccatttatcaacattacagtcgggagcttacttagaaaaacaatttcatcaaagtttaaagcgagcttataatccgaaacgaaagtatcaagctcaaagtattattattagcttctcaagtgaagagtttgatacttccgacctaaaacggcaagctactcaagcaatgcaattggtagaaggatacgtacatcaacattttagtgatgctcaaagcgtttcttgtgttcaatgcgatggtgatggtggaaaacttcatgttcatttattgattaatactgtaaagacaaatggtaaaacagtaccaacaaatcgcttctctgtctatcgaatgcggaggaatttcaatgaatatcttgaacgtaattttcaactagttaccggaagagaatggtctaattcatttaataaagcaagtacacgtaaggatgctaaaacaataattacgcggtcaagttgggaagaacagcttaagcagaccataaatcaggttaaacaggaagtacgtaatgttgttgactttattaatcgtttgtctactaaaggcattcagattaaagaacggggtaaaaagaagcaatggacttacacccagattatcccagataaaaatggtaagccaaagcttcatcgagtgcgtgcttattatcagcgtaaggataaagctgggcatgttttatctacgcgcggcttaggtcaagcttatacgagacaaggcttagacaattattggcgtcaacaactagaaaaagaacaggagattacacctgttaaaagtcattacagaaaggaagtaaaaacaaatgacagaaaagatgttcaaactgaacgagaagaactcattaaaattagaacactcgcccgagatgctcaggcagcagcaaacgaacgacagcgacgaatccagcttaatctccaaaaatcacgttccgccgatgctgaagagcggaaacaaagaactcaacctcaaactggatcagctacttcaagacggcgcgaccaaagccgatctaagtcaattagcaagcagcaacgatatgcagaaactacgcagcgacgtgtcaaaaagcagcaagaacgtgcaaaacgaactaacggaaaagatgtcggaccagacctctaaattgatagaagtcgctaagagtacacgtgatattgcttataacaatgggttgcaagcagatattacgaatactcgtcaattggttgatgcaatgcagaaacgacaagataccgctaatgtacatatgaatgaggtaacaagacaaaatgaagctatgaatgctgatttaaaacaaattggtcctgcaattgcgaaagtagttaaggctcaaaaccataatagtgaaattttaaataaggcgttgataaacggatttcatatccatactaatgaggttacagaatctgttgctaatgagtttaagaaacttactggatttacaatcaatgagtttttgcaaaacgaaattattaagcagattaatgttaatgtttatgaagcgaaaaaagcaaaattatcggtaattcaagcagcccaagtaactgaagaagtattacataaaattgcattattaattcaacgctttataagttttgtaagtgtattagtttttgaattagggctaataattgcatgtgccattatgcttcctggttggtggaaattaataggattaatagtgactactagtgcatctgcaattttaaattattatttgaagaggaggatggatactaatgggctataacctaaatatcgatactgacaatgaaggtgcattacaattagcgatgcagggccaacaaattccttcttgggtatatgaaaactctcagatagcccatgagaataagcgaattcgtttagtagctcttcaactcgaagctgtagaagaagcacaacaaaaacagcgaggacaattacaaaaacaagaaaaagagagtaaaaacaatcagcctaataataaacgtcaacgccatcaggtaaaaaagcaaaaagatgatttgttattcgaataaaaaaaagacctcccgtcataattgggaggtttttatttgttcttaagaagttctaatattattttacttaaatgttctgttttagaataatcgtaattttcaagcttattaattaatttcgttaactgtggtccacgatgagaattgttttccgtagccgcctgattagtcattagagaatccatcgatgtgccgagagcagttgccaatcttaaaagggtagtcgaactaacatcatttgatccaccacgctcaaggcgagaaataaaattaattgatagattgcttaactcagcaagttgttgttgggtcatgtttaattcatggcgacggttagcaatattttttcctaataattgttgcatagttaatctcacttatccttttaatattaggataaaagtaagtatgactatttagaacgttatttataagtgttgatagttgcatatatgcatttataattagttatttatgtgcaatgatattgacttatgtgtggatgaaaaatataataaaaaatgttaattgtaaatagcttcttttactattcaaagtgattagtaataaccatgtatttagggagatgttaaatacatataaatagaaaataaaggtcatatcgatttaggtttaattattagaaatttaatgcgcacataacaaatataattttgggggatattatgaatagaaaaaataccatccttaagtcaactttacttgctacatcagttgtaactattagtgcagttactaatgttacggttcatgctgatgacatggcatcaaaaacgcaaagccaaaatacaccggagaaacaaattgccaaaaagcaagataacaacaaccagcaactatctgctttaaagcaacagcaaagtaactctgaaaatgaagtggctaaacaaaatgctgataagttaactgaattacaagaaaataatgctgaaaaaattaagattttagatcagcaacttcaaaaccaaaaacaagttacccaacagactgctaatgatcaattagcggctaaaactaatacagttcgccaatccgaacagtcacaagccgttgctgaaaataatgcttaccaatctcaagtagatgctcaaactaaggctaacgatcaagccgttgctaaccaacaacaagcaaacgcccaagaattagctaacgccgctaagcacatcgttacccctgaacaaaagcaaagtcaaattgactctgccactaagaacactcaacaagccttaaaccaagctaagtctgatcatgacgctattgttaataagttaaacgatcaattaactaacgacctcaagcaaagcgctcaacaagaacaagcagctaagaacgatcttaagcaacctagccaagcagataagcaaaagcaacttgatgatgcgcaaaacgctgttaacaatgcacaaggtaaagccaatgacgcgcaaaacgccttaactaatgctaagaataccctaagtgctaaccaaagcgctttgacgcaagcacaagatggtcaaaaagaacatgtgactaacgctattaaattaccagctggttacattgatgcttggaaagaatatgttaacactaaagaaaaaaatgactatttagtaacagaaagtacttatccagacgtatttaagaagcttgaaacgctagataaagaagcattaaagaacaacgtatatcacactaattcagcagcagaaaaagtgccagtgaccttaaatgctaatggcactctttcacgagatgacattatcaaagccactcaatttgctgtttcattactaaacccaattcgtgaagcaattggcgttactccatacaagatcaccaacgcatctattgatgtcgctcaagatgttgctaacgaatatcgcaaggataactggaatacttgggaccacgcacacgataacgatgctctagatcgcgttgctaacaaatggaatattgaccttgtcggcgaatcatgggctggagacggatcatttggtcaagtcaaatggactccaaacaatggcgatacaaaattcatccacaactataataacctaacactaaatgatttatacaaaggtgtttatagttcaatcttatccttattgttccacgacgccgatcaaggttacggtcacgccactgacctattaggtgttcgtgccgctaattccgatttaaccgttgctggtgacaaccttggtgtaagctttgaatacggcaaggggatgaaggcttggggccaaaccaacgttggtggtttccacttcaactctatttctgacgcttcttccaagaacattcaacgtttagttaaggaaggctacgttgttgacgccgctgatccaaatgccaaagttaaccaaccaggctatcgtgatgaaatcgccattcctggtaacacatctcaaaagcaaatcgctgatttacaagctaagatcaaccaagcacaaaaccaaattgatcaattaaccaagactgctaacgcagctaaccaaacattaactgcggctaaagctaagttagctgatctgcaaaagagcaccactgatgctaaaaacagttatcaacaacaattagcagccattaacactaagtacagcgatcaaacaactaagcttaaggctgaccatgacgctaagatcaaggccgaaaatgacgcttaccaagctaaagttagtcaattaaacaatgaccttcaaactaagatcaacgctattaaggctcaacctgaaaacactgatcaattaaagacccaacttgaccaaaagctggcccaagttaagcaagatggtcaacacaagcttgatcaattaaagcaagctcacgaagctcgtttacaaaagattcaacaagacgctgaagatactttagcggcatacaaggctaacttagacaagaatgctcaaattaagattgctaaggctcaagctgatcacgatgcatcagttaaggctcttaacgataattatactcaacttaagaaccaattagatgctcagcaagctaagctcgttagtgatgaccaagctcaatacaatgctcttgctactaaacttgacggcgaattagctgccttaaagaaccaagtattgccaaagactagcgatcaccaaactgctcaaaacaagcaagttgttgctggtaacaccgataccgttgctttagatactactggtaagactactgttgtgttgcctagagtgactagtgatatcaatggagaaaaaccagagtcagttaaattcttaccgcaaactggtaacgaagagaactcgtttgcaattatcgcactaggtgctttcactgctatgtttggtatgaatttagcttcacggaagcgaaagttttagtttgaaatatagagggaattgatagcattgacagtagaagttgataatgattcatatttttatagcctattaaaagcacatgcagcagaggtagcgaaagagccaggaaagtcgccaagtcactacgcagcatacggtatgccaatcgatgtattacgacaaaatataacagaatatatgtattatggaaattctgaaaaaattgaaaaaaagatacaaacaaccatctcaaacatagcgtatactattcaacttttggaattttatattaatgctaagaatgaattatatttatcctatccaatggagagaatgttgaataaggaaattttaatcacttcctttgaaatccaagaagctctaatcagtataatgtttgacggatactataaggctaaaacggcgcaagaaagaattttaaagcttaaaaataagaaaaaattaagtgaagattttattaatgctttagacgatgaaagaaggtatcgtaataaagttcatttaactggaaaagaagataattctattcctgactataaaatttttgatgatactgaaatggttaataagtcaattaatttgttaaatgagctttttgaactaaaaatacatgatgatcaaaagatagtattaccaaatgttaaataataaatcagatatcaatccagataatggacagcccaatgtagactttaagtaataccataagcaagttcagctcaaaatagagaataatatgtgtttactaaagtagttgcgaaatataagactgaacatcattagaaaaaaagccctagttaacgggctttttaattttttaaaacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgaaataataaatgacaacctttaagctcaatttcaaagtcgctactaatggtattaagactaagtatccagttaatatgatgtgattttataaatttattcaaagagtcgaaatatggtgctaattcagttagacttatttcgactcttcctgtaagacgtaattcatctatttgtgcatcgttaagttgataaccgcaagcaccttttatttcactaacaacagtattaacatgtttttctattacttgatttaattcgctcattacttatccctccgttaaatgtaagatattgagattaattacagtttgaatcgtcatttaagattaatgtgtaaaaacctaaaaggttattactaatatctgtagctttatacattgtccacacacgatcttcttgagaagtttctcgtaaataatttctaattttagcaatgtatggtttaatccgttcagcagtaaagaatagtaagccactatttaatagtgcttgttgctcactatctgttaatagaagacttgcttgcagttgcaagtcctcattaacctcttcaataatttcattcattgtttgcataataaaaaacctcctaaatttttgaattcataaatttttctgcgctgaaagcgcgaaactttagaagctatgtgtttattgttaaattattgacgtacattattgcgtacgttataattacggtataactataatgtgaaagaaggttaattaaatggataacattattacaccaactaatgcgcgaaaaaatttatataatctgattaagaaggtcaatttagatcataccccagtaacaatctcttcaagtaaaaaagaagaagatgctgttttaattagtaaaagcgattgggacgctattcaagaaacaatgtatttagaaaataatggagttggtgatgtagttcgtcaacgtgagaaagatgatagtggctttaccgatatagatgaaattgattgggataagttgtaatgtataaagttcaaattaagaattctgctaaatcagatctaaggaaaattaagcatagcaatttaaaaggaaattttaatagggtcatccaacagttaaaagaaaatccatatgaacctaatcaaggatttgaaaaattagagccaccaatggcgagaaagtattcacgaagaataaatgtccaacatcgtgtagtatatgtagttaatgataaagaaaaagtcgtttcaatttattcggcatggtctcattatgaataaaaaagagtaatgagcctgtttaactcattactcttagtagtaacattagcaaaaacacattttttaattagtcttgaattcggtaagttcttaaagtatcaataatgttttccctcaaaacgcatagtgggttaataaattgatctttgtttcgctttaatgcacgattgaatgatttgaattctttataacggtcttgaaataaatcattataaattagctttaagtcatattcatctgaatgctgtgctaaatagcgtaacatcactttttgaacatattcttttttataattttcaaggatttcaggataattcttaccttttaaatacgtatcatctttaacccacgatacatgtttctcaatccgttcaccatgatgataatcgcgtacagtttgatctaatcccataaactgtttagcgtatttttttcgaaagcttgggaagagagaacgataattctttaattcttttcgatacgtcattaactcttcgattgaggagaagggacgtgtcaaataataaccgaaatcactttggggtacaaagccaattggttgataagtgtcgtcgggactcaagttaagccatttagtctgtttccaagttttcatactaacatagcgcttattatcaattgagtgtttcatgtcgtttattgattgcattctaaaatcatcaactttaaatgtcacagtatccttttcgagtagtttaattagtcgatctgttgtccagctgttaggctgtaatccgactagcgctttaatatggttatcttctgtcatattgaaacgagtgcgaatgttgattagagcagcttcggtatatttttgattgtgattatgcgactttagctcaaaaaattgtccaccaaagttatttttgttaactatcacccagcggttatcaaaatagttttcacatttttgacgaataatttcttcattaagtaagttgttagaacagaagataaacccatcagtggtcagtgaaggaacgagactattcgggtatgtttgttcaaccaggtccatcaacgcattgacttgatatcgggcaattgacgtgtattgtgcagctgtaaaagggttagtattacggctgaaaggtacatacattgtgttgccacttaaaaagtctcgtgttccgccagaacctaacccttgggctgatttaccgtagccaccgtttcctaataacttatagaaaagctgaagggcgtcatattttcgatattcatcagatttagagtcaaatttatcacgttttgctttagcttcatttcgacaaattagtgaccaatgctgcatttttccgattggcgctagacaggcaacatgtccatccaatattttttgttcaggaataatgattcgatgaactctaacagtacctccgtgttcaacaatgttaataatatcagttacggtcatattaacatgatttgcttgccggacgtaaattggcccttgatcttttattaaaggcttatagccaaccggcacacgttttacattgtccggaaagtgataagaaacattagcaacaccgattgtaaaagctccatttacaaaatattgtgaatgtttacggtaattttttaaaatgttgctatctaagtcatgtacatctaaaattggtttacaatcaagcctaaaatctgggattaagtgaccagcatctacatagcttgatttgagatcaatatcatatttatatttaaacgcactcgtgataattccagggttaaaggctaaattcattccaccaacatacgcttctcgtgccatagcgaatccatcattatacacggaatcaggtcgaacgctaaattgatcatgactacctttcttatgttttttatcaactgtactagattcaataaaattataacctttccgcatttgatcaaaattcaattgggttgttaaaaaaatttcaggcgaccaagtaattacatctttgttattaaaccaagaaacagtactataaatagaagcgttatttaacttagttaggatattatcaatggttggaggtacattattacgtgtgtaattaaattgatgtgcatgatccgcatattgattacgtaacttagtgctgatcgcaaattttggcttactgactttgaccttctgatttatcaaattgcttacatcaaatttaggattatcttcgtataactttttaaagttaattcgatcggctaatatcgaaggtgatcctttttgatttttagcaggtgctgaaccaattagcttttgatagatatatcctttcttgcttttcttgtaagcaagtgtacctcgagcgagataaggttttagtttttcaataaatagtttttgaaattcaaaattatctgaaccatcaacagcatcgcttaaaactttaacccattctctcgtatctctgggtggttcttgattgtataattttggtcgtaaatatttatcaacatcaataccgcgaaaaatatcttggaaaatatttttaaccgtttttgaatcataaggttcttgagagtaatgagaactaatttcatctgctaaagatgttactgtcgcgggaatatgcacattttcaattaattcttcattatatacatcaattacatttcccataaaaaagtctaagtattttaaagtaacttctgaatcacctagagcatagtttaaataatcatcaggacgtttttctaataaagaacgcatgtgagatttataatagccaccgttataaggatcattgaattcttcaaaagaaattagtttatcctcaagatcccaatctttcgtgttaagtttcttttgatcaacaattgatcccaaggctgctaaacctccttgtggcccaaggggcattgtatcgacaaatttaatagttataggatacttgattcgtcgtgaattaggatttgtaaccatgattgaatatggattactaaagaattcttgcttgtttaaagcaataaaagttggttcattctttgactttccttgaatatctaaatatttttccaatcataataggcggtaatgtcaacacctgcaaagaagcctacatatacaaccggcggaactcgattcgatttattcaacttttctttaattttatcttcttttaaacctaattgtcgcgctagtcgtcgataatctccgtctgtatattcttcacagtaaccaacattattaagataatatcgaacaacgctaataagatcccagaagctgaatgatttgtctccaggttgacgataaattacaatccccatcgcagaatattcagcatattttattacgtattgatgactaataatatcgtcttgattacgatagtcagtatcattactatggctctgcgatgtgtcccattcgctgtcatcagcaataaacactgtgtcaagtccataatctttttttaatttagaaagattttgataatcatcaatcttataatttctaattttaaaagttcgtgttaatgtgttaacaccgctcaaatttatagcctccttatataactaaaggaagcaatactaaaaaccacactatactaaatagtgattagtacacacaatatttatatgttataattttttaaatactgaagtgagtttttaattggtaatgatacttcactttagtgtttttaatattttttgtttggagaattaatcaaatggcggtttggttaattcttttttgttattttgggtgaacacttttgttaatgttgttcacccaataaatgctctgctttcttactgtcacaacgattacggtagggtgtcaagcgggttctttatgggagagtccccagaggtgctaccttttgacactaattcattattaatgataattgctaatccatttaccattccaagctttatttggaaggcgattatgaataccggctaaataaatttgcttggttgtgggtcgcacatgatgcgaacgataatacttaattaacaacccggttagtgatttattagggtcaacttctcgttgaaaaatattacctggcaaattttgaggaaggcgattataaaacggtggacaacagataacatcagcgatctcgaactttatctgataaaacagagcttgaagcaaataattattactgatatttaagctttttgccactaaactaaagtcattttgatcacttcgatctcgcttgtttttgttaaaccaaagcaagaaatctcctggaatgagagatgaagctaaaggatgcaattgactgcgataccaccacgaatcatgcggaacatagtcaatttgtagtttactccgctcaattgttttattagatgaagaaaaagtataattcaaatattgtttatgatgatgctttgagatacctttttctacatctacattaattaatgttaattggctttggggctgcgtgaataaagagttgttcagactaacgctttgtagtaatcgtgtgtaagttgctgctgtaacttgtgacggttgatgtattgctagctcactaatttttaagtttaacgctgtcattaacgaattgagcgattttagtgcttcagttttttgctcttcatgtgatgcgttaatcataagatcacatgtcttaaaattttcactaatttgaagtaatttgcgatgcgaagatgctaatgtgagtttgattccaaaatttgggtaaatcacttgtgcatcaactaaaattaagtctttaatagactctgtaagtttactttccaaaagcactcacttcctttttgaaaatgacttatagtaatcgatataatcatcaatcgcccagctaaccagctgattaatggaccgaggtggtttacaaccaggccaaaattgcatgtcaaacaacattttttgtacaatagcttctttgttctcgtccaaattaataatgtaattaataataaacactcctcgatgttttccttgctattaattaatctttagaagtcataaacttatcaagttcatatcgattgaagcgataagttttgccaaatttggtatatggaatgttagtagtagcaatccattggtcaagcgtattaggagctatatttagatacttagcagcttcagactttgacatataaggtggatattggctagtaagtgctcgtttgcttgcctcttcaattgcttgagtaactgcatatttgattgaattagctaagaaatcaggtaattcaactttgatttttgacatttaatcatctcctctcttctcctctttggttaaaataaagttaactaaagaggagaataatatgcaattctagccaaaattaagtaaactaaattttaaccgaattgcttgacgcaatattacaatattactaaaataaaatcaagtaaaattaaatagatttcttttttattcttagttcgcaatggaggtaaattgcgtattatcaactaaaaatagcgattacgattttttttgaggaatatgaagtgaactttgagatatataataaaatagcaattatatcgaatttagatttataacgtaaaaaggtggtatttatgtataatcgggttgcattaggagctagaattaaagttgttagacaaaaaagaggtgaaactcaaactgagtttggaaaaaaatttttgccacctgttagtaaagttgccgtttcaaaatgggaacgcggaattacaaaaccaactgcacagcgtttgcgtgaaattgcgaaacttggtaatgtgacagttgaatttcttattaatggcgacaatacgactgccgaggaagcgcaaaagttgttaaataaagtcattagccgatcacgatctactaatgaagaagataagaaaagattgaacggtattcaactggaattaagacaaaagcttaaatctcatgacgatgctgaaaaaatagcaggtgttaacaaaaaaactcatttattaaatgatctggaatcagaaattcatgttcttgatgaagatttagattattcaagtttagtaacatttgatcaattttttaagctttttaattttctaagtagtattaaaaatccttcaattttaaaagaatttaatgagattctttggcatattaatcaaattgctgaaggaaacgaaatttacgataaagaaagagatttattaaagatagataatttcttgacaaaattaagtatgtctaattagactgatagatataatgtaattcacttctcgatgtttcccttgctcaatcatgcttaaatgatgtacgcagaaagagagtgaaattacatggaaccttatgggtataatacaaaaaagggtaaacgttatcgggtagcttaccgaactccagataataaacaacataataagggtggttttactactaaacgtgaggcacgagcttggtatcgtcaaaaaatggtcgaaattgagaaccatggctttagtagtaatggaaaggtaacgtttgaagaagttgctaatcggtggcttgataataagaagcagacagtagctggctcaacctataaaaaatatgaaacggaatgtaataaacatttaatacctgctctgggtgataaattacttaaagatatcagtattcctacttgtcaatctttagtttatcaatgggctaaagatttcaaattttataataaaatggtcaatgatgccgcaagtatttttgatctaggtattaaatacaaattgatccatgataatccttttaaattaatagagcatccaaaaaaagataaggatgatgaaagaaaagtaagatcatttaccaaagatgagttcattacttttaaaaaaggattgcatgagcattatgaatcaacaaattataaggcgtttgctttcctttttatcttgtcacatacgggattacgaaaaggtgaacttctagctttaacatggaacgatattgaccttaaaggtggattccttcatataaaaagaggtgttacccgtgatactaaaaataatcttataataggtggaacaaagaatatttattctgtacgtgatgtacctattgggccagaaactattaaagtgttggaaaaatggcgttctgagcaatatcaagaactgaaattttttaatattaatacttttaaaccaaatcaattagtatttacaggcgaaaaaggtggtatattgtcaccgtcgaaacctggaaaatggctaaatgtaattgagaaaaagtataatcttccctcttatgtaacgccgcatggactgaggcatacatacactagtttactaattgaagatggaatgtcggtcaatgatgttgctagtgtgttagggcataaagatgctacaattactataaaagtttataatgatttacatccgattaaagataattcgatcggtaaaattattgagaatctttaaaaactaaaatgttgtagagatgttgtataattaacatctaacaacataaaatagttgatatagcagcctttgggggacacgggttcgactcccgtcatctccactatatgcctataaggactgccattggtttatggcagtcttttttaatactaaatattgggataattagtggggtttcataagaagatattctcatgtaaaaattagtaaataaagttcagataaaatataaaggaatgaattaaatggaaatattaatgattgaggataatcattctgtctgtgaaatgatggcaatgttttttaagaaagaaaaatggcactatgaatttgcttatgatggcgtggaagcagaagaaaagtttaacgctgaccctcataaatgggatattattttgctagaccttaatcttcctaaaaaggatggaatgcaggttgcagctgatgttcgacgggtatcaccaacagttcctttaattatgttaacagctcgtgatactgaaagtgatcaggtattgggattggaaattggtgctgatgattatgtaaccaaaccatttagtacgattactttaattgcgcggatcaaggccctttatcggcgaacacatttaaacaaacttgaggatgttcaagatactgatagtgatgatacattcgatattcaaacaaagaactttaagatgaatactaagacaagagaagtattcttatatggaaaaccggtcggtgacttgacacctaaagaatttgacttattaaagacgcttgcctctaaaccacgtcaagtattcacccgttcacaacttttacaattagtatgggattatgaatattatggtgatgagcgaactgttgatgctcatattaaaaagttacggcaaaagttagaaaatattggacctcaagtaattaagactgtatggggggtcggctataagtttgatgacgagggtaacgactaatgaaattaatgtatcggttgatgctttcattttttgcgattattctgacgctaatggtgattgttagtatttcgtttataaatgtaactaataacactatgtatcataatacgtggcaacaattgaaaagttattctgatagtttaattcaggattctattcgttacaatatggcaacccaaagttttgaagggtttgctacagaatcgttaaatagcaatgccaatcttttaacacggcaaaatgttcactttgcaatttatgatacaactcaccggaaaatttttgccagtaacggctttgctcctagtatgagtaaaaatgattggaaaaagttaagaaagggagaaactgtttgtactaaactaattactcctaaaattaattcacgagtatcaaaaggtgtttctccacgaatgaccgaagtttcacgaccatacttctataaaggaaagatgattgcggtagtttcgattgcaactttcgtctcgacaattgagcaaaatatgcaccaaataaagattaacttaataatggcactactgactgctagtcttgtaacgcttgcagttagttacttcttggcacggtcaattaccaaacgaattgatcgattgcggatggctactcaccaaattgcgcaaggaaattacaatgttgaagtggacgataatgggcgtgatgaagtggcagacctcggtcggagttttaaccaaatgaccgcttcgttacgtgaatcgcaacaagaaattcgccggcaagaggagcgaagacgccaatttatggccaatgcagcccatgaaatgcggacgccattaacaaccattaatggaattcttgaagggttacagtatgatgcgattccagaagaggataaaaagcatagtatccagttaatgcaaaatgatacgcggcgtttaattcgcttggtcaatgataatttggattatgaaaagattcgcactaaccaaattgcgatggaacggaaagtatttgatgcatcggcagtactcgaaaatttacgagagcagttagcgaaaaaggcaaaagagaaaaaggatactctgcacttggatgtagaaaagaatttacgggtatatgcagactatgatcggtttgtacagattatgttcaatatcattcaaaacgcaatccaattcactgataacggaattattgacattcggggaaaacgtgtggaaaagggaagtcaatttgtagttcaagataatggaattgggatgactcctgaacaacttgaaaatatctgggaacgatactataaagctgatcgttcacggatgaatactaagtacggagaatctggcttgggacttgcaattgtgcggcagttagttcttcttcatggcggaaaaattgatgtaaaaagtcagtatggtaaagggacgacatttacaatctttttccctgatcgtgaatacgctcctcataatattcaacctacaaataataaagacaaaaagtaagccaatgatttaagtgaaacgctttaactgtgataataaagtgtttattttttgtagaccaatttttataatccaaagagatttaaagaaagcgcttgtgaaagcgtttaccatatgatacacttatatctcgtaataatattacggattgataggagagaattttttatgaactacttacttgctttaatccctgcgattggttggggaattatgccactgatcactggtaagatcggtggttcaacgattaaccaaatgtttggtattggtgccggtgctacgattgttgggttggttgcatttattatcggtcatccaactgttacaacgactggattctggttctcagtactgtgtggtgctttatggacaattggtcaaattggacaattcgtttcatttaagcggatgggtgtttcaaacacgattcccctatcaacagtacttcaattagttggtaactctttgattggggttattatctttggagaatggcgtggagcacgtacccttactattggttttatcgctttagcaattgttattgttggtgctttgatgacctctgttactgatcagagcagcggaaagaaaattactgttcagaatttcctttttctattaattacttctattggttactgggtttactcagcattccccaagatgccaatgattgctaatgatagttctttaggaatcttccttccagaaatgcttgggattttacttggatctgttatttatgctatttgttcaggtaatattgactcctttaagcaaaagaagcaatatctcaatatctggggtggtatttcttggggaattgctgccttagcttatatctttgctggacgggcattaggaattaatacagcctttgtctttacacaaatgaacgttattattgcaacaattggtggtatcttagttcttcatgaacacaagactcggcgagaaatgtcatttacaattgccggaatcatctttattgttgccggaagtattttaactatttttgcttaaattatattaaaactaaacttaaaaagaccttcatcggattttgatgaaggtcttttaatatcgaaattattatttaataagggaaatttcctaagcgatctttttcagtaatgggacgaattactttgcctgggacaccaaggacaagggagttatcaggaatatctttagtaacgacagtacctgccccgataacgcaaccattgccgattgttacacccggacaaactgttacattgcttgcaagccaacagttatcgccaattgtaactggtttgccatattcaacgtcatcgaacagatcgtcagcttgttgacgaatattacgctgctgatacatgagaggatgtatggctgtaatgatcgagacgtttggaccgcacattacattatttccaatagtaacaggacatgtatctaaaatagtaaagttaaaattagcatagaaattcttacctattttagtaaaccgaccgtaatcgatatgaattggtccttgaagatatattccgtcagcatgctgagaaaataggcgatcaataatcattcctcgttcaacagtatcttcatcagttgttaaattatagtcacgataaagacgatgagcaaggtgagaaaacttattgagttccggtgttccaggacgataaggcttcccagctaacatattttcagtgtttttatccatgaataattattcccttcaatttatgtaagcggatacgctgtgtattcccagtatgcctaattaaccttaaattgtcaattttcattaagaaaaatttgctagttctgattgaaaccgacttcattatccgctatcatttaaatgtctaaaaaataaaaatagaaagaagctattggaatgacacacattaaatttgacagtagcgcattaaagcaatttgttcatgaaaacgaacttggcgaaatgcaagcaatggttaacgccgctaatgatgaattacggaatggaactggtgctggcgccgacttccgtgattggctccatttaccaaccgaatatgacaaagaagaatttgcccgtataaagaaggccgctgacaagattcaacgtgattcagacgtcttagttgttattggaattggtggttcttaccttggggctcaaatggcaatcgacttcttacataataccttctaccaagctcaaaaggcaaaagaccggaaaactccattggtagtctttgctggtaactccttgagttcaacctatgttcacgacttaatccaattaattggtgataaagacttttccatcaatgttgtttcaaagtcaggaacaaccactgaaccatcaattgccttccgaatctttaaggaccttttaattaagaagtatggtgaaaatgaagctaataagcggatttatgctactactgataaggctaagggtgccttaaagactgaagcagatgctcatggctatgaaacctttgttattcctgatggggttggaggacgttactcagttctttctgcggtaggtcttttgccaatcgctgcttctggtgcggacattgataagttgatggaaggggctgcacaagcggaaaaggattatgttgatcctgatctaaccaagaacgaagcctaccaatacgctgcttaccggaacattctttatcgtaagggctatgaaacagaattactcgaaaactacgagcctaacatgcggatgtttgcggaatggtggaaacaattagctggggaatcagaaggaaaagatcaaaagggaatttatccttcttcagctaacttcacaaccgaccttcactcacttggtcaatacatccaagaaggtcgccgtttcttaatggaaaccgttgttaagctcgataagccaaattatgacatggaaattccaacagaaccagataatcttgatggtttaggctacttggaaggtaagacaatggattacgttaacaccaaggcttatgaagcggtggttgctgctcatactgatggtggagtaccagtgatgactgttcatatcccacaagaagacgaatatactttaggttaccttatttacttctttgaggttgcgatgggaatttcaggttacttaaacggtattaatccatttaaccaaccgggtgttgaagcttataagtctaacatgttcggattgcttgggaagccaggatatgaagagatcggcaaagaattacgagctaagatggataaaaacgattaggataaattagatataatttaagaagggaatagctgttacgacatagctattctctccttttatctggagtatttttatgaaaaaagaagaattaattgaacatcgggatcgggtaaaagatcatttagtagtgtggattgttttaacaatttgtctgcaaatattaactgtttttcatatcttagcgttcttaaaatatgtagtatggctttctgctgcctatagtattttactaatcatcttgtggtgttatttagaatttaagctcctacatttaaaataatttaataaaaggagtgggactataaacttgcttcgagtttttagtcccacccctgcaagaatgactacgacgcgaagctagcctattggggtattatggacgctgatttatcaacgttcataatccatccatctactgcgttttggcagtttacactttaaaatagtaaagaggttggattattttcccagcctctcttttctattaaataagttaaataagaccaaaacgatttcttgcagctgtattaatacagtttgctaatttctctttaacctttttatttatatctaaattatcggtatcatttttaagataggcattaattatgattgaagccattacatgtttaggaacagaaaatattttaatatccatgtatttaggggggcgggaatatcttcaaaagtgagaacaatatccttaccattaacactaattgttgttttcccgcccttcacaactgtgtagtcaagttcgttaggggtacaatttttatatgcagtcataatggttatcccttcttattattaatattattgttagtataacataatttaagttataatcgatgattgtaaattgtgaagagaagaatggtaagataattgaaaataaaattggttaagaagggaataaaattataatgaacgaatatgtaattggggttaacctaggcacaagtgcagtcaaggtttcagcgatggaccgtgatggcaagattgttgcgcaacaaagctatggttatgatctccatcagcctcatcctggctacagcgaacaagatccgcgagattggctttatgaaacaacgattgtaattgatcaattaattttaaaagaacttagataatgtaaataacggagaaaacaaccgtcttaaggtcattttctccgctattttattgttaatttatttcttgaatcaatccattaaagaagtgttttagtgacacttgcccaccattagtacgctctcctttgagaaatgaaatttcattgtggacatttttatattcatataagttattcgcatattccaaaataatgtcgttttctggataatccatacacatatgtgcgagattattaagaccagtttttatatcgcgtcgaattcgttggaaaattatctttttgccatgctcatcacattggaaaaattcttcaaagttaacctcatcaaaactaatttcccgttcaatcatcgtattaataagtttgttaattgcaggagcgccatttccagctgtaataccgagaaaacgtaagatggactgagcgttttcttttttcttatttttcccactgatcgtaactgtattattattcgttgcagcaccgcttacaaggtccaaaacttgaaggaggcggttagacatattaatattttgcgctgctagtttaatcactgacttaacttctgcaatgtttagtggtttttcaataaaaaaatcaattccatgttgatatgcacttgttttaacagaaggcagaattgcttgagcagtcataatgaagtgtggataatgatgactgtcctgaattttttgaataagttgaactccatccattgctggcattgcataatcgataaacatgatatcaattcctaggcgcattgcatcgtcataggcctgttgcgggttagaagttgttccgacgacagtattgttgaaatcattttcaataatattggataataaatgaataattttactatcattatctaaaatataaaaattcatgtattttcaccgatttcttgatgttgtttgaagtattttgaaacactatttaattttactctttgtgaagataatagacaatagagttgctgttttacaaatgtgtagctgtttccgcttacatccttgtgaataaagagattgctgcaaaaaaacgctgaatttttctgttatttatggagcctttttgaagtattatgaaactttagcctattatagtacttgtattaaaaccttaggaggaaataaaaatggcttttaatttacgtaatcgtagtttcttaactcttgcagattttaacactcgggaaatggaatacatgcttgatcttgctgaagatttaaagaaggcaaaatatgctggttatgaaggcaagaatcttgaaggtaagaacattgctttaatttttgaaaagagttctactcgtactcgttgttcttttgaagttggtgctaaggatgaaggtgctcatgtaacttaccttggcccatcaggttcgcacatcggtcacaaggaatctgttaaggatactgcacgagttcttggtggaatgtttgatggtatcgaataccgtggattctcacaacgcaatgttgaaattttagctaagtactctggtgtaccagtttggaatggtttaactgacgaagaccacccaacacaagtacttgctgacttcttaaccgctcacgaagtattgaagaagccttacaaggacatcaagtttgcctttgtaggtgacggtcaagacaatgtttcaaatgcattgatgcttggtgccgctgtaatggggatggaataccacgttgttactcctaaggaattggaaccaactaaggaaactctagataaggctaatgaaattgctgccaagactggtgctaagattgttgttactaatgacatcaaagaaggtgtcaaaggtatggacgtaatctatgctgatgtttgggtatcaatgggtgaatctgatgatatgtgggaaaagcggatcaaccttcttaagccttaccaagtaacaatggatgttatgaaggctactgaaaaccctaatgttctctttgaacactgtcttcctgcattccacaacctcgacactgaagttggtaaggaaattgaaaagaagtttggcttaaaggaaatggaagttactgacgaagtattcgaaagtgaacattcagttgtcttccgtgaagccgaaaaccggatgcacactatcaaggctgtaatggttgcaactttgggtgaacaaaactaattaggaggcatttgccatggctaaagtagtcgttgctttagggggaaatgcattaggcaaatcacctgaagaacaattaaagttagtaaagaatactgcttcctcattaattgggctcattgctgcagggaatcaagtagttattagccacggtaatggtccacaagtgggtgccattaatttagggatgaattttgctgctgaacacggtaaaactgctgcttttcctttcccagaatgtggcgcaatgagtcaaggttatattggctaccatttgcaacaaagtttagaaaatgaattacaccgtcgttggatgaataagagtgtggcaacgattgtaacgcaaattgcagttgaccctaatgatcctgcttttgaaaatccatcaaagccggttggcgacttctacactaaaaaacaagctgatgaaattgccaaagaaaagggctacacttttaaagaagatgcgggccgtggataccgtcaagttgttccctctccactaccgatgaagattatggaacttgatagcatcaaaacattgattgacgctgacaagcttgttattgccggtggtggtggtggtgtacctgtaatcatcactgataaaggacttgaaggagttccagcggttattgataaggaccgttcaagtgccttgctagctgacaagatcaatgctgataagttaattattttaactgccgttgatcatgtttatgttaactatggaaagccggatgaaaaagctcttaagacgttaaacgttgcagaagctcagaaatacatgaaggaaggacagtttgctgctggtagtatgctacctaagattgaagcatgtctttcatttgttgaaggtcatccagaacgagaagcattaattacttcattagatggtcttgatgatgctcttaccggtaaagtcgggacagttattcgtgataactaaaaagaagatggttaggaaaataaaatcctggccaccttctttttttagctactctttaattttttctgtggaatgcgaatgttaatcgcaagtactgcaacgataactaaaatcgaaccaagaatatctgctcccgtcatttgtaaatgaaaaatcaggactgaaccaattgttgctgataaaggttcaaatgcatccattaaactaaatgtagttgcatcgatatattttaatgaattattagctagctgaaagggaattaaggtcccaattactagaatgcctaacacatataaccaaactgaaggaacgttaggaatatgtggttgactagggtgaataagtactaaggttaatccggcaaataatagcccccaccccgtaataattaatgagggaactcgacctttgcgaagcatgttttgtggaattaaggtgtttgttgcaacaccaattgcagaaattaatccccatattaaaacactaagcgtcattgctaaatggttaaattggccatgagttgcgataataaaaacacctaaaaaggcgataattgcactaataatttcaattcgtcgcggtggcaggtgtcgaaacacagcttgataagcaatgataaaaaagggcccgataaattgaaggatggttgcgatcgaagcattcccatattggacagccataaaataagcatattgaaccgggactaacccaaaaacaccatatgcaaagataatccatgcagagtgaagatccttaaaaatttgaaagggatgctccccacgaatttggcttaataagactaaaataattccagctgaaaccattcgaacctgcgttaaccacattgatgtaattgaactactaacattaaaaagggccttcgcaaaaagccctgaaataccccaaaaggtacaggcagtaataatcatcgctgtacctaaaacttttttatttgacataaaaatactctttccaattagatttgctattttattttatagatttgctattttattttatagatttgctattttattttaccataccaattctgtgaagagtgagctcgaccttttaattatgactatctgttggaattgttttcagcgatgattggttgtggagttcgtgaatataaagccttcacagcctctatgtctcgtgattgaatgggataatatgatccagctggctgcatcacagaaatcttgttcgtgtgctgtagaccaattgcatgccctaattcatgctcagcagtatttacgattcgttcttgtgagtagccaaaggcaggatttaataggtagtaagaatttagctctactgttgcgtgcagataatatccagttgcggaattcatgcttgtattggtaagccccgctgccccattatttggatcattaacagcggaaacactaatatttgcattcttatcattaacgattttaaatgtgaatgacttcgtgttattccattgggcaattgcggtgtctgttgcattctttaatactggattactgatattaacatagatcgttgcagagttttgttcccagcgtgcatcagcgggtgtatcttgtgccccagtttgttggtcagcattttgtttagttggggttgcaacttctttgccggttattcggtgtagccacgattgagtaagcacctgagcattatgaatgccaatattaaattgttcttgaaaggtagaattattttgataaaaccaaataattccgccaaagagtaataaataaaataaggttaataagaaattggacttcttaatcggtcacacccccctagtatttaaattctaattaaaaaagagtaaaacgtccattatttaatatttttttattgttgacaactgtaaactttgatagtatgctgtacctataatataattacaattgtaaactaaaagaaggtggaaatattgagaattgccgttataattattgccctacttttgattgcatttattgtttggtggttcttcggaaagcatacagagtcggcgggaaaatcaactattgttaatgatgaacaaactgcaacgattgtcgttaatggtggttattctccatcaaccgttaccttgaaaaagggaattccggctcaagttaactttgatatgcatgactcgacggcttgtttatcacatgtagtatttgaacagctaggagttaataaggacttaacaaagcaaaagattacgacgattaatattccaacagataaagcccagacttttaattttgcttgtggaatggatatgtttcatggaaaggttgttgtaaagtaatgaagctcacaaacattcagcgattttggatttcatttgtattatcaattccaatgttaatacaaatgcttgcgatgccttttcactggatgatgcctgcctataattggatagcattaattactactactattattatggcaatttcagcatttccatattggaaaagtgcgatcgctgcatttaagaaacatagtgcaaatatgaataccctagttgccacaggaacagctgtcgcttatttttatagtatttttgcaatgataactgatagggcagtttattttgaaagtgctgcttttgttactgtctttgttttactgggggatgcgatggaagagaaaatgcataacaatgcttccaatgctcttggtaagttgatgggccttcaagcaaaagatgctgaagtcttaaaagatggcaaatttgtcaaagtaccactcgatcaagttcaagttggcgaccttattcgggtcaagccaggtgaaaaagtacccgtagacggaacaattctggaaggggtaacttctctggatgagtcgatggttactggtgaaagtatgccggtaatgaaaaaagttggcgatactgttgttggttcaacaattaataataatgggacgattacttttaaagccacaaaggttggagcggatacaatgcttgcacaaattgttgacctagtaaaaaaagcgcaaaccagtcatgctcctatccagaacttaacagataagatttcaaatgtgtttgtcccagcagtaatgattattgctattttgacatttatgatttggtattcctttgttggcgcaacatttgttcaagcattattatttgctgtttcagtaattgtcattgcctgtccatgcgcattaggtttagcaactccaacagcattaatggttggtactgcaagaagtgctaagatgggtgtccttattaagaatggtgaagttcttcaagaagtaagtaatattgatactgttgtgtttgataaaacagggacaattacggtcggcaaaccagttgtaactgatattgttggcgatgctaaaaaagtattaacaatagctgctagtcttgaggaatcgtctgagcacccgttggcatctgcaattcttcaaaaggcaaaaaataaagagatctcaccagtaaaggtagataaatttgaagcaattgaaggtaaaggtgtgcgtgcagattataatgggcaagtagcatttgttggtagcaatcggcttttggttgatgtaaatatttcccgggaaatggcatcacgtgcagaaaaattacagaacgaagctaaaacagttgtttatgttggtcttgatggggaaataatcggcttagttgccattcaagatgttccgaagtcgagttcaaaagatgcaattgcggagctaaaagcacgtggattaatgactgtgatgttaactggtgataataaacgggtagctcaagcaatagctgatgaagttggtatcgatagggtaattgctgaagtaatgccgaatgacaaagctcaacaaattaaggaacttcaggacaagggtaaaaaagttgcttttgttggtgatggaattaatgatgcccctgctttgtcgacagctgatgttggaattgcaatgggatctggaactgatatcgcaattgactctggtggaatcgttctcgttcaaaacgatttgcgaggagttgtccgggcacttgatacttctaagaagacctttaaccggattaaattaaatctcttctgggcgctcatttacaatgtcattggtattccaatcgctgcagggctatttgcatttgtgggctttacgcttagtccggagcttgccggcctagcaatggcctttagttctgtttctgttgttagttcttctctgctgttaaataaaactaagattgcgggagaccatgttgttcaggcttaaactaagattataaggagttaagaaatataattcttagcttctttttgttatattctgcacaaagtaaaaggattttgcggtaaaatattaataaaaatgatggaggagtatttaaaatggcagctgcatttttagttcatactcgattaagctggggaaaaacgtgcgattatttaattgctaatgatgttgagccggggttaatgcatcgttatgagacacgagaagattggcaaggggttattcttgatgcattgatcaatgttcctttagcgccgtatttgccaagtggtcagcctattccgccaattggaacggcaaaagtaataggggtagaagcagttgatccgtcacaggttaaaaaaaatgtgcaacggacacgaagtcaatttataatggcaaccatttggaaaaagcaatcggccttaaaaaactataatttcttacatcatgattatgacaaatggacgcaaaagcaaatttgggccgatattgattactggtgtaattctaaaaaacatcccattatcgatttaattacaaaatggcgttgcacccgtcaacaccaacgattacgtgctgaagagaaatgataaaaaaagagttgactattaagctacttccatgtatagtatatatcgttgtaagtttaatttattgggcattcgccaaactggtaaggcagtggactctgaatccataatttactggttcgagaccagtatgcccaacttctaacaaaagacctgctagctaatctagcaggtcttttgttgataaggaagttatttgttataattacagtcaagtgaggggacgaatatggctagtaattctgattcaatttattatgttttgacaaaactaaagcatcatccagagttaattaaaagcattagaccacgttatactaatacggttatggttctttttgatgattccttaaagatagcggatgcttcattttattttcccgttgatcgtttcatggtcaatcgtttgtcaaatgattttgtggcaaagaatggtgaccttcttgatagctatttttcgatgaccaatggaacgaagaaaaattaccatgatgtttgggcgaccacctgtcatattccagaagagaaagtatatttattagaattatcatttgaataacgcaatgtaagctgcgacaaaagatgtcacagcttatttgttataaagggagagttttgtagtgcttgtttcaacgattgttttaacggtagcggcagttttaagtagtattatttccagcttttttccgcacttttcaattaattatattagtattttcgtcggcttaattattggcttagttcccttttttaatagtcgtgttgctcctttccacacagaagtattcatgtatatagtagctccattgatttattttaaggggcaatcaacgagaataaatttaattggaaaaaggttgcgacaaatctttgaaacggctgtcctcttagtgattgtaggaacaatatttgcaggttttactgtatcgcttttagaaattccactggcactagcatttctgatgggtgccttaagtactccgaccgatgctactgcaactgaatcagtttcagaaggtttaattgttcctgaaagacaagaaaatcttttaaaaatggagttattatttaatgatgcttctgggattatcttagtaactgcaatggcactgtgggtgaaaaacggtcagttcaactatcaacaaacattttttgactttttgcgttcagctggtggcgggataattattggcattttggcagcccttgtaatgatcagttttcgtcaatttttggggcgaattaaccatgatgcttataatgcgcaaatattattatttgttagtacgccattctttatttactttatagctgaagaattagaagtatctgggattattgccgtagtttgcgctggtttaatgcagaatagcgaaagtgtccgaagtcgttttataacaccccgccaattttataatgggctagtacttttaaaattgattcgggagctcttaaataataccgtcttcgttattttggtagtattggttgtcagaatcattcgtgatgacttaattattgggaatacaaattcacaatggattgtgattggaattttactctatcttactaatctccttgttcgttatttctatggactattatcaaagatgggtaataaaggaagtataatttttgctctgggggagtccatggagcagtaacactagccttagtatatatgattattgacaatgttagctcagcacaatttgacatgattgtgttagcagaaatgcttgttattattttgagtatggtggtgccttcaatcgtatttcgctttattcttgatcatgatatgtcaagtaaggagacgggaaaacagattcagcgtttacggcaagaaatggttaaagaaggcttgagagccgtggaaaagatataccttccagaaaacattcgagaaagtgtcgtttatgattcacgggatcaaaagagtgctaattcattcgcagacttttggcaccaatgggctaaagcaagtcgctatccagagttcaatgagcaggaaaaggaactggaacaacgagcattattatgggcattccgggctgaaagacaatatcttaatatggtatctcaaaaggaaaatcgtcgcgactatctttttgagctttacaatgaaattctattagcagaatcgattttgcttgacactgaaaatgaatattaaattaatttgattttaagttgacgaaaaattgaaattaacgtatacttttatttgtacgttattgcccgctggtcaaattggttaagacgtcgccctctcaaggcggagttacgggttcgatccccgtgcgggtgaatatgattgagtctgttactcatttggtaacagacttttttatttatattacaaatttagtaaaagcgttaagaaaaggtttaattgatgctatgatggatttgtgtaaatagaaaaagaataggatggatttggtgagttaattatgcgagtaatgaatttaatgatagtattagcagttattgcgattattattttagctgctcaatatttttctcagttacggaaaaaccgcaacggtaataatttcgtaagtgggggccgtgtcttttttaactggacgttggtcgctgtcttggtaatttgtgttgggggaatagtttttggtagcattcattcacatcgccaagaagcaaagccagctcaaactgataagacagaaaatgttgaatatgctgcttccgacagtgataatttgggaaaagtctcagttcagtttgatcggaaagttactttaaatgataatggagaagcaaaagttaagtttaaggtttctccacaaactactttgacaatccggggacataagagcaaagagattgttaagacgtttaaagcaagtaagggcgaatcattagttaaccatacttatacatttgacgtagctggcacttatgatattattgcagaacgcggtgatcaaaaggtgaccaagcagctaaaggttaaggacaatgataatgcccaagaaagttcatcaagtagtagttcagtaagttctagctcttcttcagttgcttcctcagcaagtagcacagtttcctcgtcttcaagctcgactgcttccactgcgcaaagtaacagtgaaagttcaagcagcacgacagcagcttcatcgaataacggaggaacttcaagaagctacaatacttctcgtccacgatatagtggcaatggcggtggaaataggacctctggtagcagtaccccgactgctcctgcgcaagaaccaagtactcctgcctatagtcaagaaaacaatggctatgttagcgatggcccacaataataatttttattcgtaatcaaatatctaatgataaaagaataaactgctttcaaaggaacaaaagatgatttttttatatgaaaaattattcttttgttcttttttattatcactaataacgtaaaatcgttgatatatcaagaatgaaaagcaaaaaatactgagaggtatattcctaaacaatttatcagtattgaaataagaatgaagtatattatactcgatattaaataatagttatcgaattataaaagtatttaagggagggagaaaaaagatgcttgatacagatgagatcaaaaaaatgaggtacttggtgttgagcttgccccggttgaaactgttggcggacaagtgaaattaggggagaaatctgcttcaagcgttgcttcactcaatagaacgccattattggaaaaaatgcttaaagcggtgccaaattttgcggctcaacaacaaaaattgaacggccaagaaccggtaataaaaaataatccagcattaggtgaatatcaactaattgatgatttaggtggcttaatgcatgggacttacttacaggcaactaatagtgaaagtcaggataaagatcgttcgcttgttagtcgtaattcaacgagtgaaacggcatcattagttaattatcgcgcagctactgattttagtggatatggtcatttgaaaaataatacagaaactaccaaatcagttgaagttgtctatacgctgcctacatttgaagggaaacaaggaacggtacaaattgtacttgatggggcgcggattaatgaatttgacggtcttgaatataaggatgaaaagggaaatgtaattcctggatttgatattacctatagttgccaaggacacgaaggagagtattcaacgattgatactcttaagcagcgtgatgattttagctgggaaaaggtaacagcggttatggtatttggttccttattgccaaacagttcttaccgtgttgaatttccttttaagattacaaatctagaaaatattaatactcaagagcaatttaatttaaatgaatatgccttttatgatttaacagttaataagcatacaacgtcacaattaaacttccgcttaagtacgcctgttttttgcccatgatgcctattaaaatatctcattcatggcattcagccgaactgaagatggtgatgaggtatttccagaagatgttcaagcaatgatgccaactttgggtgaagtaccatatgcgatcagtaactttaacgatgaaatttcatttgagactgatggagataatgtaatgtggcaaggcggtcaatacttctttaagctggccgctattcaaggtgcgattcaagaaaagggattttcagtcaatgttgataagacagggagaaagttaatggaggcctctgcctttatggttcaacctacttatcttgattttgaaagttttgacttcattccttatgttgtcattcaccaactttttattactaaatcatttacgcttaaggcagaggcaaaagatgattggaattcatttggcgggattgaaaaagtttgtggtctctccgcaactaatgaggaacttccggttagtcctgagcaaacatttattgtggatgattctgaattagtcgatgcaacccctagtgattataatgtcattattggttatttccttaacgggagtgaggacaatgatatgttaatcatttcactggcaaaggtaaggatggttgaaaataaacagacaattaatgtttactatgttgacttggttaatatccctgataaaaccaaagatgatttacaaccaagtggcggaaagattctcgaaaatcaaacccaaacttttaccggccaaggtgatgaagattatcataatgaactctggggtgaagaaaacggctttgagatttatgaatatgaccaaggtgctaaattaaggacctatgtcggtagacaaccagctaaagattattatgtttatcttattcataaaattgaaaaaatcaatgaagatcatcaagtaacacgaacaattacttttaatatgccagatggatccaagcagatcattaagcaaactggaaaaattcagcgttttggaattactgataaaacgactaatgaaaaaacatggagtgattggagtaaagctactctccccgcagttaccgcaccccatgttcctggatatacgggtaaaaacgttgatgctgaaccaatttcattaatgtcaaaagatagcaatattaatgttatctaccatccaaagcaagttagtgtcaagattaaatatgttgatgaagctgggaatgtaattgatgagcaaatagtttctggacttgctgacgacttgatcagtcataagccaacagttgaaactgaccgtcttgctgatgaaggttacgtgattgttaataatgaattgccacaaaatgctcgcttaatagccgaagacagtgatcaagaaaaagaatataaggttattattagtaaacaagatttacagacacaacaaattaccgtcttttatgttgatgtccctgataatcgattaccaattgtcaagccttcttctgggcggattattgataatcggacccaaagattaaatgttacagaaggacaaacatatagtaatgaactatggaattttgaagatgacgggtatgaattgtttaaggctgacaaaggggcattaaaggggaagtactttgctggtagtctggaacaacaatattatgtttacctcactcaccaaactactcccctaaaaaaggaacatcacgtaacgcgaacgattcagattacaatgcctgataaaacacaacaagttgtaactcaggaagcaattgctactcgttttggcgttcatgatgaagtgcttggtagtgacatttggcaagagtggagcaaaggagtgattcctgaatatattccaacaccaatcgcggggtatgatgcatctgctattccagctgaacaggttgatgaaaatgcgagcgatcgaaatgaaaagatcagttacactccacaaccagctaaaattttggttaaatttattgaccaaactggtgcaggattaacatccgaggaacttactggggtaaccggtgaagaatttaactacgatccaactccgcaaattaagtcatttgaagatgagggatatgtgcttgatgaaaatagtttccctgctgatcatcattttacagctggggaacagacctatactattactttaaataaattagtagcagtaacccctcatggtaatagtgaggcagaatcaacaatcgaacaaattaagtcgaacgatgatgataaaactggaaataaaaagggaatctttgctgcatttaaaggctattttaaataaatgaattaataaaggagtacaggaggaataaaccgctaatggtaaattccttctgtactcctttttgagttaaaaatattaattatcataattgccggtgattgggttcatttcatggatttgatttgtagcggggtcatattgatagataccagtaaggtgagctatatttggatcgccgccttggttattgcgaacttcaatttgataattattattttgattattcttagtcatgtaataatgattgccatcttgttgaacaccacttgtcttgacaaaactcgttaggacttgttgatcgttttgtgctgaggaagtggaattggtagttgctgattggctgctagaactactagttatggatgaactaggagcttttaccgtttgattagttgatttttctgaactgttagctacctttgagtttacgcttgttgagcttgtatttgttgaagaagtggactgtacactagtaggtgcagaggtttgctcctttgccttttcgctattagtggaggaggccgcctttttacttgtttgttgacttacttttgtcgcagaagtagatgtctttgttggagctgctgcgctattggtacacccagctagtccaagggctgctaaaattactaatgaacttgttaaaactttatttgtcatcttcatcattttaatgaccccctcaatctctcttatttttataacatcattacacctatattataccgccttttgaaatgattttgtaacatttttgacttatttgtcataattgactgattttgtttaataaatttctggatatttttcctttgtctgatttacgttaaaataaaccttattgaggaagtgaattaaaatgatgaataaatacgatttaacaattactaaattacaccaaatggttaaagagggagttgttccaggagttagctatttgatttttgatcatcaacatacgattaaggaagtaacagggatggcccaaatttatcccgagactgaaatattaaaaccaggcatgctctatgatattgcttcactaacgaaagtgataggaacagttccggttattgcccagcttattcagaaaggaacattgtctttagatgatccggtaaagaagttcttaccagaatttaatgatgaccaaccaactattcgcaatcttcttacccatacttctgggattactggttatattccccatcgtaatgagttgactgcctccaaactaaagaatgcttttttgacgaaaatgtatgtggaggatagcttgaaccgccaaatcaaatatgcggatgtaaactatttgtatttaggatggattattgaacgaatttataatcaaccagttcaaaaggttattacagaacaggtccttaaaccattaaatatgccaactgcgacatttaggcctcaaccagctaactgtgtaccaacagaagtacaagaaaaacggggcttaattagaggagaaactcacgatcctaaagggtatattttgggagaaagttgtggatgtgctggcctctttgcatcgttgaaagatttagaggtctttagtcacgcacttattgaaaataatttaaaaggtcttcttacttctgaaacaactgatcttctttttacagatcaaacacgaattcctggtccacatagtcgctctcttggatggaaactgtttcacgctaaagaccaccaccttttgattagtcacactggatttacgggaacttggatggtattagatcgtcaaactgaccaaggctttattgtattgacaaatcgcgtccatcccagtgctaaaaatcaagaatatttagatgctcgtgaccaactttttgcaatttatttaaaagaaaaagaaaaaactttgtgaaatttatatgcagtcaattgaataaccgctttcacagaatatgcgctttaggggtaagaaatgtataaaaactgtcgataatttatattaataacttctttttatatgattcactaaatattgatttgacggcatttgacaacgtttacataaactaatatgatgtagttgtagtcaagtgatacttcaaaaaggagtgatattgtatgcaaagtccaattcacgttacatcagaaattggaaagcttaagacagttatgttgcatcgaccaggtaaggaaatcgaaaatgtttatcctgaaattcttcaccggatgctcgtagatgacattccatacttaccgatcgctcaagaagaacatgaccttttcgcccaaacgttacgcgataatggcgctgaggtattgtatcttgaagatttattaacagacgcactagcagatgataatatcaaagaagaattccttgaaaagatcattgctgaatccggttatgctgctggagcaatccatgacggcttaaaggaattcttacttagtttcagtactaaggacatggttaacaagattattgctggtgtacgtaaagatgagattaaaactaagtatgcttctcttacagaattagcagaagatagggattacccattctatatggatccaatgccaaatgcatactttactcgtgaccaacaggcatgtatcggggatggaattaccattaatcacatgacctttaaggcacgccaacgtgaatctctctttactgagtacatcattaagcacaataagcgttttgctgacaaaggtgttgaagtatggcgaaaccgttatcctgaaggccggattgaaggtggagatgaattagttctcagcgatcatgtattagcaattggtatttctcaacgaacatctgcaaaggctattacagaattagctgaaagtctcttcgaaaagtctgattatgatacagtaattgctatccatattcctcacaatcacgcaatgatgcaccttgatactgtgtttacaatgattaactatgatcaatttacagttcatccagcaatcttacatgatggcggacatgttgatgcatacattatgcacccaggtaataatggtgaaatttcaattactcatgaaacaaatcttaaagaaattttgaagaaggcacttgataagccggaaattgatttgattcctactggtggcggtgacccaattattgccccacgtgaacagtggaatgacggttctaacacgctagcaattgcccctggtgtagttgtaacttatgatcggaactatgtctcaaacgatttgctgcgtaagcatggtattctcgttcacgaggttcgttcaagcgaattatcacggggtcgtggtggtccacggtgcatgtcatgtccaattgttcgtgaagatctcaagaaataaataagataataaaagcagcaaatttatctgagtaatctagaaagggtataattttactgctttttcttgtatcattttagtgtaattaacatgataagaagggaacacgaatggatcgaaaggcaagaagaaaatatattgaacaagtggttaatgatcgtaaaattgagacacaagaagaattgcttaagctgttaactgaggcgggtttcgaaacaacacaagcaacaatttcaagagatattcatgcgttgaatattgttaaagcaaatgatggcgatggtcatacccattatgttcaacttcatgtgacgcccgaacataattttgagcgcttatatcaagggattcatgataatgtgcggacaattgaaactgttcaatttatgaacgtaatcaaaaccgcactaaattctagctatgcgacgattttggctggaatgtttgatgaacttgatattccggaagttgtgggcacacttgctggaaacgacaccttgattatcatcagtaaagataatgatgatgctaaaatggtctatgacttaatcattcaacatatgcattcataaactgcataggagggatatttatggatgaacaaaagaaaggtattggtagaggcgaattaatcgccttaattgtaagctcatgtatcggtaccggaatatttggtatcactagtgatgtagcggcagcggcagcgccaggacctgcattattggcctggatctttgttggaattggctttttaatgctggttctctcgctaaataatttatccgaaaagcgaccagatcttacttcagggattttctcatacgctggtgccggctttggaccattaggtgaatttatttctggatggtcttactggttatccgcatggctgggaaacattgcttttgccaccatgttgatgagctcgattggaacgttctttccaacatttaaaggtggtcaaaacttaccctcaattattattgccatcatcttctgttggctattgacaatcttagttaacaatggtgttgaaagtgcatcctttgttaacatgattgggacaatctgcaaggtcttaccattggttatctttattataatgatggttgtttgctttaaagccgggatgtttacagcagatttctggggacgggttgctaataatgcttctcgcggtaccacaactggttctgtttgggaacaaatgaaaggtaccctaatgacattaatttgggtatttatcggtgttgaaggtgcctctgttatggcaagtcgtgctaagtcacttacagccgctcgtgaagcttctcttattagttttggccttttagtagttatttatgtattgatttcgattttgccttatggtgcattaactcgggcagaattagctggaatgggtcaaccagctattggtcatgttcttcaagcaactgttggtagttggggctcgattttaatcaatgttggtttaatcatctcaacaattgtttcctggctttcttggacaatgcttccagccgaaacaacgatgttagttgccgatgataaagcaatgccaaagctttggggaaaggttaatgctaaaaaggcaccaactgcttccttgatgattacagcggtattgcaaacaatcttcttgttctcgttgcttttcactgataaagcctatgaattcgcatattccttatgtagtgcagcaattttattctcatacttatttgttggactttaccaaatgaaatacagttctgcacaccaagaatggggacaatttacaattggtttgctctcggctgcatttatgttcgcatgtatgttccttgctggatggcaagaagtattattagtttcaattagttttattcctggattctacatttactacttagcatgtaaagaaaatgatcgtaaagttacaactgctgaaaagtggacaatggcgctgattttaatcctaagtatcattgcaatttggcttgttgctaatggaactattgccattagctaggtaaataatgtataattattccacattttaagaatatttataagtgaggtgattaaggtgaaggaaaagaagttaaatctcttcctcttaatcaccttaattgtaggaacgattattggtggtgggatttttaatagtccaaccgatttgattttgaaagcaaatccaatggctgcgttaattgcatggttaattggtggcttcggaattttgatgttagtattagtcttctacaagctttctgttgtcaaaccggagatgaacggtggaatttatacttatgcaaaggaaggctttggcaactatattggttttaactccttttggggatattggatgggagcagtttttggtaacattgcttttatctcgctcttttttaagaccttaaatagtatgatcgggacgcatcaactttcgccattaatgtgttttatcgggggctcaattattctgtggggatacactgcgattacatggtttggtgtccgcgaggcaagtattctcaatgccattattacgattattaagatcttaccgcttttattagttgttattgttggtgtttttgcatttcagccgcatgtttttaatgttcctgattggacaagcattcttgctgttaatcaaacgcatgtcccatttaaagaccaaattagtggtgcgatgagtactattgtgtggtgttttgttgggattgaagcagctgtttcaatgtcacgtcgggcaaagcagccacgtgatgttggattagcaacgattattagctttgtaattgtattggtcctctatatttcaatctctattattccaatggggattctacctgctaaagaacttagtcagacttcagttccactggcagcagcccttagtcatacagcattaggaatagtgggaagccttattattaaaattggcttactgatttctctattaggagcattattgagttggtttatgattggaccagaaattgcatatgtaaccagttatgatcgggatatgccgcgagcatttaaacttgttaatcgccatggtgttcctgggtttgcattaattgtatatacaattattatgcaagtatgtttactagttttactgcttccacagcttcaaatggcctatacaattgcatatactttagctgcgacgatgaccttagttgcttacctgctctctgcgttatatgggttgaaattagcaattagcgaaaaaatgggccttggctttaagattattgctacgttagcttctctttattccgtctatatgttagttgcttcgggacttgaatatgtatttgcaagtgcgattatttttgcgctaggaataccattatttgccagggctcctaataaaatgagtaagaaagaaaagtggttagcaacaattatcgccttagcagctgtgattgcgctgatgctgattattactggaaagattaatttttaaaaaattaaaagggatgaggttagaaggaatttttactttccttcaatctcatccttttttgtattctaatcttcgctagtcatcttacttttcatgttatccattcgccagacaacataggtttcaatcaatgtgattaggcttacccataaaatcgtgaaatttgatgaagtaagaaatagtaagatgattaggatccaagatatccagttccaacgacgctcaagacgaataacttttgcaaagcgtggtgggattctagttggattttgaatggctagtgcttgtagttgggagaaaagacggacttcacaaaaactttctagcaaaaaaataatggtaaatacaaatgttatggtttggttcactgtttgtcaccttaattaaaatgtaggtttaatttttagggctttttgactgcttaagtcggcatcggggtatttatgctcaagagctgctaaaagaatctttttagcaatctcaccatttcttgtaagaatgggaccgtggaaataagagcaataagtgtttttatagattgctccttcggtatgatcttcaccgttatttccattaccagaaattactttaccaagcggacgctcaccttttcctaagaatgtgcggccgttgtgattttcaaaaccatggtactcttgattgctttcttcgtttttgatggtgatatcaccaatgaaacggtgattatcctggcttaaagtatagtgatcaaggatgccaagccccggaatcttttcgccatcagcaccgatataatagtggccgagaagttgataacctccacaaatagcaagcagcggctttccatcattaataaacttgtcaatgcctgcttttttgtttggaagatctttggagacaacaagttgttcgtaatcttgtccaccgccgaaaagagctaaatcaaaatcttgtggattaaagtcgttgtcgatactaatgactttgacattaatatcggtatccatctgtttagcgtaatattgaagggcgataatattaccgacatcactataagtatttaataaatcgccgtagaggtgggcgaggtgtaagtgatattttgccattagtccattcctcctttaatatagcccttttctgctagttgtttgcgtaattgcagaacggctgtatatgttgccagaatatagacatgttcagttggcatttccttgattttatcaattacctgggtaaggtctggttcatgccacatatcttttacgccggccattgttaatctagtggtaatatctttatagcgttctcctcccgtcatgtattgtgggatttgatgttgggtaagtttttcaaagtcgccgtcccagatccagctagtatcaattccatcagcatagttagcatttagtaagaaggcaaagctaaagggctcgtcatctgtctcaatcatatctaaaacctgattaagaccaactggatttttaactaagatcaaagtaacttgttttccatcgatattaatgacttcttggcggccaaaaactcgttcgtctgattcaaaagcatctttaatttgtgcttggctcactccgagaaaacgaccaagagagtaagcggcaagagcattatagatgttatataaaccaccgattccgatggtgtatttttgcccatcaatttcaaaagttgaatgcgtgggggtaagcttatcaattttggtaacagcatacgttaattctggtcgatggaaaccacaatttggacagaagtagttacctagcccggcataagttcgcatttgatactttagaatgtgttgacatttaggacaaaggagaccatcagtgttagctggggcgttgaaaggctctttttcttcgtggttaaagccataatagatgattgggttaggcaagtctttgctgttaaagagctgttcatccccgttagcgatgatggttgcttttggtgctaatttaaccccctttaagatcttgttataagtggtgtagatttcaccgtaacgatccatttgatcacggaaaatgttggtgaagacaaaggcaattggggtgatgtatttacatactttaactacatttgcttcatcgacttcgaggacggccagcccttttttctttggatagggagccgtaataaaggtagttacgattccttgctccatgttggaaccagtcggattagtaagaacttggtcatacttttcccgtaaaactcgtacgcttaatgcggtggttaatgtttttccatttgtccctgttacaataacaaggtcgtactttttgctaaaggcttggagaatatttggatcaagctttaaggttaattttcctggaagggaacttcctccgttcataaaagtatggaggaaccaatagcttgaccgcccggcaaattcggcaaatgaacttcgaactgtcatgaatatatgtattcctttcgtgtcaattgtaagtgatacaatagtgatgattaaaattaccgtttaattctaaactttacgataacaaaaagaaagttattaaactgaaattattataagattaaagttattcaatgtaaaaaactctttcctaatgtggaagtatttaaatgacacaaatttttggatataatgaagagtactatgcaaacaaaaaggagcaattgtagtggcacaactattctttaaatatggcgcgatgaattctggtaagtcaatcgatattttgaaggttgctcataactatgaagaacaagggaaaccggttgttttaatgacgagtggtgttgacgatcgttctggtcgaggcatcattgctagtcggattggcctagagcgtaaagtaaaaccaattatggatgataccaatatttacgattatgttaataagatggaccgtaagatatattgtgtattgatcgacgaagcacagtttttaaagaaagagcatgtcttacaattaatcaaaattgttgatgagctaaatattccggtaatggcttttggactaaagaatgactttcggaatgaattatttgaaggttcaaaatatttactgatttatgctgacaaaattgaagagatgaaaacaatttgttggttctgccctcataaagctacaatgaatttacggattcataatggcaagccagtatatgagggagaacaagtccagatagggggaaatgaatcatattacccagtatgccggaagcactattttcatccccaattaaaacaataggaggaataatcaagaatggaaatggaagaaattttcgataagcttcaagcagttgctgatcgttacgatgaactaaatgaattgatcagtgatccagaagtaattgccgactcgcaacgttttatgaagctttcaaaagaagaaggaagcttacgtgaaacagttgaaaaatataatcaatataaaaaagtcacccaaacgattagtgatgatgaagaactattgcgtgaaacaaatgatgatgacttaacagccttaaccaaggaagagttagcggaagcgcgcgaagaacaagcacaattagaaaaagagcttgaagttctactaattcctaaagaccctaatgatgataaaaacattatcatggaaatccgtggagctgccggaggggatgaagcaagcctctttgctgctgatctatataacatgtaccttcgttatgctgaaaagcaaggctggaaagtagaagttgtggatcgaaatgaaactgaagtcggtggctttaaggaaattgccttaatgattactggggataaggtttattctaagcttaagtttgaaaacggtgcgcatcgtgttcaacgggttcctgttactgaatctgctggacgtgtccatacgtcaactgcgacggttggggtaatgccagaagctgaagatgtggatgtagatatcgatcctaaagatatccgggttgatgtttaccgttcaagcggtgctggtggtcagcacgttaacaaaacttcatcagctgttcgaatgacccacttgccaacagggattgttgttgcaatgcaagatgagcgttcacaacagcagaaccgggctaaggcaatgcggattttgaagtcacgggtttatgattattaccaacaacaagaacagagcgcctatgatcaaaagcggaaagacgcgatcgggacaggtgatcggtcagaacggattcgtacttacaactacccacaaaaccgggtaacagatcaccgtattggattaacattaaataagcttgataagattatggctggtgacctcgatgaaattattgaagcattgattgttgccgaccaaacgcaaaagttggagcaattacgaaatgagtagtttcgtaccgaccaactactttatggctcagcgatgggcaaaagaacaattacaaggaacaaatattgacccaagtgcccctcagtttttacttcagcaatcacatggttgggatgcgactcacttacttttgcataatcgtgatgagatgccagctgacgaagtagactggtggaaggatgccataacaagattgcttaatcatgagcctgctcaatatattgttgggcaggccccattttatggacgaacttttaaagttaataaaaatgttttgattccagaagctgagacagcagagttaatcgattgggtgttgcaagaaatgccatctcgcccattaagaatccttgatttaggaacggggagtggagtgataggcattacccttgcacttgaacggccaaattggcatgtaagtttaagtgatatttcaaccgctgcgcttgctattgctcaggaaaatatggctaagtttaacttggagttgccgttaattaaaagcgatttatttgaaaatattgatcagcaatatgatttaattgtgactaatccgccttatattgacccagacgatactgatgaaattgatcaagcggtccttgaaaacgaaccagccctagccctatttgctagtgaacatgggttaggattctatcatcgcttatttaagcaagcagggcaatacctaactacaactggtcaaatatttggcgaaactggttatgatcaagaggagtcaattcaagaattactacatcaaaccgatgaacacgcacagatatgcccacgacatgatgtggcaggaaaaatgaggatgatacacgcatgggatttttcaaacgtaggaggaagatagtaagaatggatacgaagatttttcgacatggtgagattgcccaagcagcagctgcgattaagcgcggtgaattagtggcttttccaaccgaaactgtttatggattaggggctgatgcgaccaatgaaaaagccgttaagaatgtttatttagcaaaagggcggccaagtgataatccattgattgttcatgttaactccatcgcaatggttaaaaagtatgctgccgagattcctgataatgcccgaaagttgatggatgcattttggcctggttctttaactattatcttgaagattaagaagggcgcactttcaaaaaccgtcacaggtggtttgaaaactgttgcctttcgttaccccgactgtcaaccaacccttgacttaattgaagaagctggtgttccgatggtgggaccatctgctaatacttctgggaaaccaagcccgactactgcccaacacgtttatcatgacttgcatggtaagatctctggaattgtggataatggtccgacacgggtaggagttgaatccactgtccttgatatgtcaacagaccaccctgtaattttacgtcctggtgctgttacgaagaaggacattgaaaaagtgattggatccattgaccttaatcatcataaagtaggcaaaaatgaaactcctaaagcacccggaatgaaatacaagcactatgcacctaaggcccaagtatatattgttgatgaagatactgattgggataaagttgttgaatggatacgacaacagccatttgacgttgggatgatggctgaagaaaaggttctccaacaagaagtattgccgatgaatgctattcaattttcattaggaaaaaatgttcaagatgccagtgctcgtctatttgatggcttacggcaatttgatgaccaacctaatgttaaagcgattgtcactcaagcatttccagctcatgatttagggggcgcatacatgaatcggttaaataagtcggctggtggtatgcactttgataggaatgcggtaaaataataagggaacgtagtggaagaggtaccactccctaattaaaatctcaataaaataataaagagactgagtaggattcccagcctctttatttataaccagaggagatgttgtaaatgaactatggtaaaaaatcaccccaattatgggcagccattgaaaatgaagaacaacgccagcaagatacgattgagctcattgcctccgagaatattgtttcagatgctgttcgtgaagctcaagggtcagttctaacaaataagtatgctgaaggatatcctaataagcggtattacggtggttgtgagtttatagatcaagttgaacaattagcaattgattatgctaaaaagttattcaatgcagcatatgttaatgttcaacctcattccggatcacaagctaatatggcagtttatcaagcacttctcaagcccggagatgtgattttagggatggggatggatgctggtgggcacctaactcacggagcaacggtcaattttagcggaaaactatataagacgtatggctatggcctaaatccagatactgaagagcttgattatgatgaaattatggcgttggctaaaaaagtaaagccacaattaatcattgcgggtgcttctgcctatagtcgaattattgattggcaggcatttcggaagattgctgatgaagttggggcttacttgatggttgatatggcccatattgccggattagtagcaactggtgtccatccaagtccacttccaattgctgatgtcgttactactactactcataaaactcttcggggcccacggggaggaatgatcctctctaaatcgactaaattaggacggaaaattaattcagcagttttccctgggatccaaggcggaccactggaacatgtaattgcggggaaagctcaagcattttatgaagatttgcaaccagaatatacggaatatatccaacaagttgtaaaaaatgctcaagcaatggaaaaagtatttaatactagtaaacaaattaggatggtttcaggaaaaactgaaaatcatcttctcgttctggatcttactaagactggtttaacaggaaaagatgcgcaaaatctccttgaccgtgtctacattacaaccaataaggaggccattccgaatgacccacgaagtccatttattacaagtggtttgcggattgggactcctgctattactagccgcggatttaaggaagaggatgcgcaaaaagttgcggaattaatcagtacagctttaactaatcccaccgatgaagagtgtctacaagaggtcgcaaaaggggtacacgaactaaccacaaattatccgcttaactaaaaaattagaatataaaaagttgttaagatcctttgtcatgacttgatttttttggtagaatagtgaagaaattcaaaggagtgtatataggcatgggtaaatttgaagtgttagatcatccattgattcagcacaagctaacaatgattcgggataaaaatgttgggacaaagtttttccgggaaactgtcaaagaaatttcaactttaatggcttatgaagttgcacgcgatatgccattaaaggatgttgaaattgaaacgccaattgctaaaacgacccagaaagaattggctggtaaaaaggtggcgattattccaattcttcgggccggaatcggaatggttgatgggatgacggaccttatccccgcagctaaaattggttttatcggaatgtaccgggatgaagaaaccttaaagccacatgaatactttgttaagttacctaatgatattacagaacggcaattattcatcgttgacccaatgctggcaactggtggttcagcaatgatggcaatcgaagccttaaagaagcgcggttgctcagaaaagaacatgaaatttgcttgcttagttgcagcccctgaaggagttaaggctgtgcgcgacgcttatccagatgttgatatttatacagcaggacttgatgatcatcttaatgaagatggatatattgttcctgggttaggtgatgctggtgaccgtctttttggtactaagtagataattaagaattaaaagcatgatctgtagaaaactttttagctttcgcaaattttgcttttatttttttgtttgtgttgaaaaggctttcgcttataataggtactataccagaaaaggggaattgattaatggagacccaaattaatggaattgcagccagtgatggagtgggaattgcacctgcttacttattgacgaagcctaatcttagttttgaaaaatatcatattagtgaccccgatagtgaaaaagcgagattgcactatgcttttgagaagatcattcagaaactaaaggaaaccaaaaagaagcttgttaataaacttaatgcagaaaatttggcaatttttgatacccacattgcaatcttaaatgatcctgaaatgattaaacaagttgaaaaccggatcaccaatcaacgcttaaatgcagaatcggcttttgcagaagtaattactaagatgatcaaaacccttcaggcgatgactggaaatgaatatatgcaagagcgggcatctgattttcaaaatattcaagaccaggttttagcagagttagaagggaagaagctccctaatttacgtgaattagatcaccctgtcattgtagtcgcccattcgattggtccggccgatacttcacagatggatggccgctttgttaagggaattattactgatttgggtgggcggactagtcacgcagcgattatggctcgttctttacagattccagcaattgttgggtgtaacgacataaccaaaaaggtgcagaatggccaacgagtaattgttgacggctttgaaggcagtgcaattgttgaaccatcaacaaatgatgttaaacaataccaaaaaattactgataagtttatgaatgtccgtcagcaatggaaaaaaatgattaaccagccctcagtaaccgccgatggtcaacggtacaagatttcagctaatattggttcttcagtggatatttcgtcagcaatagaaaatggtgctgatggtgttggcctatttcgaaccgaatttctttatatgaaaagtgaccaccttccaaccgaagaagagcagtttaatgcttatcgccgagctgttgaacagttaaatgggaaacggttagtggttcggaccttagatatcggtggagataaaccacttcaatttatgcccttacccaaagaaatgaatccattccttgggtaccgggctattcggattactcttgatcgaccagaaatgtttaggactcagctgcgggccttactccgagcatccgagtttgggaagattaatattatgtttccaatgattaccacgcttgaagaattacgagcagctaagaaaatctattatgaggagcagcagaaattagctgttgatcatccaggaattggccgcgatatccatcttgggataatgattgaagttccattagccgcgttaaatgctgatcgcttagctgcagaagttgatttctttagcattggaactaatgacttaatccaatattgttttgcggctgaccgtggtaatgattcagtttcgtacctttaccagccgctaaatccaacttttttaaaattaattaagcacattatcgatgctgggcatgctcataatacaacggtagcgatgtgtggagagatggcaggagatcattatgcgttgccactattaatcgggatgggattggatgtctattcgatgagtgctagttctattttacggacacgttcaatgatgaagcaattagacagcaaaaaatgtcagaaactctaccaacaggctgttacaacttgtgattcaatgaccggtgtgaaaaagttagttcaagattggttggtagcaaactaaaaaggatttaggaaaagtaaagatttttcttaaatcctttttttatctcttgttaagagtaaaatggcaatagttttgctgtactagggggatgtaaagttgtgattaagcaatactggacaaagcaaagaatctggttgttaatttttttaatggttgttggaattggtgctctcttatttaccagccataatgaacagttttatcaacaaccaattgctaaagtaatcagcaaaaaaacgatgagtaaacaaagagtaaaagaccagtttgataatgttgaccatcaatataatcaacaactccaagtaaaactaatgaatggcaaatatcgcgggcaaaaattaacagtccaaaatacatatagcgattcgcaaccgatggatcaacgttatcgggtaggaaatgaagtatttttaacccagcttcgcaaacgaggcggaaaactgaccgccaatgttaacggttataagcgagacacagtaattgtctttttactttggcttgttgtcttgatgctgcttctccttatggggcgttcagggatgtttgcattcttaagcgtagtaattaatgctcttttgtttataattgcaattgagatcgacttaaagcaaaatggtcagcatatcatgctgctttttagcgttcttgccataatttttacgtttattagcttattattagttcttggttttagtaaaaggatgctggcgacttttgcggcaacagttattggaacatttgttgccttgggagtaagtatgcttgtatttatgtggacgcatgaacgggggatttactatgaatcaatggaatatgttacgcaagttcctcgaccgcttttcttagctgaaacattgttggggtctttaggagcggtaatggatgaatcaagcgatattattgccacactttttgagttaaagcagttaaatccagctgttacccgcaaacagttatttatctctggccgcaatgttggtaaatcaattatgggaccgttaataaatgttttgtttttaatttttatggtggatacctttactggtagtcttttgtatatcaaaaacggtaactcgtggggatatacctatgcaatgaatatgagcttagggactattcagagcctgatcagtgggattggaattgtcctttcagttccccttgtcagtctatttggggcattattattaggtaagaaggtgcaaaaatgacgacaattacgggccttggcttagtattgctaattttgatggtccttgtgggagggaaacagggctggacagcttttttaagcttgcttcttaattttggctttttatattttgcaattattttagtcgcgtttcatgttcccccgttatttgtaacggtaactattgggattacaattttggcaataactattttcatgggggaagatgatttgcggacaaccgtgacggcattttatgcttcactcatcgtgctatgcttaattttagtgctgatctttattgtcgagcactgggcaatggtgcagggctttggaacagaagatagtgatgagttagaagggatgtcaattttaattggaattagttatttcaaagtttctgttactactactattttgagttcactcggagcaattgcagaagcggcgatggcgatctcctctggccttaccgaaatccttgagaatcatcctgaaagaactaatcgtcaattaattcatagtgggatggcaattgggcaacagattattggaacaacatttaatacgcttttctttggcttctttggaggattcttagcactatttatttggttcttaggtctccattattcctttggtacaattatgaataacaaaatttttgtggcagaaatgattgaaattctgatctctttcatcggggtgctgatcactgttcctatgaccgcttgggtgatgacaaagcgtcgtaaagttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacaatacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaggtgcacatggtgaatactttctcgaccgctatcattgtttacagaaaattgaacatactttaggccggcacaacgagttagccatgcgagcaattaaagccgttcgtcatcatgatcaagcagagctaacaataattttagatacttatgaatcacaaaacctaacggaaaaacaagcagacgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatacaatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagataccgtcgtaaatctgttgttgacaattaccctaaaacaaagtaacatacgaataacttataaatagacctttaatcggagtcctgtgagacttcaaaggtgcggataaattttcaatgctctttccatagatttggattgagtagggaagagacgactttggagcaggaattccaaggccgttttttctttaggaggatttatatggcgcaccgtgataatgttgttttagatgtagatgaacgaccagctccctggcagtggtttggcttatctttgcaacatatgttttctatgtttggctccactgtcttggtcccaattttggtaggattaaatccaggaattgctttatttagttcgggagtaggaaccctgatgtacttactcattactaagcataagattccggcttatatgggatctagtttctcatttgtggtcccgatgatggccttaatgaaaactactggttatccgggtattgcacaggggaccattgcagttgggtgcgtatatttaatcgtatcagtaattgtaacgttggttggctcgcaatggattgaccgcattttgccaccaattgttgtcggtccgattgttgttgtaatcggattatcattagcaggaactgccgctaaagatgctaccatcaattcggctactggccattatgatttgcgcttttttgcggtcgcaatgcttacgatggcaataacagttatcttcaatatgtattttaaaggattcctcggtttaattccgattttgatggggattgtcgctggttatattattgcggtcttatttggcattgtggatttttctccagttgcgcatgcacattggtttagtttgccagactttcagattccatttgttgattatcatccccaattatactggggtgcgattttgagtatggccccaatcgcttttgttaccatgacagaacacttaggtcatattatggttctaaacgagttgactgagcgaaattacttcaaggaaccaggattgaaccatacgcttgcgggagatgggacggcttcgattattgctggtttcgttggcggccctcccgtaactagttatggtgaaaatattggggtaatggcaattacgcgtgtccattcagtttacgttattgctggagcagctgtatttgccatcttctttagctttattggtaaattaagtgccttgattgaatctattccttcaccagttattggtgggatttcattcctactatttggtgtgattgcttctagcggattgcgcgtaatgattgaaaacaaaattgattttaatgaaaaaagaaatttgatgatttcatcggttattttagtaattgggattggaaatgcctatcttcaattaggaaaatatcaattctctggattagctgttgcagctgtcctcgggataataatgaatttaatccttccacaaaaagccaaaagtgaaatgtagtttgaatttttaagcagagtaagaaaaggcatccgacctcttactctgcttttttcgtatgataacaaaacaaaaaaattaagaggtcgtggaaaaaaacagattataagaaaaagtttatcaagtctaagaaaacgctttctttacactcttgtcaattgattagtaggtatatataaacctaatgtttttttgaattttaacgaaattaatgatatattaacattcgtaacttggggtagttcgttttatttgcaacgttcatccaatttacaagccaaattattgttataaggaaagaggtggaatatgaatgggcggtgatgctttaacttttaagcttttcggacttacgttcaatactacgaacattgtttctggactgattatctacgcaatcgtgttcttcactctttacgggatgtcacgaaagatccaaatgaagcctactggtgcacaaaatgtatttgagtggctagttgacttcactaatggaattgtgcgaagccagatgccagcatccgaacaaggtcactatagtttctttgcctttgttttgtttgttttcatcttctttgcaaaccaattcggtttaattttccaattccattggaacggagctgaggtgcttagaagtccaacggcagatccagttgttacgttaacactttctttaatggtaatggtattagcattcgctgctggagtagcacataatggccttggtggatacctgaaagggtacactaaaccatttactttaatgcttcctgttaacattatcgaagactttgctaacttcttaactcttggtctccgtatttttggtaacatttttgccggtgaacttttaatgagtttgattgctaatatggcattctcacatggaatcctaactattattccagggttgttcttggaactagcatggcaaggattctccgtatttatcggttcgattcaggcatatgtctttgtaacattaacgacggtttatatttctcggaagatttccgaataataatccctaaggaggaattttaaaatggcattaggagcaattgctgcaggactcgcggctatgggtgccgctatcggtggtggtatcggtgacggtatcttaatcggacacacagttgacagtatcgcacgtcaaccagaattacaaagtagattacaagcaacgatgtttattggtgttggtttgattgaagccatgcctattattgccatcgttattggcttccttgttatgaacaagtaattattttaagttttttattttaagataaggaggtgtcaatagatgtttgtaaacagtgtgttagctgaatcaaacagtttatacattggtgacttggtattctacatcgttacttttatcatcttaatgctattagttaagcattttgcttggaaaccggtaacagatatgatgaagaaacgtgcagataagattgctaatgacattgataatgctgctcgttcacgtgaaagtgctgaaaagatggctgcaaagcgacaagctgagttacaaagctcacggcaagaagctgctgagattgtaagtaatgctaaaaagtctggggaaactcagcgagcacagattgttgaaacagcgcaaaaagatgcccaagctctcaagcaacaagcacaaaaagatgctgagcaagcacgtcgcgatgcattaaacagtgctaaggatgacgttgcaaacttatctattgagattgcttccaaactcatccaaaaagaattaaaggcagacgatcaaaaagaattgatcgattcctatatcgaagggttggtagaacatgagtcttgataagaagacagttgctgatcgctatgcgaaagcactgtttgaattggtcgatgctgataacgaactcgatcaaacttatcaagaattgattgctttacgccaagtctttgaggacaacgagggattggacgccgcacttgcgggagttcaactgtcacttgatgaaaagaaatcattgattaaagatttacagcaaggtgcttcaaagtacgttgctaacttaattcaaatggttttcgattacggccgtattgactgcatggtcgcaattattgatgagtttgaacggcggtatgaccgtaaaatgaagcggatgcatgctgacgttaccacagcgatccaactcgataaacaacaagaggatcaactaaaggctaatcttgcaaaacgttttggtgctaatgaagttaccttaacagaacatgttgatccagaaattttaggtggggttattgtccatgttgataataagacattagatggtagtctcagctcaaagattaagcaaattcgtcgtttactagttagataaatatatcttttttcaaagaggtgagacctttatgagcattaaaactgaggaaatcagttcactcatcaaaaaacaactcgccaactaccaagacaaagtatctgtcgaagaaaccggtactgttacctatgttggtgatggagttgctcgtgccgatggcttagataatgctatggctggtgagttgctcgaatttagtaacggggtctacggaatggctcaaaacctcgaaagtaatgatgtaggtattgttattttaggggattacacaggcattcgtgaaggagacaccgttaagcggacgggtcgaatcatggaagtacccgttggcgatgcattattaggacgggttgttgactcattaggtcgtccaattgacggtcttggtgagattaagacagataaaactcgtccaattgaacgtaaagctccaggtgttatggagcgtaagagtgttagtgtaccacttcaaactggtattaaggttattgatgccttagttccaattggacgtggtcagcgtgaattgattattggtgatcgtaagacaggtaaaactgccattgcgttagacactattattaaccagaagaaccaagacgtaatttgtatttacgttgctattggtcaaaaggaatcaactgttcgggctagtgttgaaacccttcgtaagtatggagcattagattacacaattgttgtttcagctagtgcttcaaatcctgctccaatgttatatattgcgccatatgcaggggctgcgatgggtgaagaatttatgttcaacggtaaagatgttcttattgtttatgatgatttatcaaaacaagcggatgcataccgtgaactttcattaattcttcgtcgtcctcctggtcgtgaagcttaccctggtgatattttctatactcactcacggttgctagaacgtgctgctcgtttgtctgatgatcttggtggtggttcaatgaccgccttaccaatcattcagacccaagctggtgatgtttctgcatatattcctactaacgttatttctattactgatggtcagatcttcttagattcagatgaattctatgcaggtcaacgtccagctatcgatgctggtacttcagtttctcgtgttggtggtgacgctcagatcaaagcaatgaagaaagttgctggtactttgcgtttggatattgcttcatacaacgaattagcatcctttgctcaattcggttccgaccttgatgcagctacgcaagctaaattggctcgtggtcaacggactatggaagtcttaaagcagggattacatgatccgctaccagtagaagaacaagttgtaacattatttgctctttcacgtggttttatcgataaagtcgaaattgaagatgttcaacgttacgaaagtgaattggctgcttacatgcatgctaaccaccaagacctctacgacaccatcaagaagactggtaagctaccagaaggcgatgacttgcaaaatgctgttgctaagttctctgaaacatttcaaggaactaaaaagcaagccgctgaagaaaaatagttaatgatgattagtcgaaaggacggtgagatttagtgccagcttcactcgctgcagttaaacataagattgattccactaagagtacgcgtcagattacttcggcgatgcaaatggtttcaaccgcaaaactgaatcaaattcaacaccacactcagacctacgaagtatatgctgagaaggttaagcaaatgttgtctgatctggttaaatctcacagcgcaacatctgcagcttcgcaagatgatgtttacgctgcactgtttaaaaagcgcgcagttaaaaagactggggtgcttgtgattacgtctgaccgaggtttggttggtagttacaacagtaacattatcaagcaaacgttagatatgatggctaagcacaatcttgataaagacaacacggtatttctgacggtcggtaaaacagggacagaattctttaagaagaggggaatgaatgtcgtttacgaatattcaggcgttagcgatgttcctacctatcgtgaagttcacagtattgtgaagaccgctgttcaaatgtacagtgatcaagtatttgatgaaatgtatatggtttacagtcattatgttaaccggattacatcaaatgttattgttcacgatgtactcccaattactgaaaagtcattactcaatgacgaaaatgaagcacaagaaaatacagaattaaataattctgatgtaagtactgcgcacgtttctgccgagtatgaatttgaaccgtcagatacagaaatcatttctgcattggttgcccaatatgcagaaagtttgatttatggagcgattcttgatgccaagacatcagaacactcttcaagtgcgaatgcaatgcgttcagctacagataatgctgatgacattatctctactctcgaattgcaatataaccgagcacggcaagcagcaattaccactgaaattacagaaattactggtggtatgactgctcaagaataattttttctaacgtaggaggaaacaacatgagttctggtaaagttttacaagttatcggaccagttgttgatgttgaatttcccttagacgaaaaacttcctgaaattaatgacgctttgaagattaaggaaagcgatggtaagactttaacaactgaagttgccttggaattaggtgatggtgttgttcgaacaattgccatggacggtactgatggtcttcaacgtggtatggaagttgaaaacactggcgcatcaattagtgtaccagttggtgatgatactctgggacgagtatttaacgtcttaggggaacctgttgacaacggaccgaaatttggtcctgatgcaaagcggatgcctattcaccgcgatgcaccaaagtatgatgacttaaacaatgctaccgaaattttggaaactgggatcaaggttattgatttactagctccatatgttcgtggtggtaagattggtctattcggtggtgccggtgttggtaaaaccgttttgattcaggaattgattcataacattgctcaaggtcataatggtatttctgtcttcacaggggttggtgaacgtacccgtgaaggtaatgacatgtactatgaaatgaaggcctctggagttcttgaaaagacggccatggtttatggtcagatgaacgaaccacctggtgcccgtatgcgggttgccttaactggtttaacaattgcggaatacttccgtgatgtaaagggacaagatgttttgctctttatcgataacatcttccggtttacacaagctggttcagaagtttctgccctcttgggtcggattccttctgccgttggttaccagccaacattagctactgaaatgggtcagttacaggaacggattacttcaactaagaagggatctattacgtctattcaagccgtttatgttccagctgatgactataccgaccctgcaccagctacgacatttgcccacttggatgcaactactaacttggaacgtcgattaacccaaatcggtatttatccagccgttgacccattagcttcaacttctactgctcttactccagaaattgttggtaaagaacactatgaagttgctacacaggttcaacacgttcttcaacgataccatgaacttcaagatatcatctctattttaggtatggatgaattatctgacgaagaaaagacaatcgttgctcgtgcacggcggattcaaaacttcctttcccaaagctttagtgttgcttcccaatttacaggtttacctggtaaatatgttccattaaaggaaacaattaaaggctttaaggaaattcttgctggtaagtatgatgatcttccagaagaagctttccggttagttggaccaattgaagacgttgttgaaaaggcaaagaaaatgaaggctgagactgacgaagatagctcagaagactaggagggataattatggctgaaaatacttttaaggtcactattattactccagatggcaccgtctatgataatgataaggttactatactcgttatgaacactgctggtggacaaatgggaatcatggctaaccacgtaccattaattgctgcacttgaaatcagtacagttcgaattaaacattctgaaggcactgatgaagttgcagcggttaacggtgggatcattcaatttgatggtcaaaatgctacaatcgcagctgatagtgctgaaatgcctgaagcaattgacgttgagcgggcacagagagctaaaaagcgttctgagtctgcaatcgaagaagcaaagaagaagcataaccagagcgatttatcacgtgcagaagttcacctcaagcgtgcaattaaccgtttgaatgctgcttctaagcaacgcaatatctaaggtataatatcaaaaagaggttggagaaaataatccaacctctttattatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattttaaagtgtaaactgctaaaacgcagtagctgcctaactatctttacggggtgggactaaaaactcgcaagcaatttagtctcacttccttttcgtttaaaagatcattaagcttttttacgaattaataatttaatcatgtgatatgatatgattgaatttagtttaaaagagggtgatcgattgcaaattacaggattacgagcgctaatagaaataatagtgcaactggcatttgtctggttagcgttttttgctattcaagggatacattttgagcatttttttaaccgaccaccacgtacattgcctctacttattgttctgatggctactggactaggatatttatgtgcgacatttttcttaaatatcctaagtgcaattggtaatttgacatatttaattcgatagtatttactggaggatcttatggaaaaaattgttgttaagggcggtcagaggttaaccggtcgagttaaagttgaaggagcaaaaaatgcagtcttaccaattcaagcggcatctattttggcttctagtggaaacattaaattatcaaatgttcccattttatcggatgtaacgacaatgaatcagttattacggttcttaaatataaaagtagattttgataaaaataagcatgttttaacaattgatgcagctgaccctgtattatctgaagcaccattagaatatgttagccggatgcgggcatcgatggtagtcttaggccccttgctagctcggacaggtcatgcgcaaattgcgcttcctggtggatgtgcgattggttcgcggccaattgatttacatcttaagggattacgtcaattaggagcggttattgagcaacacgatggatacttagaagcacgggctgaacacttaattggtgatcatatttatctagattttcctagtgtcggtgcaacgcaaaatctgatgatggcagcaacccttgcgcagggaattacaacaattgaaaatgccgccagtgagcctgaaattgttgatttagcaaatatgttgaataaaatgggtgcacgtgttcatggtgctggaacagacattatccggattcaaggggttaatttccttcatggttgtgaacatacagtaatgccagatagaattgaggcaggaacatttatgattgcgacagccattactaatggtgatgtagtggttgaaggagcaatcgctgagcataacacctcactaattgctaaattggaggaaatgggggtgacagtcatcgttcaagaagacgggatccgtgttcttgggacttctgttctaattcccacgaatattaagactcttccatacccaggatttcctactgatcttcaaccacaaatgtccgttctccagcttttggcaaatgggaccagtaccctagatgagacgatttttgagaagcgttttatgcatttagaagaattacgacgaatgaacgccgattttcaaattaatggtccagttgcggttttaaatggtcccacgcgttttagtggcgctgaagtagctgcctctgatttacgagcgggggctgctttagtattggccgggttagttgctgatggaattacccaggttcgtaacctaaaatatattgatcggggatattaccatcttcaccaaaagttacaacaattaggggccaagattgatcgaattgatgtcgaggataaaattaaattggcggtaaagccttctaagaataaaacaaatcaagattaaagattcgtaagcgacgtctatctatatccctattttgtggtataattacgaacggtattaacgagtttagtgttaaaacttaactagctaaaaggagaagaaattaatggcaaaggatattggaattgatttgggaactgccaatgttttgatttatgttcaaggcaagggtattgttctaaatgaaccgtcagttgtggcggttgatacaaaaaccaataaagtattggctgttggttcagaagcataccgaatggttggacgtactcctagtaacattcgggctattcgtccattaaaggatggagttatttctgattttgatgttactcaagaaatgctttcctactttattggtaaactaagcgttaaagggtttatgtcaaagccaaacatcatgatctgcgcaccaacgaatattactgagattgaacgaaaggcaattattcaagccgctgaacaatctggtggtggtaaagtttaccttgaatacgagcctaaagtagcagcaattggtgctggattagacatttttaaacctcgtggaaacatggtcattgatatgggtggtggtaccagtgatatcgccattctttcattaggcgatattgtctcaagccagtcaattcggatggccggtgataagatgaatagtgatattgcttcttatattaagaataagcacggcctagtaattggtgaacatactgctgaaaagatcaaaatggaactcgggactgcattacgggttgatgatcctaaaacaatggatgttcgtggtcgtgatgtagctactggaatgccaaagcaaatcacggttaatgaaaatgaaattgaagaagcattgcacgatacgcttgaacaaattgtttcagccgctgtaaatgtattagaaacaattccaccagagttagctagtgatattattgaccggggaataatgttaaccggtggtacttctttgttaaagggtgtcgatcaattattcagtgctcgtctaaaggtaccggttgttgtttcacaagacccattagacaatgttgctaagggtgctggtgaaatgttagaacggatgcaaaagactgaacgaaagaagtaagttgaaatggtaaggattttatgtgaccttatacgctggtatcaacaaggcatttccgcccaacgaccatttcgcgtatgtcgctttaccccctcatgttcacagtacatgttagaagctttacaacgctttggtttaaaggggatgttgctcggaagttggcggctccttcgttgtcagccgttttctcgtggtggctatgatccggtacctaatcattttacttttcgtcgtcaggggtaataatagttattaagggtgaaaaagtgtcaaagaaagataaaaaagtagaagtcagcgttaaagatattgaacgtcgtaatcaaccggttcaacaaatttttattggagaccgattgattggtgaagttgtaaccgataatgaacgtttcaaagcaatgctgataagtgaccagagcgaattttatgttcgttctcaagaagagggattagaaatagtccttcaacaatatcatcttcaccagcattagtttggtgaaccatcctctttgattaatattttgtaaaggagtttggtaatgcaacgttcgcaaaatgatgtagaaagtcggattgactggggaattatattttgtgttcttttgttagccttgattggtcttgcttcaatctatgtagcggcagttcatgatcggcagcaaactagtgtagcacgacaggttattacccagttggtttggtatgcggttggaacaatccttattattgtcattatgcaatttgatgctgaacaattatggaaattagcaccaattgtatactggctaagtgtatttttaatgttcgcaatcctagtattttatagtcgagcctattatgctagtaccggggctaagagttggtttgcaattggaccatttacgtttcagccttcggaaataatgaagcctgcctatattttaatgatggggcgtgttattacgactcataataaccgatatagtgtgcatactgttgattcagattggcgattaattgggacgatgttcttatggctattaccaattttaatttcgctgaagtttcaaaatgactttgggactgggttagtattcttcgctattttctgtggaatggtcttagtttctggagttacttggcgaattttggcgccagcagctacgatattagttgttgttgggggctcagccttagcgatggtaactagttcggttgggcgacaaatacttgaacatgttgggtttcaagcataccagtttgatcgggttgatacctggcttcatccagaacaggatacaactaaccaagggtatcagttatggcagagtattaaagcggttggttcgggtggtattactggaactggttttaataactcaaaggtttatgttccggttcgtgaatcagatatgattttttccgttatcggtgagaattttgggttcattggtggggttttattaatccttatctacttgttactgatctacttaatgattcgagtaacattcgataccaagaacgaattctatgcttatatctcaactggagttatcatgatgattttattccacgtttttgaaaatattggaatgaacatcggtctattaccattaacaggtattccgcttccatttattagtgctgggggatcctcattaattggtaacttgattgggattggaatggtaatgtcgatgcgttaccatcatcattcttatatgtttagcagtaatcgtgaatttagatagtgaggttataaaatggcaaaagattatttttgggtaaaagagcaagcagatggtactaagcgtgtcggcttaaacgatgaaggccgtgatgagttaggagaagtaagtttcatcgatgtaccagcagtagggacaactttgaaacaagctgacaaatttattgcagttgaagcagaaaaagcagttaccgatgtggatagtcctattgatggtaagattaccaaaataaatgaagctattattgatgatccggctggattaaattcaagcgatatggaaaaaaactggattgttgaagttaaataaaaaataggagactaggattaggggaaccttgattttagtctcctatttagtattggcggatctttccagttcatgttatacttaaggttctaggaaaacggctaagataaaaatatttaaggtggtatttattatgaccaaaaaattacacatcgctttattatttggtggtaactcctctgaacatgatgtgtcaaagcgatcagcacataatatctatgatgctcttgataaggaaaaatatgatgtaagtctttttatgtttacaaaggatggaattctattaggcaatgaggattctcaaaagatctttgatggtgaacctgaagaccaagtggtagcagaagcatatcaaaagatggatatgagtagtccattagcaccaattatggccttaaacgaacaaaaggaaattgatttcttcttccctgttatccatggtaatttaggtgaagatggtacaattcaaggcctctttaagctccttaataagccatacgttggttcaaatattgcagctagtgcgatgtcttttgacaaggatcttactaagaagattattagtcaagctggtattcgcaacaccccttatgtagtagttacgccagaaaaccgggctgattattcatggagccggattgaagaaaaattaggtaatctcacttttgtaaagccagctaagcaaggttcctccgttggaattcatcgagttactaacgctgaagaatatgaaaaagcgttagatgatgcttttaagtatgattacaagatcttagtagaacaggggatcgctaatcctcaagaaattgagatttcaatcttaggaaatgaacatccaattgcctctaagttaggagctgttcgtgtacctaaggacgatccattctatgattacgaaaacaagtttgtggatgccagcggggttgtttttgaacttcctgttaaattaccacaatacttagttgatgaaattacagatatggctttgaaagcatacaaggcattaggaatgaagggaatggctcggattgactttttagttgacagcaataatgtcccttatcttggtgaaccaaatacattaccaggatttactaacattagtctgtaccctcaaatgtgggaagtttctggtatttcatattctgacttgattgatcggttaattcaattaggattacaagaatttgaacgaaacagcaagattaaatacgacttccgtaagcttggtactgaacgtgttggtcaaaagaaatataacgaagactaaagaataattatttaatggttaggatgttgtgaagacaatgtgctaactatttttattattaaaattatagcaggaagtaaatattatcgtaatggtatgaaatccgtggtttagtattgcagtaagcaaaatttataatataatgaagatacgtagtttttgtaagcgttagagtagcttacagtcacactacttatagtactttataaccatcgcagggggtgactttgaaggtggttataagcatttattttttataaaatttattgtattttaagcataaaaatagtattgatttatttttggtctataataaaagacctaggtaaagccaaagtaatttttgttgctgatggtggtataataccattggcaatggtacagttcatagagtacatattttatattcaacaattatgattaaggaaggtaaacaatgagactccgaggagacgtattaaaacaaattcgtcgcaagcgtggattgtcccaaacggctttagctgaagggatttgtactcaagcgacaatcagcctaatggaaaaacaaaatcgcttacccaaaatggatattttaacggcaatatgtgaacgcttaaatatttcttctgatcgaattgtcgaaaatgaagttagtggaattaatgaaacattcaaccaaatcgttgataatttgatttcacgcaattttgaagatgcttcagcgcttttgaagaaggttcatgtaaaaaatctagaaagtgattttgataaacaacgttactactatctagtaggaatggttcaagttgaaagtaatcaaattgatgaagccatttttaattttgaacttgttttaactcaatttgctactactagtgctaatatttatttagctatgacaactgcaggaatggcgcttgcttacttaaaacgtggtgataaagaacgggcagcacggttaactaaccggtctgtaaaactgattgataataaaaaattgattgggagcctttatcaatgggcatcaattgattgtcaaattgcagaattatatctgcaacttgaagaccctgataacgctattgaagttgctaataagggaattgaactttgtcgggaacatgattcattattcttattagatgaactatatctttgtataggtcgtagctacatcctaaagaacgacaaggaagaagctaaaaaggctttaaagattgctgaaagtcttagcattgctcgtaatggatcagtagcagaagatacaattctattagagttaaagaatttagaaatttaattaatatacgtaactgaaaaacgaagctgagagatggttaagatgtctcagcttcgttttttagtataaatttaaatatttatccgtacaaataattaataaaaacttaattgattattaaagactaatttcagtttatgtgcattaaacgagaattagtcttttttagtagtaaaaaaataaaaatatttttcacatgcataactgcttttaaatacaagatagacatgaaattgttaaatgtataaaatgctttttcacaattggttatgattaattttaaataattcacttgatttatacgtacaaatattttatagtaataattgttcaatgaaagcgcgttcatgttcatgaaaaactattactttttaatttttaaggaggatgaatgtaatggctaaagccgagaagaaaatatcaagtgcatttatctacttcttcggatcatttgggggcatcctatttggttacgatatcggtgttatgactggtgccttacctttcttacaagctgattggcaccttgaaaatgcagcttctctagttggttggattacttcagcagttatgtttggggctatcttcgggggcgcattagccggacaactttctgataagtttggtcggcggaaaatgattttaatgtctgcgattgtattcatggtattctccgttttatctggtgtttcaccagacatgggcgaagcaagtgcctattatctaattattgttcggatgcttttaggtttagcggtaggggctgcctcagccttagtaccagcttatatgtctgaaatggcaccagctaaagcacggggacgtttatctggacttaaccaaacgatgattgtttccggaatgttattatcatatgttgttgacttcctattgaaagaccttcctggtgaatgggcatggcgtcttatgttaggattggcagctgttcctgctttaatcttattccttggtgttcttcgtttaccagaatctccacggttcttattacgtaaaggtgatgaagcgcaagccaggaaagttctttcttacattcgtaaaaatccagctgagattgaccaagaattagcaagtattaaagaaaccgctaaagaagagcgacaagcaaatcaaaagacaagttggtcaaccttattcagtggcaagtatcgttacctagttattgctggggttggggttgcagccttccaacaattccaaggtgcaaacgcgatcttctactacattccattaattgttcaaaaagcaactggccaagctgcatcttcaaacttaatgtggccaattgttcaaggggttatcttagttgttggttccctggtttacatgtggattgctgataaatttaaccggcggacattgttgatggttggtggtgccgtcatgggactttccttcattcttccagccgttattaattggatgataccaaatatgaatccgatgacgattgttgtgttcttatgtatctatgttgctttctactccttcacatgggctccgttaacatgggtgcttgttggtgaaatcttcccactagctatccggggtcgtgcctctggtttagcttcatcatttaactggattggatcatggttagttggtcttatcttcccaattatgacggcaagtatgccacaagaagctgttttcgcgatcttcggaattatctgtatcttaggagttatctttgttaagacttgtgttccagaaactcgtgggcacactcttgaagaaattgaagagcaaggaacaaaccatggtcgagtaaaggccagcaatcctgaaaactaggaggaatactctatgaatttacgtgaaacagcgacacaagtaaaaaatggtcaggcttcactaggaattgagttaggctctacccgaattaaagcagtcttgattaatccagattttgaaacaatctcttctgggagctatacctgggaaaaccaattgaaagacgggatctggacatacccgctggatcaggtttgggaagggattcaagctgcttatgccaagattaaggcagatgtccaaagcaagtaccatgtgagcttggatgaaattagttcaattggtgtcagtgccatgatgcatgggtacctaccatttgataaaaataaccaattacttgttccatttagaacctggcggaataacatcactgaggaatccgcagataagttaactgatttatttgattttaatattccacaacgatggagtattgctcacctctaccaagcaattttgaacaaggaaccgcatgttaaagacattgatttcattacaactttagctggttatgttcactggaaactttcgggtgaaaaagttttaggaattggggatgcctcaggagtatttccaatcgatgatcaaacattaacttatcatcaagactttattgacaagttcaattcattaccagaagttgaacaatacccatggcaacttaagaatattttgcctgccgtccttgtagctggctgtgatgctgggcacttaactgctgatggagcaaaattacttgatccaagtggaactttacaagctggtagtttgatggcccctccagaaggggatgcaggaactggaatggttggaactaacagtgttcgaaaacggacaggaaatatttcggttggaacttcagccttctcaatgaatgtgttagatgctccattaaagaagcttcaccgtgatattgatattgttactacgccaaccggtgatccagtagccatggttcatatcaataattgttcttctgatattaacgcctgggttggattatttagagattttgctaatacaattggagccaagatcgataccaatacgctttacgagaccctatttgattcaacggttcactccgacccagatgctggtggattaattaattatagttatctttctggtgaaaatattaccaagattcaggaaggacgtcccctatttgtccgtactccaaatagtaagatgaacctcgctaacttcttccttactcaactctatgcagcatttgcgccattgaagattgggatggatatcttactaaatgaagaacacgttcaaaccgatgtcatggttgcgcaaggaggactctttgggacaccagttattgggcaacaagttttggcgaatgccttaaatatcccaattacaatcatgaatactgccagtgaaggtggaccatggggaatggcggttcttgctaagtatgctgagacgtacggaaaagaatccctagcagattaccttgacgaaaaagtctttaagaatccagaaagtatgacccttacaccagaacctgctggcgtaaaaggatatgaaagctttattactcgttaccaagcaggcttacctgttgaagcattagctggtgatgacattaaagaacgtgaagagaaagggagtaaatagtacatgttagaagatttaaagaaagaagtttataaagcaaatatgcggcttcctaaactaggccttgtttcctttacatggggcaatgtttcagggattgaccgtgaaaaaggattgtttgttattaaaccttctggagttccatatgaagagatgaagccggaagacatggttgttgtcaacttggatggtgaggtagtcgagggtgacttgaatccatccagtgatactcctactcacacttacctttataatcacttcccaaagattggtggagtcgttcatactcattcaccatgggcagtagcgtttgcagctgcacggatggatgttccagcaatgaataccactcacgctgatactttctatactgatgtcccagctgctgatgctttgacgaaggaagaaattgaagaagactatgaaggtaatacaggaaaggtaatcgttcgttcattcaaggaacggggtttggactatgaagcaaccccagcggcattagtaatgcaacatggtccatttacctgggggccaacacctgacaaagcagtttataatgctaaggtgttagaagttgtggcagaagaagattatcatgcaatgcaattaacgcaccaagaccttcacttacctcaatacttgttggacaaacactattaccgcaagcatggtgcgaatgcatattacggacaaaataatgcgcattcaaaagatcatgcagctcacgcttaattaatttggtagctacatttaaaaacttttttaggataaaaggagtgtaatctcatggatattaagaattacgaattttggtttgttactggtagtcaattcctttacggtgaagaacaattaaagtcagttgctgctgatgctgaagatattgttaataagttaaacgaaagtggtaagttgccttacaaggttgtcttcaagggtgttatgacaactgctgaaggaatcactaagtttatgaaggaagctaactacaatgacaacgttgccggtgttatgacatggatgcataccttctcaccagcaaagaactggattcggggaactaagcttttacaaaagccactgcttcacttagcaactcaatacttgaacaagattccatatgacaccattgactttgattacatgaacttaaaccaatcagctcatggtgaccgtgaatatgcttacattaacgctcgtttacaaaagcataacaagattgtttacggcttctggggagatgaagaagttcaagaagaaatcgctgactggcaaaatgttgcggttgcttacaacgaaagctttaacattaagattgttcgttttggtgatacaatgcggaacgttgccgttactgaaggtgacaaagttgaagcccaaatgttccttggctggactgttgactactggccagtaagtgacttagtagaatatgtaaatggtatcagtaaagaagaaattgatgctgcttacaaggacttagcaagtcgttatgaaatggtccaaggtgataatactaaggaacactatgaacactcagttcgttaccaacttcgtgaatatcttggtttgaagaagtttatggatgaaaaaggatacactggctttaccaccaactttgaagacttgcatggccttgaagaattacctgggttagctgctcaattattgatgcgtgatggctacggctttggtgctgaaggtgattggaagtctgccggaatggatcgcttattgaagattgctgctgataatgttgctactgcctttatggaagactacacattagaccttcgtccaggtcaccaagcaattcttggttcacacatgcttgaagttgacccaacaattgcttcagataagccacgagttgaagttcacccattagacattggtggtaaagatgacccagcacggttagtatttactggtcgtgaaggtaaggctgtcgatgttaccctttcatacttcaacgatggttacagggttattggttactcagttgattgtcataagccagaagctgaaacgcctcatcttccagttgctaagcagttatggacaccaactgttggcttaaaggaaggtgctgaacgctggatgcatgctggtggtggtcaccacacaatcttgagtttcagtttgaaaccacaacaaattaaagatcttttcggaatgttagatgttaaagttgattttattgaatagttaattcaaattaaaaatcctcaaaatggttctactcggcaaacctcgagacgagtagaaccattttttatcaggagatggaaaaataaaaactgaaaaagagaaaatgctagcagaggaagcttttaacgtttacgatcccgaattagttaaagagcgtcaatatgcccgtcaattagttgagcgatttaatgctcttggcgagatgaacccgactgcaagcaatactgtgattcgtcaattgtttggacacgttggcgaaaaatgtgaagttcatccgcaattcaaatgtgattatggttataacatttatgtagatgatgattttttcgctaattatgattgtgtcatgcttgatgctagtccaattcggattgggaagcattgtttattgggaccgtgagtgcagatttatactgttaatcatctcttgaacccacgattacggcgcaatggagcttacggccaaagtaaggatgtcactattggggataatgcgtggattggtggcggggcaattatttgtccaggtgtaactttgggtaataatgtaattgttggtgctggaagtgtagtgacaaagtcgtttggtgataatgttgttattgcgggtaatccagcacggatcattaaagagaatccatatgtagaataattgattatttcccaggttatttttaatgcaaaaagggaactaagatatggtcatgtgacggccgttatcttggttccctttatcattcttaatatttaaggttatattcgtaaactagtgctggttctttacctacgcgtgtaaagttatttaagttattaatagcagtcatttcctcgtcgcttaatgtgaagtcatagatgttaatattttgcttgattcgcgcttcatgaactgacttcggaatgaaggcgaccccgctttgcaaatgccagcggaggacaacttgagcagcagacttatgatggttagcagcgatcttattgagggttagattgtcgaggatggttccacgcccaagcggactccacgcctgggtaacaatatcatgttccttatcgtattggagcaatggttgttggtttaggcgaggatgacgttcgatttgattaataacgggcatctcatgcgcttgagtagcaagatactgaaggtgaatcatttgatagttactaacaccgattgaatgggtcagaccttccttttttaattcttcaagggctgcccaagtatcaaagaaagctcgctcaattggccaatgaataagtaaaaggttaacataatcaagcctcaacttttgaagggagtctttaacagaggcaattgtttgcttaaacccttgattaggttcagatacttttgtggtaataaaaaggtcctcacgaggtaaaccaagctcttgtaaggcgtttccaacctctgcttcgtttttatataattgcgcggtatcaaaaagacgatagccagcatcataggcatactttatcgcggaggtaatcgtactttgatcagtaattttatataagccaaatccttcttgaggcattgattgaccatcagcaagtaataattgttttatcttattattcattgatattctcctttgtaataagcgaagtggtcgattgtcccttaattattgttggggtataaacttttgaagtgacttcttcgcctgcaatcatttttaagatcattttcccagcatcttcacctagttgacgtttggggtgattagctgtagtgaggctgggggagataatttgcgccatttcatagttatcaaaacctattactgaaatatcagttggcacttgttttccatgtttttgaagatgactaataactcttgtggcaaggcggtcattatagcaggcaatcgccgtaatatcattattactattaagcatcatgtcgacttttttgataatatcttcatagtcttcgcttgattggtacataataacatttgatttagtagtggggatattgttatcttgataggctttgatcattccagtcatgcggtcaacgccttgctgatcatctatttggaatactcctaaaatattagtatgtccgaggctaaagaggtattttaccaaattctcctctgcttcccggtcttttgtcagtaaagaaggaaaatcaaagccaggataagtagagtgaaataggattgttggaattttatatttctggacttgccgataaaggtctaagttaggattaggcatggcgctttcagtcggctcaataattaatccagcaatttgaagatccaacatatttaagattgtttggcgttcacgtttatggtcattaagcgtatttccaacaatcattgagtaaccttgttctgttaccacactatcaattccggaaatgattggagggaagatatagtcagccatatgagtgctgattaccccaatgattttatttttttcgctttttgtccaatcgcgttgccagtcttgaacaaacatcccaccaccttgaatacggtaaatatagtgctcgttttcaaggtccccaacagcgcgacgaattgtataacgggacacattaaaacgtttcattaaggcactttcagttggcagtttttcattgattttatattttccatcaataatttcgtttcgtaaagtttgctttactgtttcatatttcacttccaatgctttgcgctcctatcttaataaaagtagttttgaatatataaaaaatgctccatataattagcaacctgctaacgcctatgaagcatttgattgattttatcttgatatttagaaccgacgcttctttggattttcgattggcttgttatccaaatcggtccgtactactagaacatcgcaaatggctgttctagtaacaaattcggtaacagaaccgatcaaaattcgttcaacagcgtttagcccagtagcaccaatcatgatgaggtcagcacccatttcctttggcatatcccgagcaataattgtctttggagcaccatattcaatggagtaactagcgttttcaacaccgtgctctttagcatagtcgatgtacttgtctaaagtcttctttgcagtttctgtaacttgttcaaccattgaagtatcgaaactagaaatattttggaatgcacgtgtgtcaacaacgtgaagtaaacgtaattcagtgtctgcaccattacgttttgctacagcaacagctttcttaaaagccaattcagcttctttagaaccgtcaacaggaactaaaatgtgtttgtattcttgtgccataattgtagtgccctcctgaaatctttatattatatacttattatacactttttcactattgagcgtaaagcgcctacgaaacattacttgcgatgatttatgcgaaaatcagcagtaattgcgaaagacattaacgtttcgctgacacagccaatgattaccataataactagaaatccagtattgtttgtccatccagaaatgatacttagaataccgacgacggtcatcacaatcccccaattttttaattgtggagctaaatatttgcttttagtaggatcgaaaataagaaatggcttatggatgtgggttaagagaaagactccttcaaaaagagcaattaaaccaaatagagtcattagaagtggtaacaacataaaaatctatcctatctataatgaaattaaaatgagggtgagaaaaagcaaaaatctttctcaccctcactaaatatgtacgaaaactccgttggtgccgttaattgtcattcagtgttgacctgtgtttaagacaggtgggacacggctgcctaatattcaactaccaagtgtaaaggcatgttgtccaaaaggcaatgcactagtcccaaagtaataagactgtaaggcaaacctgcgtttagacaacgcgtacactacagaattttcacttttataatagcatttttaagtggttgatgcaattatttgctcgggtgatatttacctcgtaaagtatgttgctgggccttccgtaattgccaatattgccggcctaaactggcttcaaaacgaccattattttttggctggtaatattgagcatctttgattcggtcaggtaagtattgttgagctacccaatcttggggatagtcatgagggtaatcataatctagtccatggcctaacttagcagctcctttatagtgggcatctttaaggtgagctggaacgtcaccaaagccaccttgccgaacctgagcaagagcttcgtcaattgcattaattcccgaattggattttggtgacaggcataattcgatgacagcatctgctaagggaattcgtgcctccggaaagccaactcgttctgccgtttgaactgccgtaacagctcgttgtacagcaggcatattggcgagcccgatatcttcgtaggctgtgatcattaaacgtcgtgcaataataggcaggtcaccggcttcaattaaacgtgcaagatagtggagggctgcatcagtatctgacccgcgaatagacttttgaaaggctgagatgacatcataatgagcatcgccatctttgtcagcggataacgcctttttctggacgctttcctcaataatcggtagcgtaagatgtattttcccatcttcacttggatcagttgatttggccgcaagttctaacccatttaatgcacttcgaagatcaccattggtcgctgctactagttggtcctcggcgttttcttcaaggactaatggtagattacccagaccgcgttctttatcaactaatgcacgctggatagcggtcttcatttcatcagttgaaagtgagtaaactgggaaaatttgcgtccgactgcgaatggcgggattaatactaatatatggattttctgttgtcgccccgatgaggataattcgtccgttttcgaggtgcggaagaagaaaatcttgttttactttatctaatcgatggatttcgtcgagtagtaagattacagttccgctcatcttagcttcttctgcgacgatttgtaaatccttttttgtatcagttgccgcatttagttttcgaaaagcatatttagttgaaccagcaatcgcactggcaatgctggtcttaccagttccgggagggccgtatagaatcattgaagaaagcatttttgctttaaccatgcgtgagatgattttacctggtccgacaaggtgttgttgaccgaccacttcatctaacgttcgcggccgcattcgataagcaagtggttgttgcatatattagccacgatcctttctatggaagagatggtggaaaaaactttgatgttgatcattgtttttttcagtcatactactatttgaatttaccagattaggatatcgttttttgacgtcgactggtgattggtaaacagctgtttttgccgccacgacaactgctaatgagcctgggtcagttttatattctggatcagttttcaatgtaaattgagcattatctttagcagcagtttgaatgtatggatgaatttcgtcgtgagggagattaccgttgataaaaacaaggttgccaattccacgatctaactcggcagttaatgcctttgtccaatcttgttcctgtagttcttgaacactaattgttagacagacgcgttcacggaatgttccgagatattttcgctgttcatcgggcttgatttttggtgtaccgtaaacagcattgtcaattcgctgttgagcagcacttttttcttgttcagacatattgaacgcctccttatcatgcaattgtaacacgaaatgcagaaaactatatttcttgataatgttataatttttgttatatcatgactatgaagaaacaaaagtaggctaacatataagggaagtgattattatgtttagtgcagtattttgggttttagcattttggtttattgtcaatctagtctggacaattgcgcgccttaataatcggatgatgtcaagaacgtttgcctggataaatgtagtggcagtagtaattggtttttggacgttttacgctgccagcaatggcgggggcggaattgctccttggtttcggttgatgaattggactaacattgtccttgcgatttttcaattttataatggataccgcccacatcaatatagtaaaaaatcaggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattaactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaaacctaaacgtaagcatcatcgaactcatccgcaagctaaaaggtgcttagggcctaatattgctcaacgacctcaaactgcggaccaacggtccgaaattggccattgggaactagatacagttcagggacagaaaaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttagaatagtaaaaaatcatagctctaattaaaaagcttataaaaaggcgaggctgagagaaaacttttgttttctctcagcctcaactgcttttatgaacaatagtaagataacgtggaaaataaccacaaggctcgagtctaagtacgaacgataatcagcctgtgccgtgctaatcatcgtcctagcttagccaaccgccttgtcgaggaggttattttccactcgcctttggtgttttattttacaatttcacaaaattcgattgtttcactgttaggaccttcaatgttgaagaacttaattcccttatcccagaagtcaaggtgttgaacttcatcgtcctttaggttgaaaccttcagccttagcagccttgaaagccgcgtcagcatcactagtattaagggaaatgtggttaatagcacccgtttcgtgaacggcaccgtcgccagtccagatttctaaagtgaggtgaccatattgcatgaaaacaacttcatttccttggtcatcagtatcaaattcgccaagtttcttgaaaccaagcttttcccaaaaagcaattgtttttgccatatcatcggttggaatcccaatgtgttgtacatcgtcaaagtaacctgctaaactcttgttaaatgccataataaatcactcctgtataaattttaattaccaatatcaagtgcctggtgctttaatttagggaagatatgacggtctgaccaaccagtaattgcaccttggaaggcaagggcaaataaagttcctaatccaaagttgtaaatactgccttgcatgaatgcagcgataattgccataattgttggtggaatgtatgataaccacatcgcaatcgttgcgttaccatggcaataacggaaacgaataatttggaaaaggtcatcagcggggtgtaacacgaggttgacacgctgataaattgaaatggcggttccgatgaaagcaacccctaagaagttaatgaaaacatataggataatcatcggtaaggtagtggcgtccggcataattcggttaaagatgtcagagaaccactggataaaaatagaaaatggcaacatgaaaataaaattaccaccaattcgtcgccagtcccacttatgcatcaaaattgcgttgaggatagaagttaacatccctaagaccatgaaagcccagaaaagggtcattgaattgttccctaaaacggcaatccctaggttgttttctgcggctgtccaataagcggagccaagaaattgtgggtggacgtgtgaacttgtaacaagtgttaggacgttccccattgagttaataacaattgacagtgcaaagtatgcccaactagcagttaatgaaattgttcgctcggcaacttgaccttgtactggaactttttcttgttccatttatattctcccttccaacttgaccaatcatttggtgaagttattcactttctctctacgatgaattaatttacaaccatcaaaaaatcttgtcaagcgcttcacaagttgaaatgacgggatttatcctataccaaaattattgaaacgatttactgaaagcgcaatcatcaagtgggtgtaggaaacataaatctaattagaccaattagctgaaaaagcttacaaaaaaattttgaaaggatgagatatgtgaaaataatcatttctccagcacgaacaatgcaagttgataccgactccttactttacaaagatttgccggaatttcttcagcagacaaaagacattttagggtggatgaggagcttatcttatgatgagttacacaaagtatggggaaattgcagctcgcgtttagcgatgaaaaattatcaatggctccaacaaatggatcttcaacgaaagctgacgccagcaattattgcttttactggtctgcaatatcaatatatggcgccaagtgttttctcagatgatgggttgaaatacgttcaagacaatttacggatattatcaggattttatggtattttacggccgtttgatggaataataccttaccgcttagggatgggtgacatggcgccagtgaatggatataataatctttatgacttttggggagaacaactttatcatgaactctataagaataatgatttagtaattagcttagcttcggtcgaatacgaaaaggcaattactccttatctacaaactcaagatcgatttatcaaatgtatttttggcgaagaaatagatggaaagataaaacaaaaagcaacattagctaaaatggctcgtgggaatatggtgcgatatttagcagaaaaccaaattcaaacaattgaaggcgtcaagcagttttatatcggcggttaccattttcgggaagatctgtctactgatgaaaaattagttttcgaactggtaaagtaaaagtaatcatattatttgccaatctttttgaattgtcttataaaagaattgtatacaaaactattaacagtgcactgattctattaaatttttaatgatagaagggagtcaaattatggtaggcgattctttaaataagacaggtgccaatttattaatcaaggccttgcaagagaataatattaaccggatgtatggaatagttggaatcccggtaaccgatttagcgcggctcgctgaattacgcggaatgaaatattatggttttcgccgtgaagattcagcagttaatgtcgccgcggcaactggttacttaacgtaaaaaactggcgttgcattaactgtttcagcacccggttttttgaatggattaacagctttagctcaagctactaagaattgttttccgttgattatgatttcaggttcgtctgaacgccatattattgacttatcacagggcgattatgaaggtcttgaccaatataatgcggcaaaacccttctgcaaaaaagcttatcgggttgatcgagcagaagatatgggattagctgttgcaagagcaattcggacagcagtttcaggccgccccggtggtgtttatcttgatattccagctgacacaattgttcaagaagatactgctgatcaatctaattttggggtttataagttagttgatcctgcccctaaacaggtacctaatgatgaagcaatatcacgagcggttgatttaatcaagaatgccaaaaagccctttattattttaggaaaaggagctgcctatgatcagaccgaaaaacaagtgcaacaattagtagctgaaacgaatattccatttttgccaatgtcgatggcaaaaaggttaattccagatgatagtcctcattctgctgcagcggctcgttctctttcactacgaaatgccgatgtagtaattgtaattggtgcccgtttaaactggatgctttcatatggggatgccccacaatttaacccgcatgcaaaatttgttcagctagacatcgatgccacgcagtttgatttctcacagccaattagcgtcccgctccaaggagatcttaagtcgattttaggtaaattggttccggcgctattggcaactggatatcaagcgcccgcagcatggttagagcaaattgcgcaagatactgagaaaaatgacaaaaagtttgcgcaacgaattgctaatggtaaagtagcacaaaaatttggctattatggagcgattgcgcctattgctgaatacttccaacaacacccagacacctatctagtcagtgagggggctaatacgcttgacattggacgcgatatgattggaatgcagctcccccgtcatcggctcgatacgggaacttggggcgtcatgggtgttggccttggttatgcaattgctgcggtggttgaaacaggaaaacatgttgttgcgcttgatggcgatagtgcatttggttttgatgggatggagattgaaacgatttgttgatataagttgccgattacggtcgttattatcaataatggctgaatttataacgggatcggccaagttgttcccaatcaacttgggccaactactcttgatccaactgcaaggtatgatttaatggctaaggcctttggtggcgataattattttgtaagtaattacgatgagatgaaaaatgtctttgcaagagctgttgactcggaacgcccaaatattattaatgttcaaattgcaccatcgatgggaaaagaatctggccttattgggaatctaaatccaaagcttaatttacaaccacttgaagaaaatgagaggagccatcataatgactgaacaaagtgaaaatgcaccattaaaaggaattaaaattgtggactggacacgggttcaatcggggccttcctgtacttagcttttagcatggctaggagcggaagtgattaaaattgaacggactaataccggagacccaactcgtaatgagctgcttgatattaaagattcatggagcctttattatttacaacgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgttgtgccgaaaccgtttatcgcgtttatcgttacctggaaaccggtgcctcaattgctgattatcaagatcactatatgcgcaataagcaacgttgtggccgaaaacgtactcagttgtcactggctgaactcacttatatcaacgacaaaattacccaggggtggacgcctgataccattattgggcgcgctgagcgcccaattagttgtaaccagcgaactctttaccggatgtttgaacgtggccagttcggcttcgatgtccgttccttgccgatgcgaggtaagcggcacccgaatggctatgtcgagcgccgcgggaaggctggccaattggggagaagtattcacgagcgtgccaaggactttccgcactatgccacttaatttgggcaccttgaagctgataccgtccaaggcaaaaagcagcaaggggcggtaatgaccctgaccgaacgccaatcgaaggtcgaaattgtactcaatgtgcacgaaaagacggctgatgcgattaacaaacacttaagtcagtggtttcggaaattcccgcggcacttctttaaatcgattacctttgacaacggaaaagaattcgccggctggcgcgagattgccaatcaatttgaccttcacacttactttgtcgaggttggtgctcccaatcaacgagggctaaacgaaaacaacaacggtcttttatgccgggatggcttaacgaaacagctagatttccgcaatcttcctgatgaattggtaacccaactgatgagtaagcgaaataacctgccccgcaaatcactaggctatcgaactccatatgaagtattcatgtcttacatcactgatgagcaactattttctttctaacttaaattgacatttcgggtaaataaaaaggcattcccaaagaaattgggaatgcctttttgggttgaatcaaacaagtgatagctattgattacttgttgtagaattcaacgataagagcttcatcaatatcagcgttcatatcttcacgtgctggaatgcggttaagcttaccttcaagcttgtcggcatcaaagtcaacgtatgaaggacgagaaacaacagcttccacagcgttcttgatgatgtctaagttcttagacttgtcacgaacggcgatgatttgaccaaccttaacttcgtatgatggaatatcaacacgcttaccatcaacagtgatgtgaccgtggttaactaattgacgagcttgacgacgagtagtggctaaaccaagacggtaaaccatgttatcaagacgacgttcaagcaatgccataaagttggcaccgtgagtaccttccttaatcttaccggcacgaacgaaaaggtttgagaattgacgttcagtcataccgtacataaaacgtagcttttgcttttcacgtaattgtgtaccatattctgaaagcttaccgcgacgatcacgaccgtggtcaccaggagcgtaagcccgacgtgctaattctttaccagtacctgaaagtgaaacgccaagacgacgtgaaacacgccaacttggaccagtgtaacgagacataaataaattcctccaataattttagttggagtaaaataatccgattgtgagcttggcattcgtgcaggctgatttgaatctttcaccctagcagccgggttactaaaaacaccgttaggcaccagtctgttgacgagcttgcccctcactgctgcattattttacacaaagtctagtatacaacggttcgtaataataagtcaatcttttctttagaaacctcgtaacttttttagcagaatgatgaacaatataaaagtttattaaacgaagatgttttttcatatcttttaaagcacgttcattgtggtatgctataattttgaataggattatacggataattattgtgcaagagcaataaacaataaaaagtagtaggtggaaaaagtggtttttcaagtattgattggtattttaattattgttgtagcaatattagcttgcgtatatttttatcaacgacgagctgttaaacagatcaacgacttaatggaaagcgagaaaaagctagcagatcaaaaagttgaccagcagatcaaaaatgttgaagaattgcaactaatcggggatgctaaaaagcaatttgaaacaattaaaaacaagtatgaaaaacaagtgcgaccagcgatcacagcctttaataaacgagctccccaattattagcagattcacggacgagcaagttgctgacaattaacactcagattcgagacctgcaagcagatttggcaaagttaacaacaactctccaacagatccaaaaagacttacaacatcttcgtcaacaacaacatacccataagcaagcggtcgagcagattaaaaataaatatcgtcaattccaccggcaactaaatgagaagagcttcgaatatggagacagtgaaaagcagttaaatagcagattaaacgaattagaggatcaattcgctcaatttactgatttaactaataagggcgatattgaagcggctcaagagattttaaccaatttgcaatctgaaaacgataaatttgaacaagaccttaagaagattcctcagctctataagccaattgcaaccgagtttccagaacaattatccgagctaaaaagtggttataagacacttgtaaaacaaaatttccactttacggagaaaaatattgataagcaaattgaacagctccaatccaaactggatcagacgattgaccaacttaacaatttacaattagatgttgtggaacaatctaataaagatcttagtgaccagattgattacttatacggggtaatgcaaaaggaaattgatgctaagaatgaagctgttcatttgattgaagtgatgaaaggctttacaaaacacgctcaacggcaaaatgacgaacttggtgtagaattagaccggttaagtttgaattacacacttactaatcatgaacaagaaaccgtacgtgaacttggtgaacaaattaaagcaattattaagcagtaccgtgatgacgcagaagcaattgctaacaaaacagctgtttatagtcaggttcttgatcggcaaaaatctaatcaaaagaacttaactgaaattgaaaaaagtcaagaaaagcttaacgatgaagttgctaaattgcaaactgatgaacaacgtgcccgtcaaatgctgcaaaaatattccacccagattcgtacaattcatcggcaagtagaacagttgaaccttcctggcttaccaaaagattacttagattacttctttggtgtcagcgatgagattaaaaagttagctgatgaattgaatgagtataagatcaatatggatgaaattacgaagcaactaattatcgttgagtcagacctagacacattaaatgacaagactgatattcttcgtgatagtgcggaattaacagaacgattccaacaatatgcaaatcggtttagtgataacgaaaagattgcagcagcagctaaaaaatcccaagaactttttaagcagtttaactacacggcaagcttagaagcaattgcgaccgttttagaagaaatagaacctggtagctacaaacgaattgaagatacctattatcgtgaaattggtaaaaattaaaaatcaaggtgagtgggaattagcctaccgccttgtggttacgacgcgaagctagttccacgatatcttaaacaatgttcctataaataaagaggctgttgaaaaaatgaagttttttccagcttcctttttttcttattaaatgatagtgataattaatgcctaatagctaattttctgttataatataaaaccgttttaagaagagtcgaaatcttcagcagtagcctatcctatactgttgaaatcataatcagagtaggttacccatttgtaacaaccctgtgtattatttttaggaaggaaattagtatgatctattttgataatagtgcgacgacaaagatactaccggatgttttgtcgacatacgaaaccgtgagccaaaagatttgggggaatccaagcagcttacataattttggtgaaaatgcttggaaccttcaagaacaggcacgccagcagatcgcaaagttattcggggttaagcctagtgagattatttttactagtggtggttctgaaggagataactgggtaatcaaaggaactgcaatggctaagcaccgttttggcaaacacattattacgactagtgttgaacatgcagcggtaaaaaatgcattggagcaactaaaagacttcggatttgaggttacctatctcccggttgataaagagggacggatcaatcccgctgatgttaaagccgctattcgtccagatactattttagtgtctatcatggcagttaataatgaaattggaacgattcagccaattaaagaagtgggagaaatccttaaagattatccaaacattcactttatggtggatgctgttcaggcaattggtaaaggattagatgaccaagtatttagtgatcgtgttgattttgccactttttctggtcataaatttcatgctccacgaggaaccggttttgtttacgtcaagagtgggcgcaagttagagcctttgattgctggtggtggtcaagagcggacactacgaaatggaacagaaaatacacctggtaatgttgcaatggcaaaagcaattcggttagtaaaggaaaatgaagcggaatcagtaaaacgtgaacaagcaattaaagaacggatttacgaccatttaagtaaatttgatcatgtaaaattgatttctggccgcgatcaaggtttcgcttcccatgtactgtgctttgcaattgtaggagttcggggtgaaacgattgttcatgcctttgaagacaaggatatctatatctcaactactagtgcttgctcgtctaagaagcattccgaagccggaacattagctgccatgaaggttccagaagatattgcaacaagtgcagttcggattagccttggggatcaaaatacccttgaagaagctgatcagtttaataaaacatttgatgaattatacgctggctttaagaaaattattgaataaaatctgaaaggaggacataacgtgcaatatacagaaattatggttcgttatggtgagctttcgacaaagggacataataaaaagtcctttattgatcgtttaggggtaaacgtacgaaaggcccttcatagctttgaccaggtaaaggtgcatgcacaacgtgatcggttgcatgttgaattaaatggagttgactatgatcaagtgatgaatcgcttgaagttagtgtttgggattcaaaacttctcgccatcaattaaagttgataagacttttgaagcgactgcagaggcagcagcgcagatgatcgctgaacaagttgacaagccaattacctttaaagtggaaactcgtcgatcagatcaccaatttgcaattgatacctttgaaatgaacaacaagctaggaggatacctcttagataagtttcctgataaattaaaagttgatgttcaccatccagacctaactttacgggttgagatccgtcttaatgggattttcctttcaagtgaaacgattaagggtgctggtggtttgccagttggtactgctggtaaaggaatgatgatgatgtctggtggaattgattcaccagtagctgcttaccttgggatgaagcgtggcgtttcaatggaaatggttcacttctttagtccgccatatactagtccccaagctttagcaaaggccaagcaattaactgaacgtcttgcaaaatatagtggaagtattaagtttattcaggtgccatttgccgaaattcaagaaacagtaaaggaaaaagttcctgaaggttacttaatgacaattcaacggcgaatgatgcttcggttggcagctgccttaatgattaagcgtcatggtctggctatttttaatggtgaatcattagggcaagttgcttctcagacaatggaaagtatgctggcgattaatgatgtaacttcttatccggtattgcgaccagtattgtcatttgataagaccgaaattattaaaattgcccaagatattgatacctatgatctttcaattcttccatatgaggactgttgtactgtctttacaccgccatcgccaaaaacccggccaaacgttgagcgagctcgtgaatacgaaaaacgacttgatattgaagggttaatgcaacgagctcttgatgggattgaaattacggaaattcatcctggtgaagattatttaaaccaaaatgaagatgtttttgctgaattactttaattaggccttgacgaggtttgataatttagctatgatacattttaataagcattgaccgaaagagtagtaaagcggcacctaaaaagcgagatcctgagagtgagagaggattagttaaactttatgaaggtagttcgggagctgatatactgaaattaatagtaggtatgtccggttcatttaccgttatgaaatgataaagtggagtattttatactcaaattaggtggtaccgcgatgattcgtcctatcgattgtgatagggcgttttttagttaatgcacaaaataaaaatgaagattgcgttctgaaaggagtttctgccatgacagaaaaagatatgtcaaccaagtacgatccagcggcggttgaagaaggccgttatcaatggtggattgatcaaggattctttaaaccaagtggtgacaaaaaagctcacccatattcaattgttattccaccaccgaatgttactggtaagttgcacttaggtcacgcttgggatacaactttacaagatatgatcattcgacaaaagcggatgcaaggctatgatgtattatgggttcctggaatggaccatgctggtattgctacccaagcgaaagttgaagcccggcttcgtaaacaaggaatttctcgttatgaccttggtcgtgacaagtttgttcaacaagtttgggactggaaagatgaatatgctgatattattcaccagcagtgggctaagatgggtatttctgtggattatgaccacgaacgttttacccttgatgaaggattaaataaggctgttcgaaaagtctttgttgatctctacaataagggcttaatttatcgtggaacttacatcatcaactgggacccacaagcacggacggccttatcagatattgaagttattcataaggatgataagggtgcattctaccacgttaagtatccatttactgatggaactacttttaacggtaaggattacatcgaaatagccactactcgtccagaaacaatgttcggggatgaagcggttgccgttaaccctaatgatgaacggtacaaggacttagttggtaagaaggtcatggtaccacttgtcaaccgagaaattgagattattgctgacgactacgtaacacctgaatttggtactgggatggttaagattaccccagctcatgatccaaacgactttaaggtaggtaagcgtcacaatcttcctgaactgaatacaatgaatgaagatgcctccatgaacgaaaatgctggtaaatacgaaggcatggaccgttttgaagctcgtgaagcaatcgttaaggaccttcaagatcaaggttatatgttaaaagttgacccaattgttcactctgttggtcactcagaacgaacaggggtacaagttgaagcccgtctttccacacaatggtttgttaagatgaagccattagccgaagcagctcttaagaaccaagatactgatgaccgagttaatttcgttccagaacgattcgaacacacctttacgcaatggatggaaaatattcatgattgggttatttctcgtcaattatggtggggtcaccggattccagcttggtataacaaacagactggcgaagtttatgttggtatggaagctcctaaagatgccgaaaattgggaacaagataaggatgtccttgatacatggttctctagtgcgctttggccattctcgacgatgggctggcctaatactgattcagcagacttcaagcgctacttcccaaccaatactttagttactggttatgacatcatcttcttctgggtttcccggatgattttccaatcgcttgaatttacgggtcaggcaccatttaagaatgttcttctccatggtttgattcgtgacgaacaagggcgaaagatgagtaaatccttaggaaatggtattgatccaatggatgttatcaagaagtacggggtagatgccttacggtggttcttaattactggttcaactcctggtcaagatattcgttttagctacactaagatggatgcagcttggaactttattaataagatttggaacgctagtcgttacgttatcatgaaccttggtgagatgcctgctcctgtccttcctgataagagtaagtgggatttagctgatcggtggattttgagtcggttaaatgcaactgtaaagcaggttaacgaacagtttgacaagtttgaatttggtgaagctgggcgggcactttacaacttcatctggaatgatttctgtgactggtatatcgaaatgaccaaggagaaactcaataatgggactgacgaagaaaagaatgatactaagaatattcttggttacgttcttgatcagaccttgaagatgttacatccaatcatgccattcgttaccgaaaaattatggcaatcaatgccgcatgatggtgaatcaattatggttgcagattacccagttgctaatgccgaacttgatgatccagccgcaactgaacaaatgaatagtttgattgaattgattaaggctgttcgtaacattcgaaatgaagctaatgcgccaatgtctaaaccagttgacattttggtaaaagttgatagtgatcacttggcacagatgttgaatgataaccgggattacattgaacgcttctgtcatccagagaacttaactattggtaaggatgttgaagctcctaagcttgcgatgagcggtattttgactggagcagaagtttacatcccaatggctgaattagttgaccttgatgaagaacgagatcggatggaaaaagagattgctaaacttgaaaaagaagtagaacgttcacaaaagaagcttggcaatgaaaagtttgttaataatgcgccggaaaaagttgttgaagctgaacgacaaaaggcaacggaatggcaacaaaaattagcagctgctaaagaacgccttcaatcacttcaacaagcttagcgtcaatttatagtaggataattaacatttttaataataaatgaaaattatatcattttattaaataggttagactactgtgagaatgctattagctttaatatttataaatatagtttaaaattagattaaaaaggaattggcaattgctgattccttttttgattaatatgaaaaaataatcatgcatcgttcgaaaatgtttatctactgataaggattaaataattgataattaagcggtttatttagagattatttcacatatttaccatttatttattgtaattatttatcacaagtattatgattgattgtggagaaacaggaaacggtttcaactattctttttatcgatatacttcggagggaggtatttataatgactattcttagtctggcacgtttccaatttgccatgacgacggtttaccacttcttctttgttccgttttcgattggaacagcttttatcgtcgccattatggaaagtatgtacgtctcaactaaagacgaaacatacaaaaaaatggcaaaattttggggaaatattttcttacttagttttgcggtcggtgttgttacaggtttgattcaggaattccaatttgggatgaactggtcggattactcacggtttatgggtgatatctttggtgctccattagccctcgaagctttgctatcattctttattgaatcaacatttattggcttatgggtatttacctggaaaaaggttaagccagggttgcaccttttcttcatttggatgacaagttttggctctttaacatctgctttatggattttaactgccaactcattcatgcaacacccagttggttatgaaatcaagggtggccgtgcagtaatggttaattttggtgcattgcttaaaaacccccaattatggtatgaatttggacatgttatccttaacgccatcatgatgggtggtattattattgctggtttaacagcattccaacttctcaagaaccaaaaactttctgaagctaataagaagttttacaagaagtcaatgcgtttaggacttttagtatcattgattttctctattggtggaattgcgttaggggatgcccagatgcaatacttaatcaaagaacaaccaatgaagtttgcagctactgaagacgtattcacgactactggtaagcatgcaccgtggacaattgttggtattgctgatatgaaagaccatgaagtaaaaggcaatatcgatattccctatgccctaagtattttgtcataccacaaaactactggtgcggttaccgggatgaatgagctcaatgcccaatataagaaaaagtacggcaagaatcttgattactacccaccagtaaatacgctgttctatagtttccggattatgtgtgcagtcggtgcttggattttcttagtttcattagttggattaattatgacaagagaaaagagcaagaaaccacttgcacaacgccgctgggcactttggtgtattgcaattaccactttcttaccatttatcggtaatactgctggttggtttgtaacggaatttggtcgtattccatggacggtttatggcttgtttacaattgctgaaagtgtatcaccaaatgtttcagttggatcattgttaacatcaaatattgtttacttcgtattatttacaactcttgcaattacattaatttggttaattgttcttgagttacgtaaagatccatcggaagcaattgaacctaaattcaagaaggttcttgacccatttgacaaggaggcgttctagatgagttttcttcaattattatggtttgtattgattggagtgctttttgctggcttcttcttcctagatggatttgattatggggtaggaatggcggtcgaaacacttgctcataacgaatcagagcgtgatcaacttgtgcggacaattggaccagtttgggatgcaaatgaagtatggttaatcacggctggtggtgcaatgtttgcatcttttccatattggtatgctagtcttttcagtgggtattacttaatcttaatgattatcctagctggtttaattatccgtggtgtttcttttgaattccgtaaaaatagtccaatgtcacaaaagcggatctgggattgggcattagcaattggtagtgcaatcgttccatttttccttggtattatgtttgttagcatgattcatggaatgccaattgatgctaacggcaattttcacgcaggattctttgactatttcaactggctttcagttgttggtgggattgccttattgcttttaacctacttacatggaattaattatattgccttaaagacgactggtccggttcaggaacgcgcccggaactacgctgaatttttgtactggattctttatgctggcgaagttgtctttgcactattattaatctttatgaccgactttatggctgttcacccagttggcacaatcattatgcttatattgattgttggtttctcagttttagcccaagtagaaacctttgctggtcatgaactaattgcctttatttcaagtgggttaaccttagtatctttagttgtattgatttttatcggtctcttcccacgggtactaattagtagcattagtccgaagtacagcattcttattcaaaatgcttcctcaacagaatatacgttgacagtgatgacgattgctacttgctgtcttttaccatttgttttggcatatacaatctgggcttactggattttccgtaaacggattgcaatgccagctattccggaggttaaataaaaagttatgattgatcgactactcttcaaaatcgaggggagcagacatatcatgattaagcttgtggggctttatgtcctgcaagcttttcttatccttggtcagggattaagtttggctgctttactaacaggcttatggcagggacattctcttttaagtcaaatatatggcttaggtggatttattgtttgctaccttttgcgtcatgggctaaccgaaattgggaatgattggcttgataagtattcggctaatgctgcccaaaactttcgtcagcaattattaaaaaaagtctttgcgcttggaccggtaattgttcagcgggagggaaccggtaatatggttactctcgctcttgatggcattaaagaagttgaaaattatattcgactcatctatagcaaggtgatcagcatgatgattattccagtcattattttggttgtctgtttttggctcgattggatttctggcattgttatgttgttagtttatcctttgattgttttattcatgattattttaggctatgcagcgaaggctaaggcagatcgacagtttgcagcttttcaaatattgtctaatcactttattgattctttgcgggggattgacacattgaagtactttggccttagtaagaagtattcgcaaagtatttatcggtcaagtgagcgttttcgcaagtcaacaatgagtgtgattaaagtagcgatgttatcaacgtttgctcttgatttcttcactacattagctattgcaatcttagcagtctttcttggcttacggttaattaacggtcacttattgctattcccgacactagcaatcttgattttggcaccggagtattttttgccgattaggaactttgcaagtgattaccatgcgacgttgaatggtaaaaattcatttcatgcggttcggcgaattcttgagatgccattaccaaagaagccgactgttgaattacaccagtggacaggagtcgatgggttaagttttgagaatgttgagtttatgtatcctcaaaatggcagtgaattaacaaaccttgatttaactgttaaggggaatcaaaaaattggcattattgggatgagtggggccggaaagacaactttaattaatcttttaagtggctttttagcgccgacaagtggccaaattaccattcaaggaaaaaaagtaacgactttggatattcatgactggcaaaaacagattctctacattccacagactccctatatttttgcagatacgttaaaaaataatattgccttttatactccaaatgtcagtgaagacaaaataaaagaagcgattcatgttgtcggcttagatgatcttgttgctgaattacctcaaggattagggacgatgattggcagcggccaccgagcattaagcggtggacaggcacagcgaattgccttagcacgagcatttcttgatccagaacgtcgggtaatgatttttgatgagccgaccgcccaccttgatattgagactgaactagagttgaaaaaaagaatgcttccgttgatggaaaataggttagtcttttttgctacccaccgtttgcattggatgaagcagatggactacattttagtgttgaagaatggcaagttaattgaacaaggaacgtatcagcagttgcttgatgaacatggttactttacagaactgatggaccaaacacgcggaaaggagataacccatgaataagattcctttacttaaagcaatgaaacatgatcggtgggtgaaacccttcctaaagcgttacaagtggaccttggtattagcaattaccctggggattgttacctttatttgtgctagtggattgatgttcaccgcgggctatttaatcagtaagtccgcaacgatgccttttaatattttgttagtatatgttcccatcgttcttactcgtgcctttgggatttttagaccggtgactaattattttgaacgattggttagtcataattgggtttttaaaatgacttctgcatttcgtaaaaagctttatgattcgttagagcaggatgccgttttctttaatagtaagtatcgaattggagatattcttgggttactttcagaagatgttgcccacattcaaaatttatatttacgaacgatttttccaatgttggttgcatttgggctttatgccattatcgttattggaatggggataatttctccactaatgggtcttttaatgttaattctatttgggttaatcatcattgctgttcccgtgtggtcagtgcttgttaatggtgcacgccagcaactagaaaagcaatataccaataccttgtatgctgatcttactgataatatcatggggattacagactgggtatttgcggggcgcagtgcggattacctgcagcactataataaaagtgagaaaaacgtactagcatctcaaaaagcgatgaaacgttttgagcattggcgtgattttattcttcaggtaatgattttattggtggttgttagccttattgtatggggagcagcacatttcggcggtcattggggaggcagtgcaaattggattgcggcctttgttctttgtgtctttccccttgatgaagtattgtctagcttgccagcagctgctcaagaaactaatgtatatacggattcattaaagcgattgaatgaattaccacaaccgcctgctccttctaaggttaatattgagattgccgctccttatcatcttaaaattacagatgtttattatcgctatcctaaaacagagaagatgatcttgcgggggattaatcttgatgttaatccaggtgaaaaacttgccattcttggtcgcagtggggctggaaagagtacgttagctagtttaattcgtggagaccggaagcctacttcgggcactgttactcttaataatgtgccaacgggtgaatttggtgatgagatttcgaattatattgggatcgttcaccaatcgccatatttgtttcataccacaatcttaaataatattcgtttgggaaatgaagatgcgacagaggatcaagtatgggatgttcttgaacgtgttgggttggccgctatgattagacgactgccaaaaggacttcatacgatggttgatgaggcagggttacggttttctggcggagagcgtcaccggttgtctcttgcccggattttactcaaggatgcgcccattatccttttagatgaaccaactgtaggtttagatccggtaacagaagaaaaggtaattgagacttttatggagcagctacaaggaaaaactttgatttggattactcaccatttacaaggcatagaaatgatggatcaagttgtttttatcgaggatggtaaaatttcaatgcaaggcagcccggcagaattacaaaaaacaaatgaacattaccgggcgttaaaaatggcagatgagggtatctagctagtttaggaatgttataataaagtaggactattaatgaagggatgaatagtaatgaaagaagttgttgtacttggagctggttacgctggcttaaagacggtcgtattattacaaaaaaagctaaaaaataatgttcatattacactagttgatcgtaataattatcattatgaagctactgatttacacgaagctgctgcgggaacgcaaagtgcttcaaggatcacttatccaattagtgatgttattaatccacaaattactacctttatccaagatgaagttgtaaagatcgatcctgataaaaagacagttaaacttgctggtcatgaagagctactgcactatgattattgtgtattaggactcggctttgtttcagaaacctttggaatccctggtgctgaagaaaatgcattaccgatgactaatgttaaagaagctttagcaatttatgaccatatcattgccaaaatgaaagattatcgtaccactcacaatcctgatgatcttcaaattgttatttgtggtggtggatttactggaattgaattagcaggggcgcttgttgacgctcgagcaagttatgccaaaatcgctggagtttcaccagatgaaattaaaattacgctgattgaagcttcaacaagattacttccaatgtttagtgaaaaacttgccgaatatggggtaaaccttgttaagagccttaacgtgcaattgcttgatggttcacgaattagcaagattgaacctgggaaggtcatctacaagcatggagatgatgatgaagagtcccttaatgctggtataattatctggacaactggagtaagtggtaatccattgatggaagaatgtggctttgatgctaagcgtggccgggtaatcgttactgaccacttaacagatcctaagcacgatgatatttacatcattggggatgttgctgccgtaatgccaccggatggtaaacgcccatacccaactactgcacaaatcgctctagcaatggctgattacacggctgaagacattgttagccgtattaagactggcaagcatgaagctaagccatttacttacaagtccttaggaacagttgcttccgttggtaatacgcgggcatttggtgaagcaatgggtcatgaattacgtggatatcctgcttcagcaatgaagaaaattattgctgaccgttccttgttagaaacaggtggtttgaaagagctatttgctaaaggacgctttgacttatatcactagaaaatgaatgaggctgagaaaaaacttttgttttttcaacagcctcgtttttatgcttatatgctaaaaaggtatggttataataaataaagggtgaaataaatgattaaaacttatgatgaagcattatcttttattcatggacgaacacaattcaagaaaattccaacactcacacggatgaaacgattcttggcagaattagggaacccacaagaaggacttaaatacattcacgttacaggaactaatggtaagggatcaaccgttgcaatgatgcggtctgctttactggaaagtggccttactgttggaagttttacatcaccttttattacacgatttaatgaacgaattgagtataatggaatcccaattagtgatgatgatcttttaagattagttcaaaaaattgcccctgttgtcaaaaaacttgatgatacattagaaacaggcggtccaactgaatttgaaattgatacagcattaatgttttgctacatggctgaaaagaagcccgatgttatattgcttgaagtggggattggggggctatacgattctactaatgtaattacgccagttgttagcgtgatcacgacagttggctgggatcatatgaagtatttaggtgatactttagctaagattgcggctcaaaaagcaggaataatcaaaaaaggtgtcccagttgttttaggtgctctcccaacagaagcgcgcgaaactattctcgcagatgcaaaggagaaaaaatccccggtttttgaattaggaaaagactttactgttcacaaacttaatggtcatcagttccacgcaaaaattcggtatcaaggaaaaaatctgaaaaaaatagaaataattcttgggttgccaggcgactatcagatagaaaatgcagcagttgctttgatggctcttgagctttttatggagaagcgtgggctggcaattgatcgtcgtgctttgatagcgggattagaaaatgctgcttggccggggcgattagaagaaataaatactactcctctggtcttactagatggcgctcataatcttcctggtgtccaggccctggttcatactattaagaatgattttgccgatcgggaagtttacctcttggtagcgattttggctgataagcaatatgaattaatgcttggggaattagcaagcttggggaatattcacttaactgttactcactttgctggccccggtccaaaaagaccaagtgcagacttagcaaaagcagttgctgatattccaactaaatatcccatccagattattaacgactggcgattaggaatcgggcaggtggcaagtcaaatgagtgcggacgatgtaatgattattactggttctctttattttgtttcagatgttcgtagattctttttaaattaaaagtgtaaaagcacaaattttccgtatttaaatatatagagtgtaaaaaggagaattatttatttatggaaaatgaagtgattaacgaatatacaaaattagtctggacggctattcctgataaaccgggaacaaagaagcaggaattatgtcaacgtttcttacgtaagtgtcctactcccctagcaattaaacggctttcacgtattgaaaaaaatgagataaatgaatgggcgccagaaatgcttaacttttttgctgctattgaattagggaagatagtaactaaaagtcatgaagaaattattggccatgcttattcgagtatcgaattaggacgcaagatggttgaccattttcaaagtgaagagcaagaaagtgtttgtattgcctgtacagatatccataatgagataattgattggaaaattttgtttgtaggcggcggatgcgaatgtattctttatcctgataagatttttcaatatgcgctccggtgttcagctcaaggaattattatgatccacaatcatccgacgggagacattcatccttctaagcaagatgaatcttttactcgccgcttagaacgaggatgtgagattattggacttcatttagttgactttatgattgttggtcgtgatacataccatagttggcgtgaagctagtctcgttaatgagcttaaaaagtaaagaaacttttaatttattataataattacgctttctttgttcttattaatgtatattaatgttcgtatgtaccgagtggctatggtataatatgcacgatattaatttgattttaagacgaagggaagaagcagattgctaggaattggaacaaaaaatcttggcattgaccttggaactgctaatacaattgtctaccttgaaggtaagggtattgtattaagagaaccatcagttgttgctcgtaattctaagactaacgaagtaatcgctgttggcagtgatgcccgtgatatgatcggacggacgccagaaagcattgtggctatccgaccaatgaaagacggtgttattgctgattacgacacaacggttgcaatgatgaagtattacattgataaagcactaggaaataatggtaagccatatgttatggtatgtgttcctagtgggatcacggaagttgaaaagcgggcagtgattgatgctactcgagttgcaggtgctcgtgatgcttatgttattgaagaaccatttgcagcagccattggagctggattaccggttatggatccaaccggtagtatggttgttgatattggtggcggtactactgatgttgctaccatttcattaggtggtattgtctcaagccggtccattcgaatggcaggagataagatgaatgatgcaattgttcaatatgttcgtcaacatatgaatttattaattggtgaacgaacagctgaaaagcttaagtgggatattgggtctgcatctgttgaagctgctgaagaaatgggaacaacacaagttcgcggtcgtgatcttgtaactggattgccaaagacaatgcaagtatctgcgaaggatgtttcaacggccctccaagatgttgttgatagtattattacggcaattaaaggaacacttgaagaaacttccccagaaattgctgctgatgttattgatcacgggattgtattaactggtgggggcgcattattaaagcatttaccagatgttattgcagatgcaaccaaagtaccagtatttattgctaatgatccccttgactgtgttgctattggtaccggcgagtcattaaagagtattgatgtaatgaagaaaaagtaaaatgattctctgacagtgacgttagcgatgaatcatcattagtactaactaatgattaacggggctgagtgccaagcagaattgtttggcaggccccgtcttaattaccttgtgtatgcattggagggtcataatgcagaaatttttttccaatcgccgattagttattgctgtgataattctagttgtctgttttggactaatggcaggttctgtttctttacggaatagacgaaatacaccaccgattatccaacaatttggaaatgatattgttggctttgttgatagtgcagttgctctccctgtaaattgggcacagacaagtataagttcaataaatgggttgatgaatacttattctgaaaaccgtgaacttaaacagcaagtaactgaattagcacaaactaaagtccgtgatcagaccttagctcatgaaaataaacaattaaaacaacagttaaaacttaataattcaatgaccgactataatacagttacagcggctgtgttaatgcgcacaccatcttcatggcaacgacaactcgtaattaataaaggtcaatctagtggtattaagaagaatatgcccgttatgagtggtagtgggttaattggtcggattacagaagtaaataaaactaatagtaaagttgaattattgagtgatactagtgaatcatcaaaccgttttgcaattacccttaatggtcaaaatgggaaggtgattaacgggattatcaccggatataatgcaagaaataacgagcttgaaatgggacaagtaacttctaaagctaaaataaaaaagggtacccgagtagtaaccagtggaatgggtggtgtgacacccaagggactttacgttggtcgcgtgtcgcatgtcggtaaagatgattatggcctcgcccagaaaatctatattactccagcaacggactttaatgatattaatattgttacagttgctgaagcggcttcgcaggagtgataaattatgtatcgtttatcacgcttaaaatatatattcccaattggcttatttgtatgtctgtttttggacggagccttaagccatgtgtgggcaccattatttttcagttatccctattcaatggtgagtgaacttgtcttactatggttagtcttatcgtacttctttcaagatgatattgagattccattaattccatttgcaattgctgctggtgcagtttacgatttatacttttcgggaattttaggattgtatattttcttgtatccattagtagtcgaaataactaaaattttatctcgttattttagttcatcatttctttcgatgattatgattttctttgttgatattgtcatttttgagacgtttaattattgggcatattatttagtgaatattactaatgttggttttggcgactatcttatttatacgcttgctccaacgttagcattgaatttaatttattttgttgtcctcttctggccaattcgcgcaatatatcgctgggcattagacgatgatcaaatttaaaattagtgcttgacacaatagatattccagtataggatatttacaacatcataaatgacagtgaacagactagtagagctttaagcattgcaaagagagtccttaatgatgggaagggatcgatgctttggcttgaatcacatctgtgagttggccttctgaaagccatagtaggaagacccggggaagcccgttacagcgcggagtttattttaatgaactcactaaggctattattcgtgagaaaatagcaagatgaggtggaaccgcggaaacgccctcgtagccattttaggctcgagggtgttttttgtttcattaaaatagacttattaaggcaaatattgtgaaatgtttgtaaatatgaggtggaaccacgatgtactcgtcctctaggaggtatctcctagaggatttttcttttcctgttatttctattagtcaagaatttaaggaggcaatagtaaatgtcaatgcaatatataagtgaaattctaccttcattattccaaggggctgctcttacattacagattttcttctggacattagttggatcgctgccattaggaattttggttagcttaggacttacttctaaaattaagcctttgaagtgggtgttagaaatttatgtttggttaatgcggggaacgcctttgctacttcaactaatctttgtattctatgggttaccaattattggcattgtttttgaacgttacgatgccgccctagttgcttttattttgaactatgcagcttattttgctgaaattttccgtggtggtttccaatctgttgatcaaggtcagtttgaagcagctcgtgttttacgcctaagctactggcaaacccttcgtaaaattatcattcctcaggtaataaaaattgttattccatcaattggaaatgaagttattaacttagtaaaagattcatcgttagtttacgtaattggtcttggtgatttacttcgagcaggaaacgttgcaacttcacgggatgtcacacttgttccattgatgttagtcggattaatctatttgatccttgtaggaatttgtacattaattctacggcaagttgaaaaatgttatgcatacttcaagtaaaggagggaatctaaatgttagaagttcgagatttaaaaaagagttttggtgatcggcaaattttagatggggttaatttaacagttaaagatggtgagattctttgtattgttggtccatcaggtgctgggaaaacgaccttacttcgttgtattactggactggaaactcccgatagtggtgagtttttcattaacggtcgtcgctttgatcctcagggaacagatgcagctgaccgagtaatcggtgtggtttttcaagactttaagcttttcccaaatctttcggtaatggaaaatatcacgttagcgccgatgatggtattgaaaaaggataaacaagaagcaattgctgaagcgcaaaaactgcttgaagaattagggcttaataccaaaggaaaattgtacccctaccaactttcgggtggacaaaagcaacgggttgccattgctcgtgcattagcaatgaagcctaaaattttgtgctatgatgaaccaacatcagcgcttgatccaaacctccgaaaagatgtggctaatattattttgggattaaagaaggacggaatgactcaattaattgttactcacgatttagaatttgcggaagatattgctgatgatattttacgagtacaaccacttgatcaacgtcagaataaatagtgaaaggagatatactgatgaaaaaagcgaaagcaatttggttacttattttgttagtagtacctgttctccttcttagtggctgtgaaagtgtaacaaagcgtgctgatacgcaagatacatggaaccggattgagcgccgaaaaagagtaattgtcggccttgatgacagttttgttccaatggattttcgccaaaagaatggcaagctggttggttatgacgttgatcttgcccgggctgtttttaagcagtatggaataaaagttgattttcagccaattgattggtcaatgaaagagactgagttaaaaaatggtacgattgacttgttatggaatgggtattctgttaatcctagccgtgccaaaaaagttgcctttagtcgttactatttagagaatcggcagatattagtaactaaaaagaagagtaacattaaaaatctgaacgggatgacgggcaaaacactcggggtgcagaatggttcaacgggagtaaccgttttggatgagaagccaaagttattaaaggataaaataaagcaccatacaccagtactttatgatacatttcctaatgcatttattgatttaaatgcaaatcgaattcaaggaattttaatggacgaggtttatgctaattactatattaagcaccaaccaaatagtaattcgtatcgcacttatattagcaaagagctgccaatggaacattttgcagtgggaatgcgaaaaggtgacaagaccttaaagaagaaaattaatcaaggcttaggtaatttgcagaaaaatggtgaattacggaagcttaatgaaaaatggttcggtcaagataataactacttgggaccggataacactaaataaaaagagcagggacttaggaaatagtctctgccctttattgtttcctacaaacaaattaataaaaatatgatgaatttacgtaatcggtttgtaatttagtcatatttaacgtatcattattcagtatgataattcgaatgtaactaggttgcagctagtggaacccctcttgctgcattttatattgaagggagaaagagaacgtggattttaatcttgctcgtggcgtggacttgcacattatacccacaaaacaatttaagatgaatcacgtcttaatagattttgcgactccgcaaacaccgacgaatgctactgcacgaaatttattggcaaacctattagagaccagcacgcatcgctatccaacacagacggctttggctcgtcaactggcatctttatatggtgcttatgttaatttatatgttaaccggctggggacattgcatactgttcgattgcgagcaagttttgttaatgatcgctttgttgatgaagatttatttgaaaagattagtagcttaataaatgagatcattttctatcccctaatcgatgacggggaatttgatggtcctacttttaggattcaatctaataatttaaaaagtgcgataaagtcgctttatgacgataaacaatttttggctaatcaacgtcttatggacttgtactaccaaaatgattctgtaatgaaggttcctagtttcggtcaaattgctgatcttgagaacttaaatgctaaaagtttagtgtcaacgtatcattcaatgattaatgaagataaaattgatattttcgtgttaggtgacattgatccgatgcgtgctcagcaagttattgctaagttgccttttaaagatcgcgatattgctaataattcacctttatatcatcaagcattgtatgatcaagttcaaagaaaaacagaataccaacaagtaaatcaggcaaagttaaatttggcatattctttacctgtctattatcatgatgctgattactatgctggtttggttttcaatgggctttttggtggcacgccatattcaaaactttttacgaatgtccgtgaaaaagctagtttagcttattatgcctctagccggctccttccatttaatgggattataagtgttcaaacgggaattcaagcgagtgatcaagaaaaagttcaaaatatgattcaggaacaattgactgccttgcaaaatggtgattttactactgagacgctgagtgaagttcaagatagtttgattaaccaataccgtgcaggtcatgatttggcaagtaatgttttggagcaacaattagttaccaaattagtcaatgaatcggataagaactttattactgaaataaaaaaagtaaccatagctgacgtcatgcgcgttgctaaacaaatgaaacttcaggcagtttatttattaagtggtgagaaataattatatggatagagaagtttatcaaaaatttaaccagtccatttatcgtgaacaattatcaaatggtttgaaagtccagctcttaccaatggaaggctaccataagacatatgctattttaacagctgattttggctccattgataatcattttataccgtacaatcaaaaggaggcgattactgttccagacggggttgcccacttccttgagcataaaatgtttgagaaaaaagatcatgatgcctttgatttgtttggtaaactaggagctgattcaaatgcctttactagttttactcaaacaagttatcttttttcgaccactagtaacctccatgagaatttagatgttttgttagattttgttcaagatccctactttactgcagagacagtgaaaaaagagcaggggattattggccaagaaattcaaatgtatgaggatgatccgagttggcggctttacctaggtattttaggcaatttatatcccaaagatccaatgcggattgatattgcgggaacggttgaatcaatcagtcatattacaccagaaattttgatggatagttaccggactttctatcaaccaaccaatatgaaccttttccttgtaggacgcttagatccagaagaaacaatggggtggatcaagcaaaatcaagaacaaaagatttttgctcccgcagagacaccccaacggttatttagcttgaacgatccaactgctcatgatgtaattccatttcgttcattaacgatggatattgttcgtcccaaagtgatggtaggtttacgggggaccaagcaatttgatgatggtaaagaacggctccactacaaattagcaattgatcttttgttagatgttttgtttgacgatacctcagataattatttgcgtttgtataataatgaaacattagatgacacgtttagttacaattttgaaatgcaacggggctttcactttgcgtactttagctctgatactgatcagatggaacgctttgcagatgaaatcattgatattcttgaaagtgctgaccagcaaattgaagcggcgcggacaaggtttgagggaattaaaaaggcagaactagggcggttaattggcttattagattcgccagaagcaattgctaatcgttatgctggaaacctctttgccggtgctagcttgatggatgagatagcgaccttggaaactatcacgattgatgatctttatcaagttgcaaaagagttcattactcctcaaggtatttcggtataccaagttgttccgcaacatcaataaactaaacttttcctatagatttattccgataagctaatatataattgagcatgatataatatccaagagtaaagataaatgaaaatggagatagaataatgagtgagaacgagaacgatcaaaaacgactagaaatcggtaaaattttacgaaaagcacgggaagaaaagggctatacccttgatgaccttcaacaaatgactaagattcaaaagcggtatttaatcgcgattgaagatgaaaattttgatgaacttcctggtgacttttatgttcgtgcgttcattaagcaatatgccaatacagtgggcttagatggtaatgaattattgcaaaaatacgatgatcaattaccacagactaaaacggaagagtattccgaccacttggctcaagcagttgaaactcgtgcaaaccaacgaaaaactgttagtgggagcgtagataaagttcgtaactacatgccaacgattattattgcttgtgtgattgttttagtgttggcagctatttggattacggccattgctcgcaatcatcgcgattcttctacacggattgataatagttcagtatctgtttctggagagagtcgtaagaaggcctctacctctgctaaaaaggcaagtacaaagcaaagcaaatcaacggcaatcaagcttcaagaagcacctaatcggaatgacacaagcgttacttacacagcaagtcaacttactaaagacacaacgctacaaattgaaccaagtgatcgttcttggatgcaagtaagagcaaataataatgatttattaaacagaactttgaataacaatgaaaaaactagtgtgaaaataagtcgtgatacaacttcattaataatcacggttggcaatgcccgggcaacaaaattaaaactcggtaatcaagaaatcgactttactaataatggccgttaccagaacacgcggaatgtaacgattaactttggacgtacccaaacaagcagcagttcagcaagtcagccgtcaaatagctcaagccaagcttcgtcatcctcggcacgtcctaataatgctactcaaccgtctgctgctaataataacagtcgtcctcagacaaatgctagtcaacaaagtaatcaaccaactcgttaattaagaggactaaaggagttagaacattgaatttaccaaataaactaactgttatacgtttaattattattccctttttcttattattaatggtgctgccattacaaagttggggagctgtaagtttttggggagcaactatcccgatggctcagcttattgctgctattttatttattgcagcaacaattactgataatcttgatggacaaattgcgcgacggcaccatcttgtaactaattttggaaagtttactgatccgcttgctgataagttgcttgtcatgactgcatttatcgttttaactggaaatggtgttgttccatcatgggtaacttcaatcattatttggcgagaattgtctgttacgggcttacgtttattgttagtggaacaagacggggtagtattagctgctaaaatgccggggaagattaagacaactactcagtttattgcaattatcttcttactcttaaataatgttatttttgctatttggaatattccatttggccaaataatgttatatatttgcttgttctttactatttattctggagtggattacttcatccagggacgcgatgtcttttcggatggatttaaatagaatatggagggtgagaaaaaacttttgttttttctcaccctcatgttttttatattcatagttttaagattttagtgaaaatgactatactttacgtatatatattaataggggatgaagttttatggatgcagaaattatctcagtaggaactgaaatagtccttggacaaatagttaatactaatgccgcgtacttagctaacagactaacccaacttgacttaccggctacttatcaaacaactgttgacgatcaatcacagagattagagcgggttattaattacgctttgactcgtgctcaattagtttttgtttgtgggggactcggaccaactgcagatgatgttacgatgcctacagttgccaaagtcttagggaaagagttgtggactgacgaagaacactggaaatggattcaaaaaacatttgagcaacggcaaataaaaatggaaccagagaatattcgtcaagcccagtatccacggggaggcgagccacttgccaatcctgttgggcttgctctaggatgttggtatgaaactaagggtaaagttgtggttgtcttaccaggaccacccgccgaatttaaggcaatggttgaaaagagtctgattcctaaactccagcaatattttcaaacaggaaaacaaattaccagtcggacattaaactttttagggcggccggagtcacaattaatggatgaaattgaagaggctactaacgatataccagggataagcattacttcttatgttcaaccaacggcaattcaggttcgactcaccgtgcgtgacttaccagtggttgaagctgaagaaaaaattgatcaggcacaaagagcaattcttgcagttgaagaaccatttttctttggagcgggggatgaccttacacttgccaaagtcgtcgttgaacaattaaaaaatcgcggatggaaattgacagcagcagaaagcttaacaggggggatgttccaaagtactatttgttccgtaccaggagcctcgactgtttttaatggtggttttgttacctatgctgctagtgcaaaagaaaagttattaggaattccccacgacactattgaccaatatggggtagtgagttctgaaactgctgcggcaatggcagaagggtgtcgacgaaaattaaatgttgaagttgggattggctttactggtgtggccggcccagatatgttagaaggacaaccagcggggacggtctggattggactagcaatgaagggatgcccaactaaaaccgttcaattacatcttgcatcctatgttggaagacaggcgattcgtacattaagtgttcagtatggacttcaattaatttaccgtgaactaaaaaaataaacgaacttttgttcacttttttcttgtttttttggctaaaactgttattattagttatcggataaaccgtaaaaaaaggaggaatttgatttggctgaccaacgaaaagcagcattagatgttgctatcagaaagatcgaaaagaacttcggtaagggctctattatgcgaatgggtgacgccactgatatgaaggttgcttcagtttctagtggttcccttgctattgacaaggcacttggaattggtggatatcctcgtggtcggatagttgaaatttatggccctgaaagttctggtaagactactgtagcattacatgcagtagcagaagtacaacgtcaaggcggaacagcagcctatatcgatgctgaaaatgcgcttgatcctcaatatgcagaagccttgggtgttaatattgatgacctattgctttcacagcctgatagtggtgaagaaggattggaaattgcagatgcattgatttccagtggggcagttgacttagtaattgttgattcagttgcagcattagttcctcgtgctgaaattgatggtgatatgggtgatacccatgttggattacaagctcgtttgatgtctcaggctcttcgaaaactttctggcgaaattaataagacaaagacaattgccatctttattaaccaaatccgtgaaaaagttggagtgatgtttggtaaccctgaaacaacaactggtggacgggcacttaaattttactcaactatccggatggaaattcgtcgtgcggaacaaattaagaatggtacggatgttattggaaataaagctaaagtaaagattgttaaaaataaggttgctccgccattcaaacggtgtgaagttgacattatgtatggtgagggaatctctaagactggtgaattgctggatatggcagttgaaaacgatcttgttgacaagagcggtgcatggtactcatatggtaatgagcggattgggcaaggtcgtgaaaatgctaaaaagtggcttaaggaacacccagatagcatgaatgaattaatggataaagttcgtgttgcaaatgggatggaaccgttaaatgaaaagtcaacgaaagaaactgctgatgataaagccagtggtaagaccagtgaaaataaacaagaaacaattgaagaagcaagtaaagaataaataataatatttgaagttgaaattccctaattttttagcattaatagctgaatattagggatttccctttttatactggctgtttaagcaattgataaattcaatagttgacaccttagtgtggcaagattaaaatttaacttgtgtgatgttttttgacgttacacggtgaaattaatttattcataccaacaacataatagttgaagcggaggtgaaatagtgaaaattttaatgttcgccgcgcttgctatggttgtcggaattattgtcggctatgtaattcgcaaggtttcatatgaaaaacaagttgcagaagcacataatgatgctaaaggtattatttctaaagcaaaacaagaagcagtaacggcgaaaaaagaagctattttagaagcgaaagaagagagtcatcaataccgcgagagagtggaagatgagttaaaacagcggcggagtgaggtccaacgacaggaagaccgattactccaacgggaggcttctttagatcataaggatagcgctctagaaaaaagagagaatgcagttggtgttcgtgaacgtaaattagatcaagaaaaagagcagcttcatcaatcaaaggaacaagcagaagccttaattgaacaacgcaaacaagaagttgaaaaagttgctcaaatgtcacaagaagatgctaagcagttattattatctgaagtaaaagaacagttaaaaactgaacgagcagtaatgattcgtgacagtgaacaagaagcggaactttctgcagaacgtaatgcaaagaaattaattgttgaagcaattcagcgtagtgctgcggatgttgtctcagagacgactgtttcggttgttaatcttcctaatgatgatatgaagggaagaataattggtcgtgaaggtcgaaatattagaactttagagacgttaacaggtattgatttgattattgatgatacgccagaagctgtcgtattgagcggctttgatcctgtacgacgtgagattgctaagatcgcgcttgaaaaattaattcaagatggtcgtattcatcctgcacgaattgaagaagcagttgataaggctcgtaagcagatggatactcaactacgggagactggtgagcaagcattgtttgatctaggaattcattcaatgcatccagacctaattaagacggtcggaagaatgaagtaccggactagttacggtcaaaatgtcttagaccactcaatcgaagttgctaagttagccggaattatggctgctgaacttggggaagatgttacattagcaaaacgtgctgggctcctccatgatattgggaaggcaattgatcatgaagttgatggttcacatgttgagttaggtgtagaactaacccgcaagtataaagaaaataaagtggttatcaatacgattgcttctcaccatggagatgtccctgctaattctgtaattgctgttcttgtacaagcagcagatgcaatttcaggggcccgtcctggtgctcgaagcgagtcattagaacaatacattcaacgtttaaagaaactagaaagcatagcaaacagttatgatggtgtcgaccatagttatgcaattcaagctggtcgagaacttcgcgtgattgtcaaaccgaagaagatttctgatttgcaggcaacaactttgtcacatgatattaagaacaaaattgaaaagcaattagaatatccaggacatattaaagtaaccgttattcgggaagttcgagcagttgattatgctaaataaactgatttttcagttcctataaagaggctgggtataaccttcagtctctttattattttaaataacatccatcatttatagagatcttgcagcaaatttagacacaaaatataattagtttattattaagattaaaaaatatattaatggggtgaaatttagtggcaaaaaaaacaacaccgatgatggaacaatatcaaaaggtaaaagatcaatatccagatgcctttttattttaccgacttggtgatttttatgagctatttaatgacgatgcggttaaaggagcgcaacttcttgagctaaccttaacaacgagaaaccatagtgcaaaaaatccaattccaatgtgtggagtgccccatcgcgcagttaacaactatattgatattttaattgataagggttataaagtagcaatctgtgaacagatggaagaccctaaaaaggcgaagggaatggttaaacgagccgttacccgtttaattacacctggaacgcaaatggatttaaatggtgaacaggcacgtgataacaattatcttgcagcgattagtggacaaaatggggtatttagtattgcctataccgacttatcaactggggagcttaaaacgacaagcttaaataatgcaaatgacgcggttaatgaattggttaatctccaaagcaaggaagtagttgtggacggtgagttgccagctgaaataacaactcagtttaagcaacgaaatattcttcaatcacatcagccaacggtccttaaaaatgctgagatcagctatcttactcaagaccttgatgatcaagcccaacagcacgttgttgcgttacttgtgtcatacttattaacgacccaaaagcgctctttggcccacctgcagaaagcaattgcatatcaaccaagttcttttatgaagatcgatcactattcaaaaacaaatctcgaattaatgcgcaatatgcgaagtgggaagcgtcaggggaccttggcatggcttttggatgagacaaaaacagcaatgggcagtcgtcttcttaaacggtggattgaccggccgttgattaatcaaaatgcaatcagtgaacgacaagataaagtccaagagttattagaccactattttgagagaagtaatttgcaacaagagttaattaaggtatacgaccttgaacgcttagcaggacggattgcctatggaagtgttaatgggcgtgatcttattcaacttaagacttccttaaagcaagttcctaaaataaaatacgttttagaaacccttgattcacctgtctttgaagaattgcaaaaacaattggatcccttggacgatgtggcagatttaatcgatcaatcaattgttgaagaaccgccaattgctgttactgaaggtggcgtgattaaggatggctataatgaccaattagaccaataccgtgatgcgatgaataatggaaaacagtggattgcggacctgcaagaacatgaacggaaattaacgggcataaataacctcaaaattggttataatcatgtatttggctattatattgaggttacaaaagttaatcttaataagcttcctaaagatcgctatgagcgtaaacaaacattagttaatgctgaacgtttttctactccagaattaaaagaaaaagaggcattgataatgggagcgcaagaaaagtcaacagccttggaatatgatatttttgttaaaatccgtgaacaagtcaagggacaaattacacgcctgcaaaaattagcacaacaacttgcggaattagatgtactccaaagctttgcggttgttagtgaagactaccactttgtccgtcctaaaatgaatactggtcacgtattaaaaattaaagatggtcgtcacccagttgtggaaaagtttatgggacaccaggaatatgtgcctaataatgttttgatgggagaagataccgatattctcctgattactgggccaaacatgtcagggaagagtacctatatgcgtcagctagcattgattgcggtaatggcacaaattggttgctttgtccctgctaaatccgctgaattgccaatttttgatcaagtctttacgcgcattggggcagctgacgacttaatctctggtgaaagtaccttcatggttgaaatgatggaagccaataatgctttgacccatgccacggatcgtagtttgattctctttgatgaaattggccggggaaccgccacttatgatgggatggcattggcgcaagcgattattgagtacgttcatcagcatgttcgtgctaagacgctattttcaactcactatcatgaactgacagctcttgagaatagcttgacgcggcttaaaaatgtccacgtaggagcaacggaaaaagatggggagttagtattcttgcataaggtaagtgcaggtcctgcagataagtcttacggaatccacgtggctaaactagcgggaatgccatccttattgttaaaacgtgcagatactattttgcaaaaattagagcaaaaggatgtaaaactaccgaatgcgcctaaaccggcaacagataattaccatacagaaccaatatcagcaaagataaatgaagcggcaccggtaaagaaagagtctgcaccagttgttgaagataatggtcaacttgaattatttgctactcaacctgagaaaaaagaatcgagtgttgatcggcggattttacatcaattaaaagaacttaatttaatggggatgacacccatggatgtaatgaatcaaatttataagtggcagcagaaattgaaataaggtgatatttaatgggaaagattcatgaattagataatattttagccaatcaaattgctgccggtgaagtaattgaacgtccagcatcaattgtaaaagaattagttgaaaattcattggatgcccatagtcaccgtgtagatattattgttgaaaattcaggtttagacagtgtgcgcgtgattgatgatggtgacggaatcgctgctgaagatattagactagcatttcaccgtcatgcaaccagtaagattaattctcgccatgacctctttaaggtgcagacgatgggctttcgtggtgaagcgttacctagtattgcttcagtcgctgatgtaacgcttacgactgcgcaagctggtcaagaagaaggaacaatgattcatttgcgaggaggaaaagaattagtagtgaagccggctggtgcgcgtcaaggaaccgatattaaggtaaccgacttattctttaatactcctgcgcgattaaagtacttaaaatcacctcaaacggagctaaccagaattacggacatcattaaccgacttgcccttgcaaatccagcggttgcttttagctttacccataatgggcgggaattatttcggtcggcaggtaataataatttacaacaagtagttgccgcaatttatggcgttcaagcaggacgtaagatgcttgagataagtggtgcagatgatgattttaaggttagtggttttgtttccttaccagaattaacacgtgcatcacgtcaatatataacaatcacaatcaaccatcggtatattcgtaattttgaattaacaaaggcaattactcagggatatgaatcaaaactaatggttggtcgttatccgatcgcggtaattaacattgatctggaccctgttttagttgatgtgaatgtccatccagctaaacgcgaggttcgtttgagcaaagaacagcaattaataaaattgattgctgaaacgattcggcagcgaatagcagttgagaacttgattccggatgtcgatgctgaccaatttattcctaatgatgatgaggtagcggaccttgatcgccggttaaaggaagcatcacctgtttatcacgccgcaccgatttcggcagtgccggcaacagaaaaggcagcaactgagatttcaactccagcagctgataatccagcacatgctgacgcgcttgatagtgagattccagcaccgatcgttatccaccatcttgaagatttaaatacgctcgcaatgcaaaaatttgatgagcgttatcaaaatgaaggtgaagttacgccattttctgctccagttcccactatgactaagaagccagtaaaacctgcaaatattgaattggatgttcatgataaacaagatcagcagcaaaatcggtttcctgatcttcaatatattggtcaacttcagggaacctttttattagcacaagcaggagatggtctttacattgttgaccaacatgctgctcaggagcgaattaattatgagtattaccgccaaaaaattggggaagtgagcgctgatcagcaaaatttcttggttccgcttgttcttaattattcgactgtcgacgcaatgacaattaatcagcatctcgatacgcttgcagcggtcggattagaattagagtcatttggtcaaaatagttttattttgcgctcccatccaacctggtttaaagaggggcaagaagaagacacggccaaagaaatgattgattggttaattaagaatggaaagctaaccgtcaaagaatttcgaatgaagacagcgattatgatgagctgcaagcgggctataaaggctaaccaccaccttgacgaacgggaagctaaagccttgctgaaacggttgccgcaatgtgagaatccttttaattgtccacatgggcgtccggtaactgttcattttaatgatcaggatttagaaaaaatgtttaaacgaattcaggattcacacaccccatatgcagacgattttgatgatcatgaattttaaggaggaactaccttgtacgaatacttaacaggccttgtaactgttgttgcaccacaatatatcgttgttgatgttaatggggttggctataaattattagttgctaatccctatcgttatcaagaggatcggactaagaaggtccaagtatatgtttatcaagcagttcgtgaagataatatttccttgtttggcttcacagatcaaaatgaaaaaaaactatttatgcaattaatcaatgtttctggaattgggccaaagagtgctttagcaattttagcgaaccctgatcatcagggacttgttgatgcaattactaataataatgttaactatttaactaagttcccaggaatcgggaaaaagacagcttcgcaaattgtgttagacttacgtgataagctcactaatgaaagcagcagctcattatttgcaacaactcagcttaccgttgatgcaacagtaaatcgtgagttgaaagatgctttggaagcattggctgcattaggatacaaggaacgggacattaaaaaggttcaaaagacattaatgaaagaagaacaaatggcaactgatgaatacttaagacaagcattaaggttgcttaactaggaggtgcaagacttgtggaaaatgatcatggtattttatcagatcacccatcaggagaagaagaaaaccaagtggagataactcttcgaccacagaaactaagagaatatattggtcaacctaaaatcaagcacgaactagaagtatatattaaggcggcccaatcccgagaagaagcccttgaccatgtattgttatatggtcctccaggattaggaaagacaactttagcgatggtaatagctaatgagatgggcgttaatatcaaaacgactagtggaccagcgatcgaaaagccaggagatttggttgctttattgaatgagttgaaaccgggggatgtcctttttgttgatgaaattcaccggttacccaaagttgtggaagaaatgctttattcagcgatggaagattactatattgatattgttattggtgagggaccgactgcgcaccccgttcattttccccttcctccatttacattaattggggcaacgacacgagccggaatgttatcggcaccattacgtgatcgtttcggaattgttgaacacatgaactactatactcaagatgaactgacaaaaattatttttcgttctgccaagattttccatactagtattcaaaatgaaggggcccatgaactatctcttcgttcacgtggtacgccgcgaatcgcaaaccgccttttaaaacgggtacgtgattttgcccaggtagcagggaaacaaagcattgattcagcaattgttaagcaagcattatcgctgctccaagttgatgatcggggcttagatgagattgatcggaaaatgttgttaacgatgatcaatttctaccatggaggtccagtgggattaaaaacaattgcagcaaatattggtgaagaaactaatacgattgaagaaatgtatgaaccatatttgttacagatcggctttattagtcgtactcctcgcggccggttagtgacaccgacagcatatgaacatttaggaattgaatatccaactgatagaaattgattgaggaaaattatgagtaagttagaatttacaattaatcaaagcgatggccaagcacgaaccggaattttgcagattaatggacgacaaattgaaacaccggctttggttgccagtggagatgaactagcaaaattatcacccaaccagcttaatcaggctggtgtaagtgcagttaagacaagtggattaaagcgttggctaaaatatgattcgatgactgaaaaattaggagacctccaccaactttttcagtgggatggccttttatttgtggatttagaaactgaggaggcctatcacttagcaaagccacgcgggaaaaaacatgatggcgttcgttttcatgatccgataacgggacaattaaaattctggcaaccagaaactgctcttcaagttcaagaagcgctcggggctgatatttttcaaagctttgaccaagcaacagattattatgcgccagttgatgatttaaaagtaggggtaaaacaaactaataactggttatctgttgttaagccccaaaaaggccaagcccttggttcaattgttggtggcggcttaaaagatttgcggacagccagtattaaggcggtcgatgaggctgggttaagcggctatcggttgagtgggatccctagcagcttagatgatcaagagtttagtcgaatcattaatgaaattacgcctaaactaggagaggagaaactgcgctacctccctgctgcactttcttttgaccagctgatagaggcaattttagcaggagttgatttaattgatagcaatctagcagctaaaaaagcggctaatgggattgcattagttaatcaaggagtgacagttcttcatcttgatcgtcaacattttagcttcgattcacaagtgcttgatcgtcaatgtgcgtgtgcaacttgtcgcgcgggctattcaaaagcactactccatagtttaattaccaatcaaagtttttacggtgaacaacttttgctgcagcataatctgtttaccctcaataaattaatgagtagtctccgacaagcaattaaaaatcatcaaacaaaaaaatttgttcaagaattattgcagaatcaatagagcatatagctttttatggtaaagtttgttaaagttaatattagttaactttttgaagggatggataaactgtgaatagtttgagtagttttgttcttggtgctgcttcatctaataatgcaagtggttactcaagaattattttaatcatcttaatggtagcattaatgtacttctttatgattcgcccacaacaaaagcaacgtaaagaacatcaagagatgatgaatgaattacacccaggtgatgaagttgttacgattggccggatgcatggtaagattgattcaatcaataaggctgaccggacagttactttagattgtgaagggatctaccttacttttgatatggtggcaattgcccgtgttattaaacgagcagatgcaccagctagtgaagttccccaagataataaagctgttgctagttctgccgctgacagttctgcagatgcttcagcagatagtgctgctagtgaacctacatctgcagcgagtgctagcgatgaacaaaaaggcagcgaagaaaagtaatttaatttagatgaaaatagtcgtaaacaggcgaatattttcatcttttttatttggttgttaatcgcgtttattgctatactaaaagatagtgttaaattttattcgggtaaggagaatagcataatggcagatccattaacagcaatttttgaacaaatcaaaaaatacaataaaataattattcatcggcatcaacgccctgatccagatgcaattggctcacaagttggccttgcggaaattttgcgggcttcattcccatataagcaaatttatgttgtagggaagcatattccagggtttgattggatcggtgagatggatacgattgacaatcagacattcgatgatgcattagtaattgttacggatacagcaaatgcgccacgaattgatgatcggcgctttgataatggggacgaacttattaagattgatcaccaccctaacgatgaaccctttggcgatattatgtgggttgaaccagatgcttctagctgttctgaaatgatttatagtttttatcaacgatttgcaaaagaattaactcttccccagaaggctgcccatgccttatatgcaggaattattggcgatacaggtcgtttcctttatccagcaacaactccacgaacgatgctagttgcaggttcgttaatggcagccggcgcaaatgccgcggaaattagccagcacgaaaatgaaattaccttaccagtggcccggttatcagcatacgtttatgaaaatttgcagatattagataatggagccgcatatgttatcttaaccaatgaaattttagaacaattcggattgactgaagccgggacatccgcaattgtttctttaccaggtcgaattcatgatgttattgcctgggcgatctttgtagaacaagaagatggccattatcgcattcgtctccgttcaaagggaccaacaattaatgaattagctaagcagcacgatgggggtggacatccacttgctagtggcgctaaggctaaagatgaagcagaaattaaacaagtgattgatgaattggaccaattaacacaaagttatgcaaaccaaaaatgaaagggaaatagctatgagtgataaaaaatttgctgattttcagttacaaccttatctgttaacagcaattcaaaaaattaattttcgtcaaccaacaccggtccaacaacaagtaataccagtgattatggctggacgaagtgttgtggggcaatcagcaactggtagtggaaaaacacatgccttcctcttgccgattttttcaaagattaatccagaagatcaaaccgttcaagcagtaatcacaactcctagtcgggaattagcataccaaatttataatgcggcaaagcaacttaataagtatgctcctcatcctcttaccattcacaattatgtcggtggtacagacaagcagcatcaagttgaccaattaagtcgaaaacagcctcaattggtcattggaactccgggaagagtattagacttaatcaagagtcaggcattggatattcacacagcaaaaatgtttgtggtggatgaagcggacatgaccctagatatgggattcttacatgaagttgaccaaattgccagtcattttcctgatgaccttcaaatgatggttttctcagcaacgattccgcagaaactgcgcccattcttaaaaaagtatatggaaaatccagtaattgaagagattcctactgaagcagtaattaatccagatgttgataattggttaatgtcaactaaggggcaggaccgtaaccagctaatctatcgtttgctgactcttggtgaaccatatcttgcattggtatttgctaatacaaaagaacgagcagttgaattaacccagtatttagaaaatcaagggctcaaagtagcgatgattcatgggggactggaagcccgtcgtcgtaaacggacaatgcggcaaattcgtgatcttgaatatcaatatgttgtagcaactgatctagcagctcgtggaattgatattgatggagtatcactagtaatcaatgacgacttgccaactgatcttgaatattttgttcatcgggttggtcgtacagggcgaaatgggatgaaaggaacagccattaccttatatgaaccagcagaagatgatttaattgctaagcttgaggagcgcggagttaaatttgtaccaaaagaattaaagaatggtcaactagtaactacccatgaccgtaatcgtcggaagcattataagcggcggcaaaatgaacttgatccgtcaatgaagggttacgtaaaaaagactaagaagaaggttaaacctggttataagaaacgaattaaaaaggcgattaaagaagacgaacagcaaaaacgaaagctagaattacggcataaaattcggaaagctaagcgtgcacgacaaaaacaacatcgccgtgaacgaaatgcccgttgattttaaagtaattgttcgctataatatgacacgtttgggacatgctataactaatggaaaatttcagagacagttggtaaggtgtgacaactgatttcctagccttagtgctccccattcggataatttgatatttaaccttgggcaaccaagaagtaaagaggtaaacgaattccatcgttgcaagcagagtggtaccgcgtcaatctggcgtctctgattcgcaatggtggttttttgttttagaaggggcgatttgatgaaagagttaaagaagctaaatagtgctcaagtacggcggatgtacttgaagttttttgaagagcatggccaccaagttatgccgagtgcatcattagttccagtaaatgatccaacattactatggattaactctggagttgccacaatgaagaaatactttgatgggaaagttgttcctgataatccacggatgacaagctcacaaaagagtattcgaacgaatgatattgaaaacgttggtaagactgcccggcaccataccatgtttgaaatgttaggtaacttctctgttggtgattactttaaaaatgaagtaattccatgggcttgggaattactaacaagtgatgaatggtttggttttgatcccgaacggctatacattacttattatcctaaagaccatgacgcttacaatcgctggcgtgaagtaggcgttgctgaagatcacttaattgctgatgaggataacttctgggatattggtcaaggtccatctggtccagatacggaaattttttatgatcgtggtcaagaatttaataatttagccgatgatgatccagaaaactatcctggcggtgaaaatgaacgctaccttgaaatttggaacattgtctttagtcaatttaaccatacgcctgaagatacttatgaaccacttcctcataaaaatattgatacggggatggggcttgaacgggttgtttcgatctttgaaaatgcccctactaactttgaaaccgacttatttatgccattaatcaagcaagctgaagagtttagtggtactaagaagtatggtcaaaataaagaagacgatattcaatttaagattatcgctgatcatattcggacaattacctttgcgatcggggatggcgccttgccttcaaatgttggtcgtggatacgttattcggcggttgcttcggcgagcagttgttgctggaaagaagttgggaatcgatgaaccatttttagcaaagatggttccaacagtcggcaaaatcatggaagattactatcctgatgttcttaaaaatgctgactatattgcttcggttattgaatcagaagaagaccgctttagtgcaaccttaaatggcggattaaacttgttgaataacgtgattgctgaagctaaggaaagtaagaccaacgaaattgatggacgaacagcctttaagctttatgacacttatggcttcccaattgaattaaccaaggaatatgctgaagatgaaggactaacagttgatgaaaagggcttccaagcagcaatgacggagcagcaaaatcgtgctcgtaatgcccgtgatatggataacgggatgggtgttcaaactgatttatggacttcattcaaagaagatagcaaatatgttggctacactgatttgaccgttgataatgcaaaagttatcggcttagcacatgatggtcaacaagcggatgaagcacgaccaggtgataagaacattgaactaatttttgatgtaacgccattctatgcagaaatgggaggtcaagtcgctgatactggtgacattattgataactatggtaaaaaagttggccgtgtggttgatgtccaacacgcaccaaaccagcaaaatcttcatcgagtagaattaactgcccctattaaaaagggtgcccgttacaaactagttgttgaccgtattcgtcaccttaagattgaaaagaaccatacagcaacgcacttgttagaccaagcattacggaacgttcttggtggtcatactcaacaagccggatcattagttgaagaacattacctacgttttgactttaaccactttggtcaagtaactgctgaggacctcaagaaggttgagaacatggttaatgagcaaatctggaaggaaatcccagtcaagacagttgaaactgatattgattctgctaaggaaatgggtgctatcgccttattctcagataagtatggtgataaggttcgggttgttaagattggtgactttaacactgagttctgtggtggtgatcacgttaaaaatactaatgagcttggtctcttcaaaattgtttctgaaggaggagttggtgctggagtacggcggatcgaagcagtaacttctagtgatgcctttaagttcctccaagatcgtgatgacctcttaacaaagagcgctgctagtttgaaggttgctcagattaaggaagttcctcaccaagtagaaacattacaaaatgaacttaaagaagctcaaaagcaaaatgagtctcttcaagctaagattgctgctcaacaagctaataatgtttttgaaaacgttcaagcaactaagaatggaagtttaattgctgccgaagttcaagttgctggaatgggtcaattacggcaacttgctgatgcttggcgctcaaaggctctttctgatgttctggttcttgctacagccagtgatggtaaagcaaacttattagtggctgttagtgatgataaaactaaggaaggcttaaaagccggtgaccttattaaggcgattgcaccagccattaatggtggcggtggcggtcggtcaaacctcgcccaagctggtggaaagaatccagctggaattaaggaagccttaagtcaagctaaaggttacctcgataagtaaatcaaaaatgagaaggaaataaccatctcatagtctaagagattgaaagaaaccaatttttgagttctttcaatctctttttgtaagaacttcttaaagtaataaaaaaatactatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaaaaaaatactatcaagaaatcctattatcagctataattataaaactaatattactgtttacttacaattgacaaatgtaaattgtgattttaataagaatatagtaaaattgatggttgaaaggaatatctggaggtgacgattgatggctacaaatgataaaacgatgttctttgattttggtcaagaacgtcaagaagatattaagcaaacattaaagacggtttatgaatcattagaagaaaagggatataacccgattaaccaaattgttggttatcttttatctggtgatcctgcttatattccgcgtttgaatgatgcacgtaacttgattcgtcaacatgaacgtgacgaaattattgaagagcttgttcggtcatacctaaagaataacggtgaaactaaatgagattaatgggattagacgttggctctaaaacggttggcatttccgtaagcgatcctctcggttggacggcccaagcagttgagattattccaattgatgaagaaaacgaaatttttgggattgatcgtgttgccgagctagtgaaaaaagaacaggtagctgggtttgtaattggccttcctaaaaatatgaataatacagaaggccctcgtgttgaagcatctcagcactatggcaagctattacaacaacgttttccagatattcctattgactttcaagatgaacgtttaacgacggttgaggcacaccgaatgctagttgaagaagcggacatttcacgtgctaagcagaaaaaagttatcgatgaagttgcagcaacattcattttacaaagctatttggatcgccatggccgccttgtgaataagctaaaatgaggtattaaaatgagtaaacaagaaaataacgaagacatgattacgttaattgatgaaaatggtaatgaacaattatttaaggaattgtttacgtttgattctgatgattatggcaaatcctatatctttatctatccagcggaacaagaaaatgacgattccgttgacattcaagcttacattatagctgataatgaagataacgatggacaggaccttgtcccaattgaagatgataaggaatgggacatggttgaagaagtattaaatactttccttgataatgatggcaacttcaaggcctaattaaaattactggataaataaaatattaacaaaagggagctgtagacacatttgtcacagtcctttttctttacaagcagaatgaaaggatcattaggatgattttaacaacctttattattttgattttaatggggtgctttattaatggtcatcgccgcggattattgacaatgacgttaatgctggggacatatatagtagcttggattgttgctcgccagggagcccaattgattggtggctggttaaaatcgttattaccaagtattggaaccccggcaactttttccgagagcttgcttgcaaatgtaaatagtaatcttttcttttataatgggattgcatttatgataatttttacaattgtttcaattctttgtcactggggaattcgtcagttaaactggataaagaggattccagtggtgggaacagttgataagatcgcaggtgggttaatctcatttttaattggctatttgattatttacgttgttttactaattatgcaattatttccagcaggttggtggcaaatgcaaatagcaaactcggaactagcgcgttttatgattaatcaaacaccaggaatagcgcatttagtaattgatacgctagtacagggaggataaaatgaacaacaaaattttagaaacattagaatttgatcgaataaaaggacaactggcacaataccttgtttctgccgctggtcatcgcgaattgacgcagcttgttccacagactgattatgaggcagtcaaagaacttttgacagaaactactgatggggccgatattttaaggttagaagatgggattcctattccgcaattagctgatatcaaaccgcaattgaaacgtttgaaaattaaggcaaatctgaacggcacggaattagctcaaattactaaagtgctgcaaactagtatgagtgtaaaaaacttttttgatcagatgcgggagaaaaaaattaaactacgggttttaactacccaagttgaccgcctagttacaattccttcaattacccagcggctagttcgttcgattgatcctgatggacggataaatgatgaggcatcagctaaactccatggtatccggcaattaattacccaaacggaaacagagattcaccaacaaatggaaaggtatactcgtgggaaaaatgcgaaatacttaagtgaccctattgtcacaatgcggaatgaccgctatgtgattccagtaatcgcccgctatcgaaataaatttggtggggttgttcatgaccaaagtgctagtggacaaacattatatattgaacctgcagccgttgtggagaccaataatcggttacgacaagcgcaaatagaggaacggcaagaaatgcaacgcgtattaattgagttatcacaaatgattgctccttatcgacatgatattggtcagaatgaagcaattcttggacaccttgactttattaatgcaaaggcacgctgggcacatgatactaaggcaacgctaccgctcttaaacaaagaaaatcatgtttcattacggaaagcgcgtcatcccctgatcgatccccaacgagtagtgacaaatgacattaagattggggaagattaccaagcgattattattactggacccaacactggtggtaaaaccattacgcttaaaactttaggaattattcaattgatgggacaatctggcctatttattcccgcagaagaaggcagtacaattgggatctttgataatgtatttgcggatatcggtgatgaacaatcattggaacaaaatctgagtactttctctggtcatatggatggagtaaaagccattcttgaacaaattacaagtcgtagcttagtccttctagatgagcttggtgctgggactgatcccaaagaaggggctgctttagcaatggcaattcttgataatattggcagtaaaggaaccatggttgtaattactacccactatcctgaacttaaagtttatggttatgatcgtgctaagacgattaatgctagtatggaatttgaccaagaaactcttaagccgacgtataaattactactagggattcctgggcggtcaaatggattagagattgctcagcgattaggaattagtccccaggttattgatgaagcacggacatttgttagtgataatagtcaagaccttaacaatatgattggtgatttagtagagcaacggaaaaaagcacgtgaagaaagtgaaaagctagcaaaactagtagccaaaaatgaaaaagttcagcgtgaccttgataagaaactcacccgctttaatgaacagcgcgataagctatacgaacaagcacgttcaaaggccaaccatcaagtttcgatggctaagaaaaaggctgaccgaattattcatcatttgcgccagttagaagttcagcagggcggaaatgtaaaagaaaatgaattaattgatgcacaagggcaattaaacgctcttcatcatgataatccacggttgcaacacaactctgtattacaacgggctaagcaaaaacatgatttgcataaaggtgatgcagtcttggtgaaatcttatggtcaatatggagaacttttatctaagcgagggaaccacaagtgggaagttcagattggaattcttaaaatggaaattgatgagaataatcttgaaaaagtagctaagaaagatcttccacgagaaaaagatgcaaagcggcgaccacgagctgctgtgagaacgacacaaacacgaaagacctcggctcgtcttgatttgcgcggtcatcgctatgaacaagcaatgagtgagctaagtaactttattgatcatgcattgttgaataatctttcaacggtaacaattattcacggaaaagggaccggtgctcttcgtaagggaacacaacaatatttgcaaagcaatccacgagttaaatcattctcctatgcttcccctaatgctggtggggatggggcaacaattgttaatttataattacttactataaaaagtaagcaaactaaatgacatttaagaagtgatttgttagaatagcgttaagaaaaacaaaggaggaattgaatatggctgtaaacgtaactacagatcaaacctttgaacaagatactgccactggtgtcgatttaattgatttttgggcaacttggtgtggtccctgtcggatgcaatcaccagtagttgatgcattatctgataagatgcccgatattaaattttttaagatggatgttgaccaaaatccagaaactgcacaaaaattccggattatgagtatccctacattaatggttaagaaagatggtaaggtagtagaccaaatcattggttaccatagtgaagatcaattaaagcaaattttacaacaatatgttgattagaaaaaagctggagaaaaactttttgttttcttccagctttttcgtattttaaacttattttttatctttttttcgtcgctttagtagggaatgacgagtttcttttttgagggtgtcttctttttcgtcagggcgatcaacagtaatgaatgttaccatctcagatcgttcattatcagctgaactttgtggatcgttttgaatcaaaatatcaacataatcacggtgccagtcaaagatctttgcctctgcaaccgttccaagttgaaactctacttcttgagcaagaaaaccacactctaaaccaaaggaggtttcctcttcgtctctttgaatccgttcctttacaattacccctgataacctccaaacttgagaagtattgctttttttacgtaaagctaaacggccaaagccaagttgattagtgagatatactagatcctcggctgtagcaacaggatatactcgagcgagatctttaccaatccaatatagcatttcatcggtctctttacccaggatagctggtaaaatcacgtcgcgcattgttccagctcctagtccttgatgaccggctattaattgattatataatttctgactcatatccactcgctcctttttaacaatcattattattatacttaaaattcaagatcttaatagggttaaacctgaaaaacttgcaaaatcttatggagaaacggataatatagtttcaaggttttaaacgttttaataaattaacgaggtgaagagaatggataaacgaccaatcggggttatggattcagggttaggcggcctatctgtaattcgtgtacttcgtgaacaactgccccaagaatctgtaatttttgtgggtgaccaagggcattttccatatggaactaaaacaaaagaacagattcagcaattagcattacgcattggaaaattcttgttagaacaagacgtaaaaatgatgataattgcatgcaataccgcgactgcagcagctcttcgacttcttcaaaacgaattaccaattccagtaattggggtaattgaaccaggagccatggctgctacccaacatcattataaaaaaattggggtaattggcactgaatccactattaaaaatggcgcttatgctaaaacattagctaaacttaatcctgatctaagtgttatcagttctcccgcacagccacttgtctcaattgttgagcatgggcaaacaggaacaagtgaggcacaaaaagctgttgacactgaattagaagtatttgataaccaatcgattgaagctttgatccttgggtgtactcatttcccgtttttacaaaaagaaattcataataaattaggatctaatgttcagttaattgatcctgcatttgagacaatcagacaggcaaaggaattgttaactggcaaaaatcagttgagtgataatttagcgtcaagtatcaacctttattcaacgggagatgctaaagacttagttgctggtgcacaacaatggttaccaaacggatacagtaagtgtgcacatattgaattaaacgaggaaggttaaaatgaaaacaatcgtaatcgcaacaaagaatgccgggaaagtgcgtgaataccaagatatgcttgctcccctaggaattgaagtaaaaacattagccgattttgcaccaatagcaattaatgaaaatggtaaaacatttgaagaaaatgcaacaattaaagctactacagctgctaatcaactccaactaccagttatggcagatgattcgggcttaatggttgatgctcttggaggtgctccaggtgtacactcagcaagatatgctggtgatcatgatgatgctgctaataatgctaaactcttattggcgttaaaagaggtaccggatgaaaaaaggactgctcactttcatactaccatcgtcggaattaagcctgatggaaccaaattagttgccaatggtcgggttgatggccatattcttcatcaactcacaggagaaaacggttttggttatgatccgcttttttatgttgatgaattaggcaaatcaatggcccaattaacagcagaccaaaagaatcaaattagtcatcggggacgcgcattacgatcatttatgaagcaatttaatgattggtggtaataaaaatgaaaatactagttgtaagtgataaccatcgagaagaaaaaattttgacagagattgttcaaaaaatgggggatcaagttgacctaatgattcactgtggggattcagaattagctcctgatcaggaaccgatgagcaattttaaggcagtgaaggggaataatgattatggtttgtcgtaccctaatgagttggtaattaatgctgggcaagagcagctctatctaactcatggtcatttacagcgggtcaatttttctctgacccctctgatacttaccggccaagaaaaaggtgcctccattgtgtgctatgggcatactcatcagttaggagccgtttacgatcatcaaatgctaataattaatcctgggagcatcagttttcctcgtggtgaatatgctaaactcgggggaacttttgcaattattgatgcgcagcctgagcggtttattgttgattattataaccgcgagatggaagctgttcctgaattacattgtgaattcagtcgtcagaaataaaggagtgtatttttgtgattgatcagcgtttgcagactttattgctgaaaaataagcagaagtttatgatccctgccagtttagttgcaacagtaaatcaaagcaacagtttagatcatgcatttttagtccttactaaggatcggtacgctaaaattattgtgattgataataaaaaccgttactgtggtcaagtttctttggcgatgattactgaccgattattggagacaaaacggatcaatgtggagcgcttaaatgaattaaaggtcagggatgtgatgcaaaccgatgcgccagttatccaagatccaactgatatcgaagaaaatttacacctcttaattgatcagtcatttttaccggtggtggacgatcataattacttttgcggaattgtgacgcgtcgtgaagtattaaaggcggtcaattatacaatgcatacttttgggaaataatgaaaagtagttatgatataagtcaagttactttcataaaaaataaatagcgcagtacaacataggcctccagcgtccggtaaaaccgaacgttggaggcctccttctttttatcattcatttttaattaactgattaatagtctgcaagacgccatcatgattattatcaattgttgtggtatgggcagcttgcatttgaataattggttgagcattttgcattgcgtaactttgactcgtcattgctaacatcccgaggtcattttcattgtcaccaaacgtaacaatttcatttgcctttaaattaaagtgagactgtaaaagagaaagagcgttttgtttagttgcagcagcattaccgattaagtcagtattaaagcctgaattttccatgattaaggatggtggtaagtaaccatctaaggttgttgcaactttttttagatcgatatggttagcaaaattaatcgatatcttggtaaaatcttcagttggccgttgagtgaaaatttgtcggatatcagggatacgctctacattttcataaaaaagtttcacaatattgaaatcatgagcactcatcccctgatcaacataagatttttcactagtagagattactaattgattaatatcttgtggaccatagaaacggtcaaggacatgaataacccgggctaaagattcttgattaataggaaaagatttaaataatttgcttcctaaatgaataactgaaccgttttgcgaaataaatcccatcttggcggtgtagtctttaaattctcgttgcaaacgtggaaagctggatccactagcagcgacaaagtagatattatggcgttcaagttggcgaaagacctttgcaaataaagaatgattgtaagtatggtcatctcgtaaaaaggttccgtccatatcagtagcgattaatttaatactcattaggtactccctcccaggcaattggaatattatttgttcgtaattctttaagatatgctgccaaaaagcgactagcaacagttgattgttttccgctgactgctgttatcgtcacacgaaaaacgagcgcaccgtctggggtaacgactggtccgacaataactggttttaattgtagtgcctttatttgtggaactagttttttattaacttgcgtaacaatttcttctaccttactaagaggggtcttcgaagtaatccgaatatcaacgttgctaaccatattatttcgtgaaaggttttgaacaatagtaatgttacggttaggaataaaattaagtgttccgtcagaactagtaacttgtgtagtacgaataccaagagcagttactgttcctttgatttgcccaatttggacagtgtcgccaacgtctaattgttgctcaaggaggatgaaaaatccagtcacgatatcactaacaaggctttgcgcaccaagccccaatgctaaactaaagattccggctccggcaatcagtgtccctactggaacgccaatttctgatagtatggcgtataataagaaaaaataacaagtataacgataaatatttaagacaagggcttttaccgttgccatccgattgctattttttagtacattgtatttttttgattcttgaaaaagatggacaatgataactcgtcctacccataaaagtattaaaaataagacaaacgtaacgataattaaaagaaatttacttaaaagctgttgtgaaatttcgtgccaggataaatctgtaaaagctttttttaattgttccgtttgttttgatgtaagtgaagtggcaccagtgatcataataacctcctaaaaaatactaataaatattttaacagggaagacaagcttctgtcgactacactagattatcgtttttatttgttttatgatattcttagcattgaataaatattttgaaaactaaaggagggattatcagatgacttttggccagttggcagggttaattgcggcaatcgcattcttaatcttagtcatttttgcatgtatcctgttgaatcaattgagtaagacaatgaaagaaacaaataaaagtattacaactttaacgcgggatgttcattatcttagccaagaaatggaggacgtgctaagtaacacgaatacattgttagacgatattaaccataaatcagaacaactagatccggcggttaaagcggttgcagatgtaagtcagagtgtttcggaagtgaatgcctcacttcaagaaatggtcgagaaagcccggttgcaccgcgagaagcgacaatttgaccggagtatttttaaatttgcaggaaagacacttgttttcgatgctttcaacaaatttagacagcatcggaagcaaaagaaaggaatgacaaataatgagtaaaaaattacttgctgggatattattaggtggagtcgcaacatatgctgcatggaagaaaatggcgccggctaaaaaagaggcattgaaagaaagcgttgatgaaaagattaataaggttgctgattatgtgactgactataccttagacgcattagacattgtcgatgaccttatgagtgattctaacttgaatgataaggtgagcggcgctgcgggtgctgttaataatgttaagggtaagataaaagatagcgccaataaagtagttaatcatatgactaatgatgactttgataagcaaactgctgatattcgtgaggaattagcgaagaataaagaaacagatgaagataataacgatattattatcgatgctactagtgatcaaaagccagcatctactgaagacgatgaaacagatcaagatgacgctaatgcagccgataaataagtaaataaaaaagctgagaggtttctcagcttttttattttaatgagggaaagttagtaattctttagttgtatgcgtaaatggttcgcaaccatcttctgtaatatgaacacagtcttcaatccggacgccggcaaaacctggaatataaatgccaggttcaatggagaagcacattccaggttcaaaaactagctgatttccttccatgattgatggaaattcgtgttcactgctacccattccgtgcccgaggcggtgaataaagtattcgccataaccagctacagtaatgatatcacgagcgatcttatctaattcttcagcggtcattcccggcttcgcagcattttgagcggccaattgagcctctaaacataccttgtagatgtctttttgtttgtcatttaactttccgacagccactgttcgggaagcatcgctaatatagccatcaacaattgttcctaagtcaaagaggacgagctgattattttggatcttattactggaggtagctccatgaggttcggcagcatgaggacctgcttgaactagcgtatcaaaactcattttattaatcccatgttgtttaagagcgtattctaaatcggcagcaacttcttgttctgttttaccaatttgaattgcttcgaatcctactttaaaagcgaaatcagcccatttccctgcttcatttaacttagtaatctcatcatcgcttttaatcattcgcatttttgctattaaaggagagagatcagtattaaaatgggcattggggaggacttcttctaaggcacgaagacggtcaacagttagtgattctccctcaattccccagttaattggtgaaccagcatgatttttgatatgttcagcaataagctcaaaaggtttttcgtgatctaaatacccatataccggatatttccaaccagtatcctttattgcttctacttcaagcgctggtgcaaacagaaatggctcactgtcggcaaaaaggactagtgctaatacccgttctactggatcgctgtagaaactagttaggtaattaatggtcattggatcactaatataagcagcatctaatcccttttcagtaagagcgctttgtaattgattaagttttgtcactgcattcacttcctaaaaaagattgcgaatattataacatattgttatgacccgaaagtaaaaaaataatgaagaacgtttgctaattaaaactaaatctgctatattaactaggttatgaaaaaatatgaaaacagattataccaataaagaaagggctatcttatggaaaaacaatcagtaacaatttatacggttgcccgagaagctcgtgtctcaatggccactgtttcacgagtagtaaatggcaatccaaatgtaaaaccagaaactagacaaaaagttttagatgtaattaagcagcttaattatcgtcctaatgcagttgcacggggattagcttctaaaaagacaacgactgttggggtagttattcctaatataactgatccatactttgcggaattagcattggggattgatgatgttgcttcaatgtataagtacaatatcattttaactaattctgattctgatgatgaaaagatcctgaaagtggtgcggagcttgcttgctaaacaggttgatggacttatctttatgggtcatgatgtttctgatgatctgcgaaatgaatttgaaagcacaaatacaccagttgtagtagctggttctgttgttaatgatgatgctttaccaagcgttcggattaactaccaagcagccgccaaggaagcgacagaatttctgctaaaacatggtgatcaacaagttgcctatattactggtccattacgatactcaattaatggcgaagaccggctcaatggatataaagaagcattggcaaataataatgtgccatttaatgaattattagtaattgaaacggacgggtcttatcaggctggatatgcaaaggcacaagaagttatcgaaaagggattaaaggctgcttatgtaacagatgatagtttagctgctggtctcttaaacgggcttacggatgctgatattagcgttccagatgattttgaactaatttcttctaatgacaccaattatacaaaggttgtccggccaacaatcacttcgatcactcaacctctttatgatcttggtgccatttcaatgcggttgttgacaaaattaatggatggcgatgacagcaatgatgatgaaaaaaatgttattttagatcatggctttgttgaacgccaatcaactcgtaagtaggttgtgatttgttgtgacaacccgaagtgaattacgagcacaacgacaagaaaaagttgagaagccaatagaagaaacaccgaaaaagcatcattttctatactgcttatggggtgtaatctgtgtgactttactcgggctaacattactaattaattcgacacttttaaatgttaactttgtaaaagaagaagttacaaattcgtcgcttgaatcagttatgttaaaccaggttaacagtagtctaattcagtacgggatttcaacttctatcttaaagaaaagcgatactgataagctaattaaccaggcaattgatcaggtatatgcaggtgaaaaaattaatcttgacctatcacctatagttaataatgtgggcgcatctgttaattcccaattagctcaatatggtttgtctacttccatgttaccagcaggcagttcttcagcaattgctggtaacattaattcgatggttaacagtcagttaaatgctcccgaagttgcacagttaattaatgggattaaaattgctaaaacggttgttaatattattttagtgatttcaattatcagcctcgttatattgattcttaaggggttatggcagcatcacttaattggtagttttaggtggatttgtctgtggggaactattttatacacaggaatcgttatgactattcatgcgattgcccttcaaatgggtgcaggccaaccagacataagtccctttatttcccaggttgctaatgattttcagcagactggatttcacggttcaatgatgatgattgtcattagtattgtgttatttattctgcactttgtaaaacgaaaatggcaacctcgccaataaccttgaattaacgatgaatatttgctaaaatttatctgtttgtattacactaataaagaaaagaggagtcagtaatgtcaggacattcaaaatggcataacattcagggacgtaagaacgcccaagatgctaagcgtggtaagattttccaaaagatttcacgtgacttataccaagcagctaaagcaggtgatcctgatccagcgaacaacgctcaattacggcttgtaatcgataaggcacacgcggccaacatgcctaagaaaaatattgaccgtgctattgctaaagcttcaggtattggtggagctaagttcgaagaagttacttatgaaggttatggaccaggtggggtagcagtaatggtttctgctcttactgataacaagaaccggactgcatctgctgttcgttcagcatttagtcactctggcggttcattaggtgctagtggatcagtttcatacatgttcgaccgtaagggattaatcgaaattctccgtgatggtcttgataagagcgaagatgatatgttaatggatgctttagatgctggagctgaagatatgaaggcaactgaagaaaagttccaaatcttcacagatccaagtagcatgacagatgttcgtgatgctcttcaagaacaaggctacgaattagatactgctgaagttaccatgatccctcaaaaccggacagaggtacctgcagataaggcaaagcaataccgtcatttgattgatgaattaacagaaaacgatgatgttgctgatatttacgaaactggtattttaccagacgaagatgacgatgaagaataattcaatcattgttattaagaggttaaaaagcaaaacgctttttaacctcttttttagttttaaattttttagtgcatttttagaatttatccgtatttaaataatagggaggttaaaatatgccgagttttgaagaagaattagcaagaatgattcgcaagcaaccgagtgacctatatatcttacctcatgataggtattatcaattatccttagcgataagggggaccctattaccttttaaacaggttacgcgtgactatggtcaacgttttatctcatacttaaaatattgcgccaatatggcagttagtgagcatcgacgaccccagctaggcgcttttaaatttacttatgctcaccaaaagatcaatttacgcttatcaagtgttggtgattatcaagggagggaatcactagttattcgctttatatatcctcttaatgatattaggtttaattttttagttcctcatcagtgggaaagattacagaaataccgtcaacaacgaggtttaattctttttgccgggccaatgggggctggtaaaacaactaccatgtatcagcttgctcgacagctattgccgaaacaaattgtattaacaattgaagaccccgtagaaattgatcatccgggatttattcaattgcaagtaaatgaattagcggggatgaactatgaaagtttattaaaattgggattacggcatcgcccagatgtatttatcattggagaaattcgtgattcacagacagcagctatgtctgtccaggccgcattaagtggtcacttagttttgggaactatccatgctcgaaatgcttatggcgttgtttctcgccttcaacaattagggatagattcttattaccttcagcaagtattaacggcagtatcttatcagcgtttaattccgttggtgaatggagaacaagccatcttatgtgacctgttaaatcgacatcaatttagtggtttgcttagtggcaccaagaaaggaggaatatctgatgaatggtcaaaagctcttcagcaggctgtggaaaatggcgaaattacggagaatactgcacgtcaataccaacaaggttaaattcaatcatcagcaacaagcagattttttccttttattagcagatttattaagtgttggcttttctgtcaaagaagcacttggttttatcaaggctgtcaatccgaagctaggtccttggattgcttctatagataaacgaatgcaaaagggagcgagttttgcccagagcctgcagtcagaagtaaaagacgatttgttttatcaattactattagcagaaaagcatggtaatttaacaaaaacattgagtgaagtaggaaagatacttacagcacgagaacagcaacgaaaaaaattatttagtctcctgcaatatccgctaattcttttagggatgctaggggtggtgatttgtgggttaattttgtttgtttttccagaattgaaagtctggcaaggcgagaggcaaactttgccgctaattcacatgattacgttaggagcaacgtatctttttaccgttatctttattagcgctgtatttcaggggctaagatggcatcaaatgaataaggaacaacggctaattaagatctgtacaataccgatgatcggaaaatgctattgttattattttcaatattatttaactagtatattaggatcaatgttgcaacaaggattatcgttggctgaaatttgtgaaattacccagagctttgatagaaaatcaattctttatatttttggtaacaaaataatgactactattcaacatgatggagatatttcaaaagtggtggctacctactcttttcttcctaatgaattaattgtttttatgaataagggggcgaccagggaaaatatgggacgggacttaattgttttcgcgaatttaaaatttaaggcccttacaactgcaattgaacatttattgatttttgttcaaccagttatctttagcattattgcaatcataattgttattttatatcttagtatcttattgccaatctgtcattcattccaaggagtttattaatgaaaattttaaagaaaaaacaatcaggcttcaccttgctcgaaatgtcaatcgtcttatttattattagcctactagtattgattatgctgcccaatctctctcaacagcgaaagcatgctaatagtattcatggaaaagcgatgacatctgtaattcagacccaaattgatgcatatgaaaatgaaaatggaactgataatgtcagtttagaggaattgaataaagcaaattatctgactgatgcgcaggttcaacaggcccatcacgaaaaaattgtaattgttgatgggaaggcaattcagcgatgaattttcgtgaagaagggtttacgtttctcgaagcaattattgttttaggaataacggccctccttttactaattacgattccaaattttacaaaaacgcgtcaaaaactagctgaagaacaattttggcaatcattgcgtcaagattggcagtgggcgcaattaaagtgtgagagtaaacatcaatttgttgtaattcgccacgacaaaaataacgaaatgattacttttcgtataaatgatcaaacgagagagacaaaagaaatccttattccctcaacactgaatgttgagtggtttggtgaactttatcttacgccaaatggctatacgcgcccctgtacccagcgttttaaatcattaatcgatggtcactattactacatgaagattcaattaggatggggaggataccgaattgagaaacgctaaagtaaaagcatttatgatggcagatagtttaattagtttatttattgtagcgatggggataaatttattttttatttgcgaaaaacaattgtggttacaaaatagaaatcttcagctaaaaatggccgcaacgaggttaggaaaagaggctagtgatttatatgcggttaaaaagcaatcagttattttaagccgtggtgatttaaccgcaaaagcaacggtccaaagggtggttgtttataataataatcgatgcctttgtcgggttgaaagatgaagaagggggcctttactttaatagaagcgacttacgcgttaattatttcttcattagtgattatcaatataagtttagttactactagcatgagacaagtaggtaaaatgaacttagaatcaacgatcacttggcatttgtttttacgggaattagaatcagtcaatcatcgttttgaattaatggaggttcgtgataattggttattactgtacagtcagacaactgatcaaaagtatgaattaagagaaaaccatgctctatacctaacgtgtcagaataaaggtggttatatgccattgttagatagcattaagaatcatgaatactcgtttacgcaacttgattcccaacgcgtattgattaaggtgacaaggaaggatggagagaaagcaagtgcaattgttaagttttatccaccaaaataaaaaagagggttctattttatttgtaagtattgccgtcctacttataattagttcaattttattgtttcaatatcgatattatcaaaattatcaggaaatgggacgagatctttgttcaatttatattgataaaataaaagataatctaagaggtcaatgagagtgttatcttgaatttgctaggaataatagttaaactaataaggtaatgattgtattatttggaggcgactagcactgacacagaaaacaccacagcaattatttgagctttttgataaggccactgaaattttacaagcagcgttaaattgttcgtatttagatgcgctattagaaaacgcagaaaatattattgacaataatactgttcgtgttgatgaaggtgttcctgatgaaaaaactgtaaatgaattgcagaaaatataccaagaattaaatttacaaaatgtgaagccagaaattatccgacaaattatccagctgagttttttgaaagtaattcgaaaagatgcaattcaggctaatcatcaaatgactcctgatacaattggcttaatcatggctttcttaattgaaaaggttacaaaaatcaaggagattaagactgtttttgatccagccgttgggacagctaatttattaacgactgtgatgaatcagcttaaagtaaatggagataaagacatcgttggttacggaatagataatgacgaagatatgttgggagttgcgagtgtaaatacagaattacaacaccttaatgtaaagttgtaccatcaagatgctgtaactgctttagatatttctcaatgtgatttagctatttctgatttgccaattggttactatccgcttgatgaaaacgccaaaaactatcaaacacgggctaaagagggtcattcatatgttcaccatttgttgattgaacaatctatgaattatcttaagcccggtgcatttggggtattcttagtgcctagtagcttattccaaactaaagaatcacaatcatttgttaaatggattcagtctgttgcctatttacaaggacttatcaatttgccagcagaactttttgctaatccgaatgcgcaaaaatcaattttgttattgcagcgccaaggtggagatagcaaacaagcagttaaagttttgttgggtgagtttccttcatttaaggataaagcaaaatttgcttcattcatggatgatatcagtaaatgggtaacaacgaatttacgttaaaggagaaaagtcaatgtcaaaaacaattgcagttaacgctggtagttcaacacttaaattcaaattatttgatatgccaagtgaagaggtagtagctgaaggtacgattgaacgtattggtgaaaagatgggccatgctaagattaagtatggtaatggtcaaaagcatgaagaagataagccatttgttgatcatgctgccgcagttaattatttgttagataagttaattgaattaaagattgtggcaagctatgatgaaatcacagcagtaggtcaccgaattgttgccggtggagaattctttaaggattcaacaattattgatgatgatgttattagcaagattgatgaattgtcagaatatgctccactccatgagccggcagaattggttggtattaaagctttccgtaaagtattacctaatgcatttgcggttgctgtttttgatacatcattccatgttgatatgccagaaatgaatgcattgtacagtgtgccttatgattggtatgagaagtatggtgcgcgtaagtatggtgctcacggtaccagtcaccgttacgtatctgcacgtgctgcggaaatgttaggcaagccagttgaagaacttaaattaatcaccatgcatattggagcaggtgcatcaatcactgccgtaaagaatggtaagtcattcgatacgtcaatgggctttacgcctgttgctggaataacaatggcaactcggtcaggggatgttgatccatccttaattgcttttatgcagggtaaactaaacttatcctcagatgagatgattgatattttgaaccataagtctggtttgcttggtatttctggtatctccccagatatgcgtgatattcttgcagctgctgaaaagggtgacgaccgagcacaacttgcattagatatttatgttaaccgcattgtccgttacattggagcatatattgctgaaatgggtggcgcagatgccattgtcttcactgccggtgttggtgaaaacagtgttccagtacgaaagatgatcacagataagcttgactactttggcattaagattgatcaagaaaagaacgactgccatggtgttgaacgtgatctttctgctgatgatgcaaagattaagacattattaattccaactaacgaagaattaatgattgttcgtgatattgaacgtttaaagaaaaataactaagtactaaataattcgccaaaagctgactagttgacaagaaatgtttgtctctagtctctttttattttagaatttaagataactatattgcctttttaagaaagaagattctctatgaagttttgcacgtcagatactcatttttttcatgatagtctccttggtacaaataaatttgcaccaaggccattcaataatgtcaatgagatgaaccaaacgattattaataattggaacgataaggttggtgaaaatgatattgtttatcatttaggagacattgctctgtactttactaaacctcaacgaaatgcctatcaagcaatccttgaggtgttattacaattacatggacacttaatactgataaaaggcaatcatgataatcgggccctttttaaatatctagaaagtaataattatgagtttaatggacttcctaaatttcagtttcatgatgtgggagtactattaaaatataatcaccgtcagtattatttaactcattatcctcttatgttaggaatagcaccgcaaattattaaccttcatggccatattcaccactattctgttcccattaaagaaaatataaatgtaggcgtggatgctcccgaattagactatcttgaaaataagcctaaatttggagctccgctgaattttcatgaaatagaagaaatcgtagcgcaaaaagctatgaagtatccaggacaaaaataatcaaaagaaggtggaaaagatgaatagagctaagattcaagattatattgatcagcgtgaagagcaacgatctttaatctatcatattgaaaaaaaagaccagacacattttaccgttaatggacatccttacgaattagtaaaggactaccgtgacggttttaattcagaaaaattcgcagaacgatttagcagtgttctgagtaaatatgactatatcgttggggattggggatatgaccaattacgcttaaaaggtttttataatgatgataatcccttatttgaaccagaattgggtgctgatacgattgaggattatttatttgagtattgtaattttggctgtgcgtattttatccttcacaatgatgatgtttgtattccacggcacagttaccgtcagcgtcgaaagaaaactacgccagtcattcatgaacggcgacggcaggttaaacaaccgaacgtgcgtcaacggcataatcagcgtgcagaacgtgtaaaaaacggtcatcggcaaaaatttgtgattcatcaacgaaaaaagaggagctaaggcaaacgatgaaagattatcaaggatattttattgatttagatgggacgacttataagggcaaaaagcaaattccagcagccggaagatttatcaaacgactacaagatgtcaagaaagaggtcttgtttgtaacaaataatagtaccagaacgccagattttgtcgctgaaaacctccgtgaaaatcataatattaatgttacggcggaaaatatatacacaacagcaatcgcaactgctgactatttacggtcaatggcgccgataaaaagtaaaatttatgttattggtgagtcaggattaaagttggctttagaaaagcgagggtttatcttgactgatgatcaacctgaatatgttgttgtaggattagatacgaatgttacttatgagaagcttgaaaaggcagtcttgttaattcgaaatggcgctaaatttattgggaccaatgctgatagtaatttgcctaatgaacgagggatggttcctggagcaggttcgattgtaaagctagtagaatatgcaactcaagtgaaacctgtgatgattggtaaaccagaagcaataattatgaaaatggcacttgaaagagttaaattgcctaaagaaagggtaattatggtcggcgataactatcatactgatattgaagcagcaattaatgttggaatggatagtttattagtttatactggtttatcgcgtccagaagaagttataaaagaaaaaatccagccaacatataaggtgaataatcttgatgaatgggaaatttgaatttattcagtggggaagagcaatcttattgacactacttagtttagttgttgcaattagtattgctctttttatcgttattaatatctcacctttttttataacaattcctaagcacctcctaggattatctgcctctgaattaatagctgattatggaagtgtcattaaatatatccagcttccggcccagcgagtcctcgaactaagatatttaccaattgccccttctgcagttcaccattttgaagacgtaaaacatttgattttattgaatgaagctgtgatggtggtttcgctcccgttgttagtgtttggattgaaaaaacaaaaacggcaaaatcagctctggcgcctgattttaccgtttcagatgttatttattttattgctctttagtgggtttatggggataacaaatttcgatgtcctttttattaaatttcattatcttttctttagcaatatggattggctatttgatccacgaacaacgccaatcatattgttgatgcctgaaaatttttttacagtactatttggattatggttaggatttatattgataatcttacttttgatctggggatggataaagcttatgttaagcatcttctttaacaaaacgcgaacgtaatgctccgacaacggctgggattaacgtaaccacaataattgcaagaatgatgacagagaagtgttcttgaacaaacggaagattaccgaagaagtaaccacatccacaacaaagtgctacccagataacacagccaattacactataacgaataaattgcttgtaggggaaaccagaacctgctgccgcaaatggagcaaatgttctgatgatcggaataaaacgggcgagaataatagccggcgcaccatgcttttcaaagaagacttcggcacgttctagactatctttatcaattaatttaccaaaaagtgagtggttagaaaggctcttcccaatcttatgaccaattaaaaagttaagggagtctccacccaaacaggcgcataagaaaataaaaataaaaatccaaatattaagatgataacgtgggtcagcagctagtgcacttgcagcaaagagaagggaatctccaggtagaaatggcattatgactgcaccagtttcaataaatataatagcgaataaaattaaataagttgcatcgccgaattgattaacaatctgaattagatgaacatcaatgtgtaatataaaatcaataagagttgccaaagtaattctcctttgtgtaataagataatactgttaaagtgtagcaagatagaaaaatgttgtgaaggggcgtttaaaacttttaataatttttgaaaaatatatttattgtaagtataaattagttgtgtgagactagttcattcatagtcaatgacgaaaggatcattgcaccctttttgaaaaggctgaataacgtttattatcataagaatggtaaagcaaacgaaaaaaataaataaaaatcaaaaaaagtgttgacgagggagtgaaatccatgtatagtagttatcgttgtcaaagcagttaagtgctgttgagatggttaacaaaaagttaaaaataattgttgacatctacttgatgacatgatatattaataaagttgctgattgagttatcaatcaaaagaaattcaaaattaattaaaatttcttcttgacaagctaatctaatatatgttataataaccatgttgattggctgcttgattggccaacaggtagacctttgaaaactgaacaaagtttcgacgaatcaaatgtgtagggtcttcaatcacgatgtgatttgaagcaaaacatttgcgaagtcaattcgcttaacaataaagataattgagagctattcaagttcttatatattttatatgagagtttgatcctggctcaggatgaacgccggcggtgtgcctaatacatgcaagtcgtacgcactggcccaactgattgatggtgcttgcacctgattgatgatggatcaccagtgagtggcgaacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggcaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttacttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgtaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcggagaaactttgtttagttttgagaggtttacctcttaaaactttaacctataagacgcttatttgggcctatagctcagctggtttagagcgcacgcctgataagcgtgaggtcgatggttcaagtccatttaggcccatatggggaattagctcagctgggagagcacctgctttgcaagcaggaggtcatcggttcgattccgttattctccattatcaaccataaggttgatagagtttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccattgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgcgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatgaagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgtacccatgccgaacacagaagttaagcttcaacacgccgaaagtagttgggggatcgctccctgcgaggataggacgttgccacgcttatggaggattagctcagttgggagagcatctgccttacaagcaggaggtcacaggttcgagccctgtatcctccattgagcgattaagctcatgagccgttagctcagttggtagagcatctgacttttaatcagagggtcgacggttcaagcccgtcacggctcattatcagaaattttatctgataataaaaaaacaaagtgtcaattgccgacttagctcagttggcagagcacctgtcttgtaaacagggggtcggaggttcgaatcctctagtcggcactttcatatgcggaagtagttcagtggtagaacatcaccttgccatggtgggggtcgcgggttcgaatcccgtcttccgctttgccagttctataatgccggggtggcggaattggcagacgcacaggacttaaaatcctgcggttagtgataaccgtaccggttcgatcccggtcctcggcacttattatgcacccatagcgcaattggatagagtgtctgactacgaatcagaaggttgaaggttcgactccttctgggtgcattttttcgggaaatagctcagcttggtagagcacctggtttgggaccagggggtcgcaggttcgaatcctgttttcccgatttataaaattaatatattattagttttttcgcggtgtagctcagctggctagagcgtccggttcatacccgggaggtcgagggttcgatcccccccgccgcgattggctggctgttttggacctttagctcagttggttagagcaagcggctcataaccgcccggtcgtaggttcgagtcctacaaggtccatcagagattagctttgatgaatcattattgtttaatcttattagttcattatggaggattacccaagtggctgaagggggcggtcttgaaaaccgctaggccgtgagagcgacgcgagggttcgaatccctcatcctccttatattatcgcggggtagagcagtctggtagctcgtcgggctcataacccggaggtcgttggttcaaacccagcccccgcaattttggtccgttggtctagttggtttaggacgcatccctgtcacggatgagatcacgagttcgagtctcgtacggaccgtttatatttggctcggtagctcagttggtagagcaacggattgaagctccgtgtgtcggcggttcgattccgtcccgcgccattaacttaatattatgcgggtatagtttagtggtaaaaccacagccttccaagctgttgtcgcgagttcgattctcgttacccgcttagatatgggcctatagctcagctggtttagagcgcacgcctgataagcgtgaggtcgatggttcaagtccatttaggcccattggagaagtactcaagtggctgaagaggcgcccctgctaagggtgtagatcgcgcaagcggtgcgagggttcgaatccctccttctccgtaatgacccgttagtcaagtggttaagacaccagcctttcacgctggtatcgtgggttcaaatcccgcacgggtcatctttattatcgcggggtagagcagtctggtagctcgtcgggctcataacccggaggtcgttggttcaaacccagcccccgcaattttggtccgttggtctagttggtttaggacgcatccctgtcacggatgagatcacgagttcgagtctcgtacggaccgtataattaatgataaataaaaactttctacggataggtgggaagtttttttgttagtaaaaggtaaacagttaataaaatacgaattaaaaaggctctacaatatcgtaagcagtcaataacagtacgtctagctctagctaccccggatcttctatactgagactatcatcagtaaggagattttttatttatgacagaacaaaatgaaattattaccccagttttcaaaaacaagccaagtaatttacaaaagcattcttttacggcacgccctgccgtaaaaattaatgtgaatgaagtcgaattaacgattttcaaggggactaattctgttttagcttcggatatcgttaaagtggttattcgttatgctcgttaattggcatgacccagattatatctatttagtctgtggaaaaacagacatgcgaaaaggtattgatgggctcgcaatggtaatcgctgagaactatggattagaattatataataattcgcttttcttattttgcggcggacgtaataatcgctttaaaggattgttttgggatggcgagggctttattatgctctataaacggtttgaaaatggccaccttagttggccgagaaacagtaatgaagccaaagaattatctgatcaacagctcgactggttattgcaaggactgaacccattaccaattcgtaaaattcaagctgttcgaccgggaagtttttattgagttacctctatttaaaagaagaattctttgatataattaccaaagaataattcaaaggaggtgacgtaccatgaagcaaacagcggaagaacaaatcaaagaacttaaacaacaattagctatggtcaatgaaaagattgctcaattaatagctattatcaaacttcaaaagaaccaaatatttgggaaaaagactgaagtaatggagcccgtcgttgatggacaacaatccttatttagtgagcaagaaatggatcaacttcaagatcctgatatttcagtcacggaagtgactgaaaagaaaataaagcaagtggtgcgtcaccggaaagcaaagcaatctggtcagcggaccacttttttagatggtttaccacagattgaagaagttattccattcgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttagagcgtaccgagtggcccaaatgatcaaccgtagcgccgaaaccgtttatcgcgtttatcgttacctggaaaccggtgcctcaattgctgattatcaagatcactatatgcgcaataagcaacgttgtggccgaaaacgtactcagttgtcactggctgaactcacttatatcaacgacaaaattgcccaggggtggacgcctgataccattattgggcgcgctgagcgcccaattagttgtagcctgcgaactctttaccggatgtttgaacgtggccagttcggcttcgatgtccgttccttgccgatgcgaggtaagcggcacccgaatggctatgtcgagcgccgcgggaaggctggccaattggggcgaagtattcacgagcgtgccaaggactttccgcactatgccactgaatttgggcaccttgaagctgataccgtccaaggtaaaaagcaccaaggggcggtaatgaccctgaccgaacgcaatcgaaggtcgaaattgtactcaatgtgcacgaaaagacggctgatgcgattaaccaacacttaggtcagtggcttcgtaaatttccgtggcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgccgggacggcttaacaaaacggctaaatttccgcaatcttcccgatgaattggtgacccaactgatgagtaagcgaaataacctgccccgcaaatcactaggctatcgaactccatatgaggtattcatgtcctacgtcactgatgagcaactactttctttctaacttaaattgacatttcgggataaaaaatttggcatggaatctctatccataccagaaagtgtataccctaaaaaacaggactatgaattaccaaaaatgataattcatagtcctgttgtaggtatcagttaaataccattggcaaataccctacgttatctacttattaaaaaatgggtttgtaaatctcatcataataactattatctgaccccatactagtaaagttctttaaggatgtgaaagtatcgctttccttccatgcagttaaggcttcaaaatcggcccaagcagttagtaaaactaaagtagtagcttccgctttattatcaacgctaagcatataaccaccgttcatattagctggttcagttaataccttttgaagtgtattataaagtagcttttgacggtcaccgtttacttgaaatgattggtagtaaaacattccatttaattgagcatctagcgttgaatcaagagttgttaattttactggtgactgaaaaatagtatcttttccagaaagatcaaataatgctaattttcttgtatgagtagttgcctgcattaatttaaaatgacgttcgggatatttatcaatgattgattgtaaaatttgtcgtgaaccaaatgttaagctaatttttgttaacatattaatccctcctcagaagttagtagtcatacttattatagtacaacttaatgtaaaataattaaattgtaaattttatctactttatttttgataagacataaatggaaaatctaatatcaatagaacttacaaaaagtcaataatttttgttatatcgctttaatattaattgaatagggagtataataaacaatgtattaatgaatgttctagtttaacttaataaaggaggccactaaacgaaatggttacactatatacgtctccaagttgcacgtcttgtcgtaaagcacgtgcctggctaaaagaacatgatattgcttttaaggaacggaatattttttctgaaccattgtctttaaatgaaatcaagaatattttacggatgactgaagatggtactgaagacattatttcaaagcggtctaaagcttaccagaagttgagcatagatctcaatgatttgtcgatgaaggatctgtttaagttaattagtaaaaatccaggattgttacgacgtccgattattattgatgataaacggcttcaagtaggttacaacgaagacgaaatccgtcgcttcttaccacgaaaggttcgtgaactagaactagtagaggctcaagaaaaagcaaatatgatttaactgatagaatatggaaagtattatgctttcctttttttattcttttaaccgagtaactttacttttaagcgaaaatccttacaatagaagtaacatctagttttggtaaaaggaggtgctgctcaatggagatggaacgcattaatgaaaatactattcgcgttttggtagataatgatgatttatctgctcggggtatcaccattctagatttgctaggtgaccatcagcaaatagaggatttcttttatagtatcctgaaagaagtagatactgatcgccaattccaaaataacgatgcggttacttttcaggtgatgcccactaataatggcttagaattatttattagtaaaaatgattctaattttgctgggaatgaacagcatggaccgattaatgaccaggtgtccaaatatattaagcaacatttgattcaaaaaaatagtcaagatcaagatcaaaggaaaacagcgattaatgattcagaagataatgagattcagcacacgaactggcaagtaattacgtttgattcttttgaagatttaattgattttgcgaaaattgccgataatgatgatgtttcatcatatttatataagtacaatgatttgtattatttagcaattgcttattctgattctattttgaacagtaatgatgttaaagatcagcttgctcttgcttatgaatatggaaatcccacggcaacaacggttgattttttaagtgaacatggaaagaaaataatgtcagtatctgccttgcatttaattcgacactattttgaataagctgcgtttgagttcatactcaacgtagttttttttcgtgcaaaattgagtaatttccgtatataaatatatagggggattaaatgttaattgcagttcataacgatcaattagtgttggctgaaaacgcaaaaagcgatatggcatattattgtccaggatgcgggcagggagtgatcttgcggcgaggaaagcataagattactcattatgcccataagaagggaaatgactgtggctttagcgagggtgaaacattagaacatttaaaagggaaagaacagatttatcaatgggcacaaaagcatcattggaatccgcaattagaagtctattttccaacaattactcaacgaccggatattcttttagaaattaatggacaaactgtagcagttgaatttcaatgtagtcccttaagccttgaaaagttattagcacgtaatgaagggtatcgtcagttaagaattccggtttggtggatattaggatcgccttatttgcgtaacttgggaaataagaaaatcgttcagtttacgcaaatctttagaaggcagtttgttctcttgttttgggatgtgaaaagggcgcaattagttattgatcagaaatattggcgttgctcctatagccggttaaagtatgataaaaaaactattttaatggagcagattgaaatgttaaagaagaaacagtatcattttccaaataaagaaataagaaaactatcattaactgctttaaaacttactggacatgctttatctgaatgtccactagtatgccatgatctcattgcaagctggccggcaatgtctattccaatgattatctggcgaattggtgtaatattagagatagagaaattccctttattttattcttggagagataaggaatggaaaagattattaatgaaggtaaacaaaagcaattggttattccctggttgtttacctccagaaacaatccgcaatattattatcaaccaatatacaaacgaattaattgcctttaaagtaatttgtagaagggataatcatcttattttaattcatcgtccaagatggtttaatgattcacagttaaaactacagctggttaaaaggagatcatagtatgcaacacacatgtacaatgtttttagcaggaaagaatgcaacgattgacgggtcaactatagtttgtcgtgaggaagattatagtaatgcatttgatcctcaaagatttgtattagtaaaaccagaaagacagccacgtaaatatcaaagcaaaacaactgactttaaaattgatttaccagttcctaagctaaaatatacttctacgcctgatgctgacgataaagatggaatttttggtgcgggcggtatcaatggtctgaatgttgcgatgagtgcgactgaaactattactactaatgcccggatattagcaatagatccttataacaccttatcgggaattggcgaagaagattttgtaacattagtccttccttatattaagagtgctcaagatggtgttaagaaactaggaagtttattagaaaagtatggcacttatgaggctaatgcgatagcttttagtgataataatgaagtgtggtatatggaaacgattggcggtcatcattgggtagctgttaaaattcccgacaatgcctatgtgattgcccctaatcgatttaatattactaattttgattttgatagtcccaacacaatgagttcaccaaatttgaaacagtggattgatcaaaataagttgaatcctagcgaagacgaatacaatttacgacatatttgtggaagtgcaactgctactgatactatctataacaacccacgagcatggtatgttcagcagcaactagggacgataaatgctaacccgcaaagtaataaccttccattcatctgttatgcaaaagaaaagcttactgtaactacgattaagaagttaatgagttctcattatcaagggacagcttttgatccgtatcatttagaaagagataaagctccatttaggtcaattgcactaaaccgaaacttagaattacatattctacaaatacgtaataatgttcctgcaagtattgctggtgttcattggttagcatttggtcctaatacttttaatgcagtggttcccttttatgcaaatattgacgatacaccaatcccttatcgaaacactagtactgaatattcaatagacgatatgtattggctcactcatacaattgctgcgcttggggaccaaaattatcgtcaagcacagaatattgaagaaaactttgaattgcaagtaatggcaaaaacaatgaatgttcaaaataatacggataaggaaatagcagaacatcaggatgtgagtgcatttttaaccacaattaataatcggatggccgaaaccgcagtggacgaaagcaaaaaattactagggaaactagtaaagcttgctttttcaagagaacgattacaattctaggcagaaaataaaaaaagaggttggatagatggtgcaataatgaaaggccaacttttccaatctcttttttattaattattgttttgtataatttgtagctttggcggacgatattggttcacaaattcatctaaggatgcagatcgagccaattttccgcttttaaatgcgtttattaaagtattatagtcaaaatttggaatcattaggccgtaatcagaatcttcggtgttaaaaacgactgcggtagccgtttctgatacgcctagatcacttgcgattttttgatcttgacggaaagcctgcttagcaagttgactttgccgatcctcaaaaaacatttctaagtcaaggtgtgaaccatgtgcaattttattaattaattcatcgttgtaatccaagccttggttaataagcgcagattgtaattgtaagagataatgccgtccacgttttcgtccttggaagagggctgctttataatctagtattatttggttaagggtttttgatacttgttgtcttgcagcaagatcatggggattaagatgataatatttaagtgtgctatcgatcgttttcatattgaatagtggtacaaactgataactaatttttgtatttaaatcacgatcaatttttaacacgtctttttcacaccgtaaacagcgcattcctaatggattcacaaaaagatgaagttcgagcataattaacccctccgatcatttgtatactcaaaatcctaatcctgtgaacataattatttttgcaaatatctaactatttgtaaagaatttagttttaagagttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacactacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaagtgcacatggtgaatactttctcgaccgctatcattgtttgcagaaaattgaacatactttaggccggcacaacgaattagccatgcgagcaattaaagccgttcgtcatcatgatcaagcagagctaacaataattttagatacttatgaatcacaaaacctaacggaaaaacaagcagatgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatataatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagatacgttttaagataattacaagagttattattataaatgtgctaaaatatacggagatttaacaggaggctgaattatgattgaagattggcagcattttttattgccatatcaacaagccgtaaatgaactaaaagtcaaattacgggggatgcgaaagcaatttcaagaccaaacgcaacattctccgattgaatttgtaactggacgagtaaagccagttgatagtattaaagaaaaaatgattagacgacatgtgcaagaggatcgacttgagcaagatatgcaagatattgccggtttacgaatcatgtgtcaatttgtagaagatatttataaggtagttgacttattacggcagcgaagtgatatgactattttagaagaacgagattacgtcaccaatgttaaaccgagtggatatcgttcctatcatattgttattgaatatccggtgcaattaattactggagaaaaaagaatattagctgaaattcaagtacgtacccttgcaatgaacttttgggcaacagtagaacattccttaaattataaatatcaaggtgagtttcctgaggagctatctgcaaggttgcaaagagccgcagaggcagcatttaagcttgataatgaaatgtcagagattcgagaagaaataaaggaagcacagacattgttttctaagcggaggtcaactaattctattgatgaggacgagttaaaggagtaaattatgagaattggaatatataataatgaaacagcagaatctcaacgagtgacaaaggttttaaaggctgaaatgaaacgggcgggtttaacttatgtcgaaaaaaatccagaagttgtaataacaatcggtggagatggtactttgttatcggcttttcatcattatcaaaaagacttaaataacattcgctttgttggaattcatactgggcacttaggattttatacggattggcggagttttgaaattgatgatttagttgatagtttagtaaaagatagcggacaggcagtttcgtatcctctacttgctatgaaggctacttattctgatgggcagatagagaattatattgcacttaatgaatcaacaattcggaatgttacacgaacaatggtatgtgatgtgttcattaataatcatttgtttgaaaactttcggggggatggtttatgtatttcaactccaaccggttcaactgcttataataaatcagtcgggggtgccattgtcgatccaaatagtgttggctttcagttagcagaaatggcttcacttaacaaccgggttttccggacactaggctcaccgattatttttggcgctgatgctgagttaattttgcgtttgcgtgatgaaaatgggcatgtgcttacatgcgatcgtgatcaatggatgcttaaaagtgagaaggagcggtacctaactgaattatcttatagagtttctaagcaacgaatatattttgctcaatatcggcataataatttctggaatcgagtaaaagattcatttattggtggagtgcattaatggaatttaattggatatatgatcatcgcacaccacggaaattacgatcggcattaaaaatgtatggggtttcttcttcgttattaaaagtagccatataccatggaggaaaaatgcaaataaatggggtagataagtgggcagttgatactgttaattaccacgataaagtaacattaattctccctccggaaactgctaatgataatgtggatatcagtgaggcacctatcgatattatttatgaagatcaagactttttaataatgaataaaccggcaggagtagcgacagttccggctcataacgttccggtagccgatagtttggtgaatcgggtaaaaggctactataagcgccaaaattatgaaaatcaggttacccatgttgcgacacgtttagaccgtgacaccagcggcttagttgtttttcctaaacaccgatttgcccatgctgtcctagatgaacagttaaaaaaacatttagttaagaaaaactatcttgctctaattaaaggaaaagttcctgcagagcatggttatattgatgcgccgattcaacgcgatcccagttcatttgtaaaaagaatggtagggaaagaagggaaagcatctgtaactgaatactggcgccaagaatgtaatgttcaagcaagccttatcaaaattaggttgcatacagggcggacacaccaaattcgcgttcattttgctagccttggtttcccattaattggcgataaaatgtatggtgaagaatcaggattaattgctagacaagcactccattgttattggctgagcttttatagtccatttaaaggtgaaaatattactgttttggcaccattgccaagtgatttcaaaaacgctaaagatgatcttttaagtgcaaaagaatattagtaattgaattaattagtagaaaattaccagaagataaaattaatttacttactggtaatttttataaaaaaggtattgcaaataataaaaatatagggtaaaatgtaactattgtcatcgaaaagatgtgaataaatgatcatatctattaaaattattaagagtaaacatggttgtaaagtcactaattcttgaaatgattttctgaaaaactattgacatccacttgatgacatgatatattaataaagttgctgattgagttatcgatcaaaaggaattcaaaattaattaaattttcttcttgacaagctgatctgatgtatgttataataatcgtgttgattggctgcttgattagccaacgggtagacctttgaaaactgaacaaagtttcgacgaatcaaatgtgtagggtcttcattcacgatgtgatttgaagtaaaacatttgcgaagtcaattcgcttaataacaaagataatttagagctattcaagttcttgtatgttttatatgagagtttgatcctggctcaggatgaacgccggcggtgtgcctaatacatgcaagtcgtacgcactggcccaactgattgatggtgcttgcaccggattgacgatggatcaccagtgagtggcggacgggtgagtaacacgtaggtaacctgccccagagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcatgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcggagaaactttgtttagttttgagaggtttacctcttaaaactttaacctataagacgcttatttgggcctatagctcagctggtttagagcgcacgcctgataagcgtgaggtcgatggttcaagtccatttaggcccatatggggaattagctcagctgggagagcacctgctttgcaagcaggaggtcatcggttcgattccgttattctccattatcaaccataaggttgatagagtttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagatgaaacgtcacactctctgttcaggatcctgagtacggcgggacacgtgaaaccccgtcggaatccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtgggaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccattgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggaggaacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacagaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatgaagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgttcccatgccgaacacagaagttaagcttcaacacgccgaaagtagttgggggatcgctccctgcgaggataggacgttgccacgctatagtaaaaggacatgcattgtttaatacagtgcatgtccttttttagtacgcccagcatggatattaactatgagttgaaaggtaagcagtgtaagcagtccatattgacacgttattgacagacaaaaaatccccgtagaaccgtccttgatggcttcacggggattttctattcgcaacattctttttgtacgttttttgaccacggcaaaaaagctgccagatcttgacaattgctctctggtaggtgatcaaacaagtattctaagtaccgctggacgttaagctggtttagtttagctgtctctactaagctatagtagacggcgttcgtcttggcaccttcttcggtttttgcgaatagacaattctttcgaattagtgttgatggccgaatactttgctcaactgaattgttgcttaacggtaattgtccattttcaaatacacgatacactcgtgattttaactggatggcgttctgaattgccttacgcaactgtccaatcggctggctaatctggctaatgtaattgtaaaatttatccattagcggtttgacatggatttgccgctgcactaacttctcattggccgtttgataactcaactggttttccgaatggaaaacctgactaagaagagttattgcttgttgcgctttggacgccttcattgtttttggcagtgctttgaccaatttgacaaattctcgtcgaatatgcactaagcacgaaccaaattttgcttgcggatagagttgattactataccctttatacccatcgcacatgataatacccggataattattaccgactatttgtccaatgattctaccagaacgcgtattggcatgatgaaagactacaaccggatgttgggcaaactctttcgttgtccgcgttacccagaaatagtcttgggatttaggactatcaacgactttaaaaggtgtttcatccatatgaatgactggttcttgtctaactgtattgcttaaatactgatacaacggctctaagtacgtttgactaactttaataatattcgaggccatttgcttggcgctaacaggtaatcccaacccttgtacaaagctttcttgccgatggaaaggcaacgccagattaaattttaaataggcgataaatgccataatactgcttgaaaagtaactatgtggtaataaagccattggtgccttactagttaccaatttatcatttccatcttgactacagtgtttacacttatagctttcctcatataagttggcacaatacaattcaggctcttttagtctagcttcccgtcgtgccaacctctttccaatgtgagccatttcgtgctgacaatctggacaggtggtcgtttttaaagaaacaacttcctcgacttgaggaagttggtctaaaaactcttgacgagttagctgtttcttcgctggtcgatgacgtacgatcttagtcgttgttgttttaactgcttcagtaatctcttgatccaagttcagatcatcaactggatcaaacagtgataattgtccatcagctacctgctctaaaacttcagtttttttccaaaaattatttcctgtagttgcttaatcgtaattgcttgttgttcaagttgttcttgagctttcttcaactgcgcacgtagtgcttcgttttctttctttaatgactcagccattgtacgtcacctccaatctaataaacttttgttattatatcagagctaaaacagtttaaaaagagcttagtatagatttcctggtttaattgtatgaatatgtcgctcgggaaatggggatagacctgtaaataaggcatttagttgctctggctttagttctttaacttcacttttgttcttaggccatcttaaactaccattttcatatcttttatatagcagaatgaaaccttcatcatcccaataaagggctttgaaccgatcattgcgactaccacaaaataaaaagagcgaattattatataaatccaatccaaagttttccgcaactaccatcgctaaaccgtcaattcctttacggaggtctgtcttaccacaaacaaggtaaacatgctccggtgcctgccaattaatgagcataacgaataaccactttagctatatcagtcgcaagactgggattagctcccttaaagatcgttaattcaatgttatcagcttgtagttttgcggtgggtcgaggaataaattcttccttattaactactgaattcttggtcttaaaaattggtgctacaatatcgtgttttccttccatagaaaaagcctcctgtactaagattgcttttagtataggagactaagtttttgatggctagacgtgtggatacggactgcttacgaaaaattaggcagcttaacaccggtacaataccggcatcaagctgcctaagaaactttgtataatttattgtctacttgacagggtccagttcacgctgttgatattaatttatttccacttcattacacacactggttctggacaactaacatctttttgaaggagagttaacttaccagttgatggatttcgtttataaagagtaaggttatcagagttctgatttgaagctaaaagataattttcatcttgatttagattgaaatcacgtggaaaatctccttcagttgaaatagattggatatgtttaacggtaaaatctggttgaacttcaaagacggcaatagtgttttcaccacgatttgatgtatagacaaatttcccatcatttgaaatccggatagcagctgctccattgtgagctgtccagtcttcaggaattgttttgagcgtttgaaggtgcttaaatgatgcatccttactattatacttgagtacttctagtttactgcttagttcacccaaaagataagcataattgccatttggatggaaaactatatgacgggtaccaaagccatcttcacacttatagcgagaaacagcagttaatttaccatcatcagagacatcgtaaaccacaacaagatccattcctaagtcacatacaactagacgattatcaggagttagatcggcataatgaacatgtggagcctcttgttcaggttcaggaccagttgctccttcatgaaggacagaatcagtttgtgttaacgttccatcttcgttgatcttaaaaacatctatttttgctgtatgataattagcactgaataataaatgccgtttgttatcaacgcctacatatgcaggaggagcaccggcagctaagacatcgcttagcatcttagcgttatcgtcatttaatgagtaagaagcaacgccccccttgtcatctacttgtttgattgcgtaaatacgaccatcttgaccaacttgtaagtaagctggtttttgagatggaattgctaattcaacgttcgttattttttcttggtcagtatcgagggtaactttgtagatccctttacttgtttttttagtataagttccaattagaaattgttcaatcaaggcaatttcctcctttttgaaaatgcttacctatataatagcaatttgcccatcgtaattctagctgtgatacactgttattagtaatttttagttgttaatggaggaaaaaagttgaaaaaagttgaacgtcaacgagaaatggtaaaaaataatcttgccctttttcaatgccctgtttgtgaacagccaatggatagagttgaaggaaatagtattatttgcggaaataaccaccgatttgactttaatcggcatggttatcttcactttcttaatggagcggctaatactgaatatgattgctcaatgtttgaatctcgtcgtcagctattaaatgcaggactatttaagccaattattgaaaatatcagtaaattcttaccttcaaaatctttaaggatcttagatgtaggaactggggaaggaacaccattattacaattagaaacaatccgtgctaactgtaatgatacgatgattggctttgatatttcgaaaccagggataacgcttgctactcagttaccgttaaaggcatttttttgtgtagctgatttacgtaaattaccttttaatgatgagagttttgattgtatattagagttgttttctccatcttattatcaagagtttaaacgggttctaacaaaagatgggacccttattaaggtaattcctaacgctaactacttagtcgaattacgtcacctcttatatgaaacaggagaacgtaattaccactatgataattcacgagtaatcgagttatttaaccggcattatcctcatagtaaagttgaaacggtaacctaccaatttagaattccagacggtttacaacaggcaatgctggaaatgacgcctttacactggggagcaaacgctaaaagattatctaaagaagaattaacccaattaaaaacaattacggtggatgtcagcttattaattgcgaaaaaagctaattaattattgcaacattactaaattagtgctaaattattataggaaatcgtttgataattgacatcgaatataagtgtttcgttggtaattatcaaggagtacttcattaaagcagcgtttcgccgtgcccacaccgagaccctgctttttttattttattaaggagattttattatgacaaaccatattgtcttgtttgaaccattgtttccagcaaatacaggaaatattgcacgaacttgtgcgggaacaaatactgaattacatttaattaagccattaggattttcaactgatgataagcatatgaaacgggctggattagactactgggataaagtaaagatcacgtatcatgaggatttaccttcatttatgaagactattcctgatattaaccgtttatatattgtttctaagtttgccactcatgattatagtgatgttgattatacgggtgaaggagatcattatttcctatttggaaaagaaacaactggcttgcccgaacgttttatgcaaaaatatccagaaaatgctatccggattccacaaaatgataataatattcgggccctgaatttatcgaatagtgcagcgattgttatttatgaggtattgcggcaacagagttttcctaatttagcccgcgttcataaatatgaattcgataaattaaagtaaccttaaggaggcaataatgcgatggcgagaagaaaaaaggcatcatcccgccggacaagagggaaaaaacaacagtatcgattaatggataatctattaggaataattgtttgcctcttaatgttagttggcttatttaatttaggagcattaggaacctttctcgataactgttttaagatttttgtagggtcatcctttccaattgcaatgattattgtttttctttatggattatgttttgcattgtatgggcatcgtccgcatttcaaaaaacgttggattgcaggaactattattgcctatattggtttattaatgtggcttcagacagtaatgtttcagcgtctgaatcttcatgcaaaggtaatcaaaactacttggaatagtcttagtaaggtcatttttaacggtgattcaactgttccggttggtggagggatgattggtgcttacctatataatggaagtaatattttaatttcagaagttggaacagcggtattgtcatggttgttaatgattatcggaattattgtcttttttgcattaccatggcgcgaatttctagtaaaatgtgggattggcattaaaaaatctggagcagccatggctaatgctcacgatcaattaatgaaaaagagaacggagagagcaaccaagacaactacggtaccatcgattagcgtgccccttgctaaagcatcaaggcaggttaaagatttttttgctgaccaagaatcagcagagccaacgtcaacgccgccagtttctccagcgatgcctgctcaagatcctgttgaaccaactattagggtcgcaggtgaaagtcaggtggaagaaactcagagtggacgtaaggatgatcaggactcgaaccaacgtgatgatgcggaaattaaacttgcaggaattgacgctaaagaagacaatgattatcaattgccgccagtcagcctgctaagtcaagtaaaagcaacagatcagcaggaagatttgaataatatcaaaaagaacaccaaaacgctccaacaaactctaaaatcttttggtgtggatgcaacagttgaaaatgttaatttaggtccttccgttaccaaatatgagttacgcccagcagtaggagtaaaggttagtcgaataacccatttggctgatgatttggcacttgcacttgcggctaaagatatccggattgaagcgccgatcccagggaaatcattaattgggattgaagttccgaaccagcaaattgcaacagttggttttcgcgatatggtcgaaaatgctcctagtaatgataatcccatggaagttccgcttggtcgcagtgtcactggggatatcaaaatggctgatctaactaagatgccacaccttcttatcgctggggcaactggtagtggtaagtctgttgcaatcaatgttatcattacaagcattttattaaaggctaaaccgcatcaggtaaagatgttaatgattgaccctaaaaaagtcgaattgagtgtttataatggtattccccatctactcagtccggtagtttctgaacccaaaaaagcagctcgggcattaggaaaagttgttgcagaaatggagcgtcgttatgaattgtttgcaaaattcggtgttcgtaacttggatggatataataagttggtcaaacaacaaaatgatgaccatcctgatgaagttcaagctaacctaccattaattttagttattgttgatgaattagccgacttaatgatgactgtttctcatgatgttgaagatgcaattgtccggattgcacaaatggggcgggctgctggtattcatatgattttggcaactcagcgtccttctgtcgatgttattacagggcttattaaggctaacgttccttctcgaattgcctttgcggtttctagtggggttgattcgcgaactattatcgatactaatggggcagaaaagctccttggtcgaggtgatatgttatttgaaccaattgatcaaaataagccagtccggattcaaggtgcatttatttctgatcatgatgttgaatcagtagtagactttataaaaaacgagcgagtagctgagtatgacgataatatggttgtaactgacgatgaaattgagcaagaagagcaagctgaagaggaagatgaattattccctgaagcattagattttgtggttgatcaacaaaaagcatcaacttcgctaattcagcggcgatttagaattggttataatcgtgcagcaagaattattgatgatatggaacaacgcggttttatcggaccagctaatggctcaaaaccacgggaagtttataagcaaaaaagtgaggaataaaaaagaccggagaaatttttctccgatctttttttattccgattacatggatgtttaataggctaaattaagtttaaggatgcaactgctccaaagattaaagaaccaagcattgcaattaacatgagccaaatagcaaccatggtaattttttggaaacgagttttcttttttcgctgcattattaaccatccttccatttttatcaataatagtagtgtaacgcatctttaatgcctttttcaaatctagttttagattatgttaaacttaaattacttatttaaagagaaggggactgaaaaggttgatggttagtattcaagttataattttagagattattttattattagtgattgggatagtagaacgattattagtacgaatatttcatcatcctaaaaaaacaaagcatttatggtggggatggacaattattttatggattctgataatctttaatattggattctattggccagcttatcctattgccttatggatgattctagctctgctattaattgctttacaaattattcacaatcatgaattcatttatcgccgttactggccagtattttggcggtattcggcatattatgctttaattatatatattggtagcttaattatttcaccatggttaccgttgatataaaaatattgagtgagttggaaaattaattttctgctcactttttttgtctattactttttggtaaaattcacaaaattacgtggtgagaagtgggggattgtggtagacttgacctataacgtggtaaaggaggacattagtcgtgttaatgggagaatttacacacactattgattccaaaggccgactaattattcctgccaaatttcgagaacaattgggggcacacttcattgttactcgggggttagatggatgtttgtttggatatccattaaatgaatgggcgattttagaacaaaagctaaaggcgctcccattaacaaagcgtgatgcacgtgcatttgtacgctttttatattccgctgcgacagattgcgaaattgataaacaaggacggattaatattccgataacattacgaactcatgcttcacttgaaaagaaatgtgtaatcgttggtgtgtctaatcgcttagaaatctggagcgctgaacggtggaataaatttacaagcgaaacagctgataattttgatgagattgctgaagatcttaatattgatttttaatggaggttttagttgatggcagaatttaaacatgtaacggtacttttaaaggaggccgtagcaggattaaatgtgcaaccaacaggtacctacgttgatgcaacattaggtggtggtggtcatacgcaagctattttacaacagctcgtcgatggccacctatattcatttgatcaagatcagacggcaattaattacaataaagaacacttaaaaacagtaatagagcaacaaaaattaacattaattgaagataatttccgcaacttaaaagcggaattggatagctataatgtaaaacatgttaatggaattttatatgatttaggtgtttcatctccacagttcgatgatgctaaaagaggttttagctatcagcatgacgcccccttagacatgcggatgaatcaggaacaaaaattgtcggcaatggaagttgttaacgaatggtcatatgaacggctcgttaagattctttaccgatatggagaagaaaaatttgccaagtcaattgctagaaagattgaacaacgccgaaagatagcaccaataaagacgacatttgaattagttgatgtgattaaagagggaattccagcagcagctcgccgtcatggtggtcatccagcgaaaaagagttttcaagctattcggatagcagttaacgacgaattaggtgctttagaggaatcgttagagcaagcattagacttgttggatgttggaggacgaataagtgttattaccttccaatccctagaagatcggttagtaaagacaatgtttcgtgaaaagacttcattaagtggggatgtaccgcagggattaccagtaataccagcgggaatggaaccaaacttcaaattaattaataaaaagccgattgtagctagtgaggaagaattagcggcaaatcatcgtgcgcatagtgccaagttgaggataatcgagaaaattagagaaggaaagtgacagaattatggtttcaaatgcggcaaggcaactggcgggagagcaacaaccgcagcaagcgccaagaaaaaagacttatcaacaactaaaaatttctccaagtccggttagatggtcaaaatttgaaagatctttagtagcagtaggtagcttaattacgctatgcttaatgattagcttactttctacaaaaattagtattaataatcagcaacggcgcttacaggatacccaaactcaaattactaaggcaaaaagtagtaatacaagtttgcagcaagaaatcgctgaattgacgactcaatcgcatttgaaatcagcagcacataaatatggattatcagataaaaattcaaatgtaaggaacgttaataaataatgaataagaagccacaacgaacgaaaaataggggacatagagaaaaccgagggacctttggcaaatggctctttctaatcacggttggattgtttaccttatttatcgttcgttttgcgtatatcgcaataaataaggatgttcaacatgttaacttacggtcacaagcggaacaaatttatacccagcagcgaattattcaagcgcgacggggtgatatttatgattcagaagggaatcccttggcaactgatacaagtaaatataccctctatgcggttttggatcgaacccaaaagtcttctgatggtaaaccgttatatgtaaaagatcgaaaaaaaactgccaaggtattatcacagtatattgacctgaccccaaagcaaattgaaaagattcttaaaccaaaagggcaagcctaccaagttgaatttggaaatgctggaagcaacctttctgtttcaacaatgcagaagatcaagaaccggcacttgccaggaattaattttattgcgactccagcacgtcaatatccagaaggcgaatttgcttctcaaataattgggatggcaactcctaaagttaaaaatgataatggaactgaagagaccaacttagtgggacaattgggcttagaaggctactttaataaacaactgacaggaataaacgggttgagaaaagataaacaggacgtctatggataccaaattgctaattctaagcaggtaactaaaaaagccgtcaatggagataatatctacactacccttgattcacaaacccaacattttctcgaaaataaagttaataaagtttataaaagttctaacgccaatgcaatgactgcagttgtaatggaagctaaaacaggtaaaattattgccgctacgcaacggccaactcttcatgcagaaaataatcctgtttggcggaatatgttagttcaagatgcttatgaaccaggttcggtaatgaaaattttgtcattagctgctgctattgataccggacattttaatcctaatgcgacctttaattcgggaacatgggctatgggtggcggaaaaatcactgattggtcaagttctggttggggaacaatttcctataaagatgcttttgatatgtctagtaatgttgggtttgctcatgtagagcaggacatgggagcagagacatggatgaagtacattaaacgatttggcctgttaaaaaaagttaatgttatcggaatgagtaacgaggttaatggttatacttcattcaaagggattcttgctcaggcaaataccgcttttggacagggaattactgtaaatgtcatgcagatgatgcaagcgtttagtgctattggcaataatggtaaaatgatgaagccttacattgttagcaaagttgtagatggtaatagcggaaagacgattcaaaaggttaagcctaaagttgttggacacccaataaaagcatcgacagcgaaaaaggtccttggttacatgcaaggcgttgtttatgatcaaaagggccttggccatgattaccaaattaagggttaccgaattgctggaaagaccgcaactgcacaaattggtggtgctcatggttattcaactggtgatacaaactacctttactcctttgcagggatggcaccagctaaaaatccaaagtatattatgtatgtcacccttcgccaaccgcaaaaccttaaaaaaacagcaaccaaacaaattgccagcgtctttaatccgacaatgaaaatgttgttgagccaacaaaaagttgcagaaaaggtcaagaaaaaggttattacaatgcctaatgttgttggtcaagcaagcgatgaagctaataaagaattatcaggtaaaggaatgcaggtaattgttgtaggttctggcaagaaagttaaacaacaatcagcagttccagacgaacaagtgttaacagatcaacatgttattcttgatactggtggcgagtataaaatgccagatatttctggatggagttctgcggatgttcaacaattagctaaggtccttaagctaaaagtaaaagaaaatggaaacggctatgttactcagcaaagtattttacctgatacaactattaagcgtggaacaactttaaccgttcaatatgaagctaaaaactagcagagaaactaattggaggtaaatatgaatttcttaagtgcagttttgactattcttagttcattcttaattacgtttttattgatgcccacgttaattaaatattttcgggctaaaaaagaaggtcagcaaattcgtaaggaaggccctacctggcatgctaaaaaggctgggacgccaacaatgggaggattattgttcatcttctctgcagtagtaacaattttatgggttgctgcttggcaagggttaattacgaatacgctgtgggcactcctctttgtcctggttgtttatggcctgattgggatgtgggatgatagtattaaaatcttccaccatcaaaatgaaggatttaaaccatggcaaaaggcgctatgtcaggtattagcagcaatggtctttacagttatttaccaacatgaaggttttcaaatgggctttggaacaactcaaattggttggctttacggtttgtttattattttttggatcgtcggcttttcaaatgctgttaatttaaccgatggacttgatggcttggtaagtggtctttccattatttcttttgcggcttatctaatcattgctttagtaaatctcaatcaaccaggttatcctgaaattgctcttttctgtttagcaatgatcggaactttactaggtttcttcccttataatcataagcccgctaagattttcatgggtgatatgggatctttagcaattggggcatccttagccgctgtttcattgttattacatcatgaatggtccttattagtaattggaattgtttatgtttgtgaaactgctagtgtcattcttcaagtggcttcattcaaaacaaccggtaaacgaatttttaagatgaccccaatccaccaccattttgaaatgaacggatggagtgaatggaaaattgatattgtgttttggcttgtagggttagttgctgcaattattgccgttacaacaatcttattagtaggttaggagtaaagagaaatgaaaaaaattgatgaatatcaaggtaaaaaagttcttgtaatgggtttcggaattagtggcattaatgcggctcacttattggtaaaacttggtgccaatgttaccgctaatgataaagcaactcctaaaaataatgatattgttgatgatttagaagctgatggaatcaaggtaattactggtgataatcccatttcattagctaatgaaggtttcgatattgtagtaaaaaatcctggaattccttatgataatccattagtggctgcattcgttaagcaggggacacctattattacggaagcagaactaggatggcaaatttttgatggtcaccttgtaagtgtaactggaagtaatgggaagactaccacaacgactttaactcaactaatgattgctgaaaatgcaaaatatcaagtgaaatatgcaggtaatattggaatttcctttagtaaaattgctgaggatttagggccagacgatacattggtcacggaattatctagtttccaattattaggagcaccaacaattcatccgcatattgcaattattactaacattttttctaatcatttagactatcataagacacgagaaaactatattaatgcaaagcttaatattacccggaaccaaaccaaggatgatttcttagttattaactgggatcgtgatgaatggcaaaagattgctcagcgtagtcaagctaccattgtgccattttctcgtctcaataagagtcatgaaggatcttatgtagaagatggaatgatttactggcgtggacaagaggttatgccaaccaaagatattcgattgatcggtccccaaaatgtagaaaatgcattggcagcaattgcagcggcaaaattaagcggtgttacaaatgatgcaataaagaaagttttaacaacatttagtggagtccgtcaccgcttacaatatgtgatggaataccaagaacggcttttctacaatgattcaaaatcaactgatattgaagctactgaagttgccttgcaaggctttgatcgtccagtagttcttttggcgggtggccttgatcgtggttatacctttgaacggttggttccttactttaagaagcatgtcaaggcaatgattgtttttggtgaatgtaaagataaaatgaaggatgcggggaatcaagctggagttccagtaattgaaagtgaaaatgcaattactgcggtaccagaagcatggaagctgagtgaaccaggagatgtcattctcctctcgcctgctaatgctagttgggaccaattcccgagctttgaagttcgtggtgataaatttattgaagcagttgaaaaattaacaggaaagaaggaacaataagatgcggttattggtatcaggtggtggaactggtggtcatatttacccagcattagcattaatcgaacgcttaaagcaggttgatccagatactgaagtgttatatgttggaacaacccgtggccttgaaaataaaattgtaccggatgccggaattgagcttgaaacaatgcatatgcagggctttaagcgttctctttctcttgaaaattttaagacaatctatcttttcttaagttctgttcatcatgctaaaaaaattattaatgagtttaagcctgacgttgttttaggtacaggtggatatgtaagtggagccgtcctatatgctgccgcaaagaaacatatcccaaccgtaattcatgaacaaaatagtgttgttggtgtaacaaacaagtttttaagtcggtatgttgatcaaattgcaattgcatttgaagctgcacgcagtcagttccctgctgataaagttacaatggcaggtaatcctcgtgctcaacaggtagctgctaaaaaagatagtgacttttcatggacaagttatgacttgaaagatgatattccaaccttaatgatttttgggggaagtcaaggagcaccaaaaattaataaaacagttgtcgacgctattccagaattcaataagcgtccttatcaggttatctttgcaaccggtcaaaaacggtatgatgatgtaaaaaagcaacttgcagaaaataatattagaccagctgataatgttaaagtcgttccttacattaaagacatgccggctaagatgcctcgagtggcagctttagtatcgcgcgcaggagcaaccactattgctgaggtaacggcactcggagttcctacaatcttaattcctagtccgtatgttaccgctaaccatcaagtaaagaatgctcaagctttagttaagaataacgctggcttgatgattactgaagataagttagatgcccgggcattattgactcaagcagataagattatggaagatgaagaagtgcgtaaagagatggcgcatgctgctgaaaagatgggtcggccagatgccgctgatagactaattaagatcttacataaggcaattgatgaacacgaaaaataaagtatagcctaggaaggaggaggagagatgttggatgatagatctgcgattgagcatcataaatattcacagcggttaactgaattagaaaggcgaagtgctgctgcccaacagcgacaacagaaaaagaagcctccaaaaatgcatgttggtaataagattcgcgggattaagattaagcgttatgtttctaacggcgagcgagtcttaaaattagttgtattgttcagtgctattctcctctttatgctttatattatttctcccttaagcaaaattaccacgcttcatgtaacgggtaatcatgacttaacaaaagagcaagtagaaaaaaatgcaaatatttatccaggacggtttatttggggcgtttatcttgctcgtcatcaactcactaaacaagctattcgcaaaaatcctcaaataaaagatttaaggatcaaggtaaccggtccccagtctctgcaaatatctgtaaaagaaaatgcgcttttaggaacagcggtgatgaataatgatacatacgctgttttagctgacggccaattacagcgaacaaaaaatgctgataatggtattgcttataaacgttttgatggtcataaaaaagttcttgctacaacggccgctcagttaggaaagctgaaactggcaataagaaatggtatttcaagtgtgagttatcaacccactaaagagtatccagatcgcgttattatttatatgcgtgatggtaatacagtttatggcgacttaaatactatcggggataaaatgggatattaccctgcaattgcagcaagtatgaaaaataagggaattatagatcttcaagtcggagcttattcttatgactatggatctaaggataaatgattttgtgaaaaaccttgataattcccttttttgtcattgtttatctgtggtaaaattcttatataggttaaaatacaattaatttaattaatgatagtcttaggagggttccttttagaatgaataattcagaagtatacgttggattagatattggaaccacctcgatcaaggcactggtgtgtgaaagtgttaagggtcagttgaaagttattggtgttggtgtagaacgatcggcaggattaaaccgaggagttattgtcgacattgataaaaccgcccaggcaatttcggcggcggtagcacaggccgaggaaaagtccaacgtagagattcaaagtgttgtagttggcttaccggcaaattacttacaaatgcaacgagtacacggtatgattacgattgcaacaagaggacaatcaagagagattgttaaccaagacgtaattgacgttgctcgtgaagcgttgacgcaaagtattccccccgagcgggaaataattgatttaattccaacagaatttactgttgatggcttttctggtattaaggacccccgtggaatggttggtgtccgtttagaaatgaaggccaccttgtatacaggacctaagaccattattcataatacaaaaaaggcagttcaacaggcaggttatgacattaaagattttgttattacgccgatcgcaacagactttaacctccttaatgacggagagcaagattttggtactgttgttattgatttaggtggtggtcaaacaacgaccagtattattcatgatcatcaattaaagtatacttatgttgatcctgagggtgggaaatacattactaaagatatttctacggtcatgaatacatcattaaaaaacgctgaacaacttaagctaaatcatggatatgctatggcatccttagccgatgaagatgttcaagttgacgttgatgttgttggtcaaaatgatcctgtccaatattcagagcagtatttatcagaaataattgaagcacgagtaaggcaaatttttgatcgtattcaggataaacttaaggctattcatgcccctgaattaccgggaggagtagtcttgattggtggagtggctgctctgccaggagttaaggaacttgctgaacagtactttactggtaatattaaggtgaatgttccagaacaaatgggcattcgtcaccctcgctatgcggttagtttagctttggggatgtatgaaaatcagttatcagatattgatcgattaattaagcaaactgttcaacgaattgatacgattaagagtcctcatgaagaaaaaagacaagttgttaatcagccacgtcaacaatggactgaaaaatctgataaattacaacgttcacagcgagaagcacagcagcaaccagttactgaagagccagcgccaaagaagaaaaagcaaaatggcctaagtaatcggtttaaaaacatttttaataatttatttgactaatttggaggaatactgctatggataacgaaacgttcgctaacgacaaccaatttgcggaagcgcaaatcaaagtaattggtgttggtggagctggcggtaatgccgtcaaccgaatgatcactgaaaaagtacaaggtgttgactttattgttgctaacaccgacctacaagcattaaataattctcaagcaacaactaagatccgcttaggacctaaattgacaaagggattaggtgctggttcaaatccagaagtaggtgaaaaagctgcccaagaaagtgaagaacaaattaaaaaagctcttgaaggcgcagatatggtcttcattacagccggaatgggtggtggaactggtactggagcagccccagttgtagctaagcttgctaaggatagtggagcattaactgttggtgttgtgactcgtccgttctcatttgaaggacctcgtcgagcacgctatgctgcagaaggacttgaaaagttaaagtcaaatgttgatactttaattatcgttgctaataaccgtttattagagatgattgataagaagacgccaatgatggaagcatttaaagaagccgataatgttcttcgtcaaggtgtacaaggtatttcagacttaattgttaccccaggttacatcaaccttgactttgctgatattaagacattgatgtctaatcaaggttctgccttaatgggggttggtgcttctactggtgaaaaccgtgctactgaagcaactaagaaggctatttcttctccattacttgaagtgtcaattgatggggctcaacatgtcttgatggatattactggtggtaaagacttatcaatgtttgaagctcaagaagcatcagatgtgattaaacaagctgctggaactaatgttgatatttcatttggtatgtccttaaatgaatcaatgggcgatgaagttcgcgttactgtaattgccactggaattgataagaaaaagaaaattcaacaacaaaagccagcggaaaaagaagcaccacgagtaactcggcctattccgcaagaagaacaaccaaagcaacgagatccttttgatggttggaatgatccaacagccgatacaagtaaccaatcaagaaattctgataacgaattttctcacgttactaagccagaatttaacgtatttaacgatgatgcggctaatacggatgacaatgatgatactaacttatcgactccaccgttcttcaagaatcgtcgtaagtaaataatttagcaaaaaggtggattttttaatccgcctttttctgtttagacctattaaggagggtaatacaatggcagcaaattttttaaaaagcctatttggtgaagaagacattgatgaacaagatggtctctatgaaacgagtgaacaagtttcaacgccagcaaacacaagcaacaaagtagtttcaattaatagcgggcgtcttaacaaaatgagtcagatttccttatacgaaccccgtctttatgcagatgtaaagcagatcgcatcccaattattagaaggacatgcggtgatcgttaatttcactcaaatggatacaaatgttgcagcacggttagtagacttcttaaatggcaccgtttttgcaattgatggtgaaatgaaacggatcggaaaggaaattttcctctgcacccctaaaaactatgaaatctcaggtagtttaacgagtaatctaaaaaatgatggtgataaattttaatcactaaaaggagttaatatgatcgcatttttattatgggctcttaatcaattagttgatgcttatatcttagtgatagttgtgtggtgcattatgtcatggtttccaaatgcacgtaattcacgactcggtgatgttatcaatcggttggtaaaaccttatatgcattggtttgattttattcctccaatcggggggataagttttgcgccgatgatcgctatccttgtactatattttgttcaggcaggattagcacatatagcagcaatcatttaattaatactaagaggaagtaaatttgagcgaagataatattaaacaacattttcgtccggatgaagccacccttattgaccaagcaaatgactgggtagccactgcagaaggtcaatatcgtcctgtcctcactccttttttaaatccacgtgaacgttttattatccaaacgattgttaatcgaaataacaatgttaaaataacaatgtatggtggttggcaaggcgcagaaatgcaacgagttttaatttatccgccttattatgaaccctctatcgaagactttactttacaggctttagagataaactatcctgttaagttttcagaacttcaccatcggcaaattatgggaacattaatcggtgaagggatggagcggaatgcatttggtgatattttaactgatggagcgcattggcaagtgatcgtaacgaaaccaatggcagagtatttacggaaaaacgttgagcacgttggccgaattaaggttaaatggattccgatcgcaacagaagcagtggtaacacctaaagaggaatgggtaccgatagttacaacagtttcatcactacggttagatgttgtgatagctgcaggctttaattattcacgaaaccgggcaaagcaattaatagagcatggtcaagttcgattaaactgggaagagattgattgtccagattatcaaattgtggttcatgatttgatatctgtgcgtcatggtggtcgcctcagaatcgatatgaccaatgggaaaacaaaaaaagacaaagaaagaattaccatttcagttgtaaatgcgtaatttgaatggaggaatttactcatgagtttgacggttgatcaaattaacaataagcaatttaatactaagatgcggggttataatcctaaagaagttcaagaatttattcaggaagtttcacaaacggtccaacaattaataactgaaaataataatttacaagagcaagtacgggctaacgatagcaagattaagtactttgctgacttgaaagattctttaaataagtcaattttagttgctcaagaggccgctgataaggttaaaaataatgctaagcgtgaagcagatattatgattcgtgaagcgcaaaagcaagcaaccgatattgtttcggaagctaatgataagtcaaatcaagtaattgaagacgctgctaattctactaagaagttaacaagtgaaactaatgatcttcgtaaacagactcggatcttccgtcaacggcttcaagtcatgcttgaatctcaattagaagtcattaagagtaatgaatgggacaagcttttggaaaatgatgacttgagtaaatatgacgaaattgaaaaaattttaggtagtcgtcttgacagcagttcaccaaccagtgtagaatcaactgcaacaactgctagtgaagaacaacctgttgaatcagaacagccagttgcttctgctgaacaaacagaagaagagagtacacctgtacaaccaacagctgttaacgatgacaaaggatcagatgcacctgaaactgttgttgtcttccctgataataacaagtaaatcactagaatcgtattttaataaaatcgttgaagagaattggaataattatcataacgttgaagcgagtcaacaattggtgagaggttgataatgtttaactattcctgatcatctcggagtacctcatttgagttagttaggatgaggcggttcattatcgttatctaatgacatgaggaaactttaatcttaaagttttaaatccgggtggtaccgcgaagaagcttcgtcccagtaatgggaggaagcttttttattattaaaatacaagaattaatgaaaggggtagttacaatgcgtgttaaagatacgttaaaccttggccgtactaaatttccaatgcgcggaaagttacctgtaactgaggcacaacgggaacagctatgggaagaaaataaagtttatgaactacgacaaaaactaaatgaaggaaagcctacttttgttttacatgatgggcctccatatgctaatggtaatattcacattggccacgctatgaacaagatttctaaagattttattgtgcgctataagtcaatgtctggctaccgggcaccttatgttcctggttgggatactcacggattgccaattgaacaccaattgactaagtccggttacgaccgtaagaagatgagcttaactgaattccgtgatctttgtcgggaatatgcccttaagcaagttgataagcaacggactgactttaagcggttaggtgtaagtggtgaatgggatcatccataccttacccttgataaagaatttgaagctgctcaaattcgggtattcggtgaatttgctaagaaaggtctattataccaagctaagaagccagtttactggtcatggtcttcagaatcagccttagcagaagccgaagttgaatatcatgatgttgttgctaaaacagccttcttcgtagagcaaattaaagatggcaaaggccgtttagataatgatacatatttagttgtatggacgacaacaccatggactgttcctgcttctgaggcagttgcggttaatccaaagtttgattactctgttgtaaagccagcaaatgatgaccggaaatttgttgttgcaacagacctgcttgagaaattagcagaaaaacttgggtgggaagattatgaagttgttgatcatttaatgggtcaagaacttgaagggatgactactcaacacccataccttgatcgtgatcttcttgttggtttagcagattatgttactgctgatgctggtactggccttgttcacactgctcctggatatggggatgatgattacaactttggtaaaaagtatgacttgccaatttttgccccaatcaatgatcaaggtgttttaactaaggaaaacggtgaaggctttgaaggggtattctaccaagatgctgatgatgtatctcttcaaaagctagaagaaaacaatgctttacttcttcaagagccattacaacacagttacccatttgattggcggacaaagcaaccaatcatcttccgggcaactgatcaatggtttgtatcaattgaaaagatgcgtcaaagtattttggacgccttagaagacgttaagtaccacccagaatggggaaaggttcgtcttcgcaatatgatcaaagaccgtggtgattgggtaatttctcgtcaacgtgtttggggtgtacctctaccaatcttctatgctgaagatggcacaccaatcatggaagaagaaacaatcaaccatgtagcagaattatttgctaagtatggttctaatgtttggtttgaacgtgaagcaaaagatcttttgccagaaggatacactaatgaacattctcctaatggtaagttcactaaggaaactgacattatggacgtatggtttgattctggttcatcacaccaaggggtattagctgaacgtgattatttaacatacccagcggacctttaccttgaagggtctgaccaataccgtggttggtttaactctagtttgattaccagtgttgtatgttcaggacatgcgccatataaggaaatcgtttctcaagggttcacacttgataagcgcggtaacaagatgagtaaatctcaaggtaacgttatcgatccaaataaggttgttcaacaaatgggtgcggaaattatccggttatgggtaatgagtgctgatacttcagctgatgttcgtgtatcgatgggaacattccaacagatttctgaagcatatcgtaagttgagaaatacgttccgcttcttacttgctaatactagtgacttcaatcctgaagaaaataccgtttcttatgagaagttacaatcggtagacaagtacatgttggttaaacttaaccacttcttaaagacaatgcgggaagattttgataattatgatttccttgatgcttataaggcattgatcaactttgtaaacaatgacctttcagctttctacatgaacactgccaaagatgtgctctatattgaggctgaaaattcagaagttcggcggtcaatgcaaaccgtcttctacgatatccttttgacacttgttaaacttcttacgccaattctccctcatactacagaagaagtatggagctacatgaatgaaccagaagattttgttcaattaactgaaattccagatccacggacattcgctggcgaagaagagctattgagcaagtgggatgactttatggaagtacgttcacatgttctgaagagtcttgaagaggcacggaatgctaagctaatcggtaaatcacttgaagctcaagttgatctttacttaaccgatgatcaaaagcaattacttgatagtcttaatgaaaacattcaattattgctaggggtttctgctcttcatgtccatccagctgatgaagcgcctgctgatgctgaccaatacaacgatggggtagcagttaaggttacaactgctaatggtgaaacttgtgctcgttgtcgcatggttaaggaagatgttggcagtgatccagcatatcctgaattatgtgctcgctgtgctgcgattgttcgggaaaatttccctgaaacagcagaagatggtttagaagaataatctctaaaaaaactggttttcgttatccagtaaatgacaattatttttaagcggtgtaaaataccaagtgacacttgttgcttggtattttattatggagttggtaaaaatgctcaaaggaaaagtaaaaagttttgacgaacaaaaaggatggggctttattacagttcctcacgaaggagaaatttttgttcattatagtggaattgaaggaacgcgtcgtcgtatccttcaccctgatgaagaggtctcattagtaattgttcaaggacaaaagggaccacaagcagcacatgttcgtgttttaagataaggatgggttctaatggaatttgaagagcgaccaataagtagtaaaacagtttttcacggccatttaatcgatgttgaagtacagcaagttatcaccccacatggtaataaaacacaacgagaaatcgtccaccatgcaccagcaattgcgattttggctttgacggctgataataaaatgattcttgaaaaacagtggcgcgcaccaattgcgaaaacaacccttgaaattcctgcggggaagctcgaccaacgggatgctgataatgctcttcatgcggctaaacgtgaattaaatgaagaaacaaggtatgaagcaacaagtttaaaaaagatttcttcattttatacttctgttggttgtatggatgaatacatgactctttatttggccacgggattaaaacgggttagcaacgagctgccgcaagatcaagatgaacaattgatgttaaaagaagtaactttaccacaagcgcttgaaatgattgatcaaggcgaaattgaagatgctaagacaatcatggcaatctattactggcaaggaatgaacaaccgtggataataaacaacaagatgagcaacaatcacgtatgtcacgtagtcaatatcgtcaacagcaacgtcagactgaacaacctaatgaagcggcagaaaatacaactgatcgaccttatagtcgcgaagcagttgctagtcagcgtcatgacgaaacagtggcagaaaaaacagcgcgcttgaagcgtcgcttaaatattgcaatcattgctttgattgtggcaattattattgtttacttaatactattttatgttggataaaaaggagaaaaatatgcgatttggaattatttgtgcaatgcctgaagaaattaaagaattaactgcgaagttatctgataaacaagaaaaggaaatcgggggtaaatcctaccttttcggtaagatcagtaatcaagacgttgtattagtagaatctggaattggtaaagtggaagctgggattactactgaacatttaattaccgattgtgaggcagatgttgtgattaattctggatcagctggcgggattggtgaaggcttacatgttggggacattgtaatttcaactgaaacggcctaccatgatgtcgatgcaactgcatttaattaccgttatggtcaactcccagggaaagaaccgcgctttaaggcttctgatcaatggggacaagccttagaaaaagccggcgaaaagactggtttaaatgtaaaacgaggattaattgtttctggtgaccaatttattgcaagctcagaagcaattaaaaagattttgaataatttccctgatgcactttctagtgaaatggaaggggcagcggttggacaagttgccactgaccaccaaattccatatgtggtagttcgggcaatgtctgatacaggtgatgaagatgccggcgttagttttgacgactttattattgatgccggaaaacgctctgcaaacatgcttcttcagctctttgcagatttagataagtaaatggaaggatgaaaaactcgtgagtgagatttatttggataatgcagcaacaaccccaatgaccccagaagtgattgcggaagtgactaaacaaatgcaagaatcatggggaaatgcctcaactggttactcttatgggcgtcatgccaaacttgtaatggaagatagtcgtcacgttcttgcccaaagcattaatgctgatgataatgagattatctttaccagtggggggactgaaagtgataatactgctattatccaaactgcttttaaacggcagaatcttggtaagcatattattacaactgccattgagcatgaggcagtcttaaaacctctccattttttagaagaacatggctttgaggtaacctatttgccagttgatgaaaatggtaatatctcaattgatgattttaaggccgctcttcgtgatgatacgattttagtaaccattatgatggaaaacaatgaagtgggtagtcaaatgcctatccatgagattggtgaaattttgaaagaccatcaagcatggttccatacagatgcagttcaagcatatggactgttgccaattgatgttaaagctgatcatattgatatgctttcaacatcggcccataagattaatgggccaaagatgatgggatttttatatcgtcgtgatggcattagttttccaagctttattaagggtggggaccaagaaactaaacgccgtgcggggactgaaaatgtacctggaattgccggttttgctaaagcggtagaattaaacacgccggaggtaaaagaagaacgccgtgatcgttattatgcctttaagcaaaagatcgttaatgcgcttaaggaaaataatgttgattttgaaattaatggacaaatcaacaaaacccacgtgcttaacttatggtttaagggaatttcaacttatgttatccagacagacctagaccttgcaggcatcgcagtctctggtggttctgcatgtacagcgggtagtattgaaccttctcacgttttaacagcgatgtttggcgctgatagcccccgaattagtgaatcaattcgaattagttttggtgggttaaatacggaagaagatattgatcagttaattgctacgattgttagaaccgttgaaaacctaaagaaaattaatggggacaattaaaatggaatttacaaaaacagtacaaatttctggtgataaggataaatacacaattagcccagagataaaaaaatatgctttacttgatttgggatttgaacagactaaccggggaaactttgaatatttaggaagtctcgatactgataacccatttaaaccggttgcccgtcttcggattttaattaacagtgatttagacggttttaaaatggagactctttcaggaaatggtttaagaaaaattaatatttttaatcaccaacgcgcagctgaatttattcaacaatatcactatattttagatgaaatggttgcccggcaaatattcactaaataaaaactgtgcagggattgaaatactctggtacaatggttatcactggatgcatgcgaccttcaatcgtagattattccagaatctatacgaaatgatggtgataattaatggctgataatagtcatacacgtgtggtggtaggaatgagtggaggagtcgactcttcagtgacggctcttctcttgaaacttcaaggatacgatgttgttggtgtcttcatgaaaaactgggatgacactgatgaaaatggtgtttgtactgccactgaagactacaaagatgtagcaaaagttgcttctaagattgggattccatactattctgttaactttgagaaggaatactgggatcgggttttcaagtatttcattgctgagtacaagaaaggtcgtacaccaaatcctgatgttatttgtaataaagagatcaagttcaaggcttttattgaatatgctaaccaattaggtgctgattacgttgctactggacactatgctgatgtaaagcgtgatgagaacggccggatgcacttgatgcgtgctaaagaccaacacaaggatcaaacttacttcttaagtcaacttgattataagcagttggataaggtaatgtttccattagctggctacactaagccagaaatcagaaagattgctgaagaagcagggcttgctactgctgataagaaggattctgttggaatttgctttatcggtgaggatggtcattttcgtgaattcttgagtcaatatattccagcacaaccagggaatatggagacccttgatggtaaggtcgttggtcagcatatgggcttaatgtattacaccattggtcagcgtcgtgggcttggccttggtggtaataaggaaagtaatgagccatggtttgtaatcggtaaggatatgaagaagaacgttctttatgttggtcaaggatacgaaaacagctatctttatgctactcatcttgaagcgagtgatatccactgggttgatgatgttgtaagtcgttatgggcgtgattttcattgtacggccaagttccgttaccgtcagacagatgttggcgttactgttcatttgtcagaggatgatcaaatggtaacagttgaatttgatgatcctgcacgggccatcactccaggtcaagcggttgtcttttacgatggagaggaatgccttgggagcgcgattattgatcgtgcttacagtcatgaccggcagcttcaatacgtttgattcatatttttagaccttaaagaaggcagaggtaatttcgcttttgccttcttaaatatacataaagtaataactctgtgataaacaattgccgcaaactctggtaagatagtaaataaaaggggtaacgacagagatgacaaaagtttatttaatccggcacggaaaaacgcaatggaatttagaatcccgttatcaaggtgccaatggcgattcaccgttattaaaggatagttatcgtgaaattgaattattagcaagttctttacaaaggattccgtttgaacacgcttatactagtcctttaaagcgtgcgcgcgtaacagctcaggcattattgaaccatttgaatccagaaatcccattaacaattgatagccggttaaaagaatttaatttaggcaaaatggagggaatgcattttgaagatgttgcggcaaaatggcctgaagtcttaaaaaactttcgtcatcatcctgataaatatgatgaatcattagtagaaggagaaagttttctagaagtaatcgctcgtttccgtgcagcaattgaagagtattgtcgccagtatcctaatggtaatattctcgtgatttcacatggagctgccttgaatgctgccattaatgcattgattggaacaccgcttgctcacttgaaagatcgtggtggactaagcaatacatcaacgacgattcttattactaatgatggtcgtcattttgaacttgaaaagtggaatgatacatcttaccttcacaagagcaaggttgatccgactgatacgatttaagaggtgatattaatgacagagaaaaaaggttttcgtgatcctaagaaaaaggaaacagaaaaattagttcataaactagttgaagcaattgatgagcacccagataaagtaaacaattattatgatttaggttctttgctaacccggttaaatgactatcaacaagcagaagaactctttatgaaggctttggggatctttgaggcaaagggtgacaaggatgctatgaacctcttaaactatggtcttggtaacctttactatgagattggcaaagttaatgaagcaattaagctttacaataagattgatgatcccaaactcaaagctgattcttatcttatgttagcccaaagctatatgaaaaagggacaatacaagcaagccgttgcttatggattaactgcccttgaattacgtccagacgatcctgaaattaatcaggtaattggtgattcattattagcattaggtgaatttaaacaggctaaggcttattatgatgcaattctaaagtatcatccgggccgtgctgatacgcaatttaaccgcggaattgtagcgatggttcttggtgaaccatacaaagactaccttgcgcaagctaagcagttagatcctaactactaccataagagtgagcaacgacttaatgatattgaaaaagcgcttcaggcaacgcaaaagaaaaattagcaacatgaaaggatgacttctatggctgaagaaatcgacctatttaagacgccaacggagccgtctttttttattggtcaggtacaatctgagatttttactagtccagattcgttttttaaagttttaattgtctcggttgaagaagcaaattttgattggcacgagccggaaattactgtaaccggaagttttggtgatcttagtgatgatcagacttaccgctttgagggaaaaattgttgagcatccacgatatggacaacaatttcaagctacttcttatcatgtcaaccgtcctacaagcaaggatgggttagttgatttcttgtctggaaaacaatttaccggaattggaaaaaagacggctgaaaaaattgtcgacaagttaggaacagatgcgattaataaaattattgctgacccgcatgttttagataaattaaaactccgcaaagcagttaaggattcattggttgataatttacgggcaaaccaggggatggacgagattattatcggcctaaatgatctcggctttggcgctaaccttagtagtgcaatttttgacaagtacggggaagaaactctacatattattaatgaaaacccctatcaactcgccgctgaaatagatggaattagttttaatcgtgctgatcaggtggcacaaaaattaggaattgccacggatgattcacgccggattgatgcagcaattatccagacacttgatgacttgacaatggaaactggtgatacatttactacaacaaaacctcttctgcagcaaactatccaattgcttgcccaaggaagtggtggccgtgtttctacagatttaattgccaaccaaattgttgagttagagaaaaatcaagaaattagttacgcggatgaaaaaatttatccaactgccctttataacgcggaatggcaaattgctgatcacttacatcgtcttcttaccgttgaccaggaaaaattaccagcaacgactattgaaaaaacagttacggaagttgctgatcaatcggggataacctatgaccaagttcaaaaagaggctattaaaacagccttaaacagcaaagtcatgcttcttacgggaggcccaggaacgggaaaaacaacaattattaagggaattgtagctagctatgcgaaaattcataatctctcattggatgtaaatgaatataaggaaaagtcttttcctgttttgctagctgctcctacaggccgagctgctaaacgaatgagtgaagctacagatttgccagcaagtacaatccatcgcttgctaggacttaacggtcgggaaatgccaactgatatgaatgcccgcgatttagaaggctcgttattgattattgatgaaatgtcgatggtcgataccctcttgtttaagactcttattcaagccgtccctacttctatgcatgtggttttggtaggtgataaagaccaattaccatctgttggtcccgggcaaattttccatgatcttcttgactttgcagaactgcccaaagttgaactaaccaatattcaccgccaggctgctgattcaacaattatcccattagctcatgctatcaaagagggtaagttaccatcagatctaacgaataaaatgccagatcgatcatttatctcatgccatgctaaccaagtgccaagtgtggttcaacaaattattgacctttctaaaaaacgagattattccgcaaatgatattcaaatcttggcaccaatgtaccgcggacaggcgggaatcgaccgtttgaatgaacttgcacaacaggcatataatcctccagctaatggaaagcaagaagtcgattttaggggactaacttttcgtgttggagataaggttctgcaactcgttaatgttccagaaaagaacatttttaatggtgatattggaaaaatcacagcaattgaaagcggtaggacagtcggtaagaaaaatgaatcaattactgtcgattttgatggtaatgaagtgagctatagccgcatggaatggaatcaattacggttagcttattgtatttcgatccataaagcacagggaagtcagtttaagatggttcttttgccgattgttcagcagtttagccggatgcttcaacgaaatcttttatatacggcgattacccgtgccgcagaaaagttagtcttgatcggtgagccgtatgcggttgtgactagtgtaaaaaatgaagcagttaaccggaaaacttctttggtcgatcgtcttgataaggtttggagtaagcatggtgaactaaaatcaaaattggatcatcaaacggattcgttaaccaaagaactttctagtccgcaacctgttcaaaaagaaaatgaacagttaataaataatgatgctcagcaatatatcctaacagctgatctcattaattcagagacaattgatccattaatcggaatggaaaatattagcttacaaagtttgcatcaagccaaataatacttgcttgaatagtaatttgttgtcataatagttatgattattgtcgaactttaaaggagtataaaaatgacccagataaaaaatgccgataatgtgcgtttattttcactaaattcaaatccaaaactagctgaacaaattgctcaacgcgtggggattccgttgagtaaagcttccattagtcattttgctgatggggaaattaaaattacaattgacgaaagtattcgtggctgtgaggtctacgtcatccagtcagtttctgatccagttaacactaacttgatggaactattaattatggttgatgctctacggcgggcaagtgcggccaagattaacgtagtaatgccatactatggctatgcacgtcaagatcgaaaagcacgaagccgtgaaccaattacagctaaattgatcgccaaccttcttgaaatggatcaaattagtcgactagtaacgattgaccttcatgctcctcaagttcaaggtttctttgatattcctgttgatcatcttcaagcaaccagtctttttactaaatatattgaggaacaaaacttgggtgatgatattgtagtagttgcccctgatcatgctggcgttaatttagcgcggaaatatgctgaacgaattaaagcttccattgcgattattgataaccgtaacaatgaagttcgggaacggactgaacaagaagtaccggaatatgtaatcggggatgtaaaaggaaagactgcgattattgttgatgatattgtagatacaggagtacggatgaacttatctgcacaagcattaaagaactttggtgccgctaaagtttacggaattgctacgcatgcagtattatcagctgatgcggtaaatacgttacaaaattctcctcttgaaaaaatgattgtaacagatacaatccatctaccaaaagagaaagaattccctaagttggttcaattatcagtggacgatttattaaaagaagcaattgttcgtatccacaataaccaatcaattgatacattgtttaatcgtaaataaattaaaaatcgatgaaaattcagagttgaaactgaattttcatcgatttttatcttttaaatttttttagttttcaaattttaaggaaggtagtgaattaacaaaagccaaatatgctttgttttcatccatttcaacgctactgctttgaagctcatcaagattttcttggtgaattgttgactcctctacagtaataatatgagtaaacgtagcattaccgattagttcgacccagtagttgtagtcatcacggtgaagaattgtcttaaccatgccaccaggattataaacactaattggttcattaaatgatgctgcgtctggatgagtgagggctaaagcgagactagtggcagacatacctgtcccacaagcatttgtaaagccgactcctcgttcaaacgtttttacaaagagtttgttatgaccgagaatatggccaaaattaacatttaccccgtcactgaagtaaagattatcactatttaaccgtgtacctaattcttcaagtgctgggccatttagctcttccatactaacaaaactaattaagtgggggttaggaacagcaagggctgaaaaacggaggttaggatataactcagggacgagggtgtctaacaggcgctcatggccaagattatcaaatggcaaagcagtgcggtcaaactttactggtgaaatttcaaccgcaaaagcaggaactccaggtgcaaggtcttcatgctgacgaacacgaagactagcattcattgtatcaactttaaaatcggttaaattatcacgttctgctacataacgagcaaccgttctcaaaccattaccgcacattgaggcttcgctgccatctgcgttaattacccgcatttgtgctaccgatcctggtctagttggatggttaacaactaaaacgccatcagcaccaccgagaacgccattttgtgtatcagttacttttcgggtaaatgaaactagttctttatcggtaaggggagtagtcaattgtgtttggtcaagaataaaaaaggcattttgtgatccgtgtacttttaataattgcaccataaatagttcctcctaatttgcgaaaaagcgatggtaaatagctcgaacggcatcatccgcgtcttcgttgtatgttccgatcataattgcaattcgtgaagctccttgattaatcatgggaaccgcaatgtgtttttcggctagaggcattaatatatcatcaattacccccgtgcgattacgcataccttcaccaacaaccatggtaattgcataattatcaatccattctaaacggtcaggattaatctcctcttgaatttcattgcagatggtatcgattaattggtcattaattgcattccgatcaaggataattgttatatcatcgattccggaaggcatatgttcgtatgagacgttgtgctttgcgagaatttcaaggatccgaagagtaaaacctgcttgcttgttaagaagatatttgtgcaggtagagggctgcaaagtgttttccactcacgacccccgttataatatcgcttggttgaaaatctttatcagggacaatcattgttcccggcttttcaggatcattagtattacgaacattaattggaatatttccttgaatagcaggaatcaatgcttcatcgtgaaagacggagaaaccagcataagatagttctcgcatttcccggtaagtcatggttgtaattggttgcggatggtcgacaatttgtggattggctgagtaaatagcatcgacatcggtgaaattttcataagttgaagcgtgaagaccgcgcgcgagaattgcaccggtgatatcagaaccaccacgggaaaaagtagcaatgtgtccagcaagagttaggccatagaaaccagggaatactaataattcgttctcattaaacgtaaaatgactcaagtttgcatatgtttctggaataacgttagcattattgggtgttccagtaacgataataccagcttcacttggtgtcacaaaacgtgcttcatagcctaaatgctgcaaaaggatagccattagttgagcgtttaagcgttcaccatgagctttgaaagcggccaagagatagttatcatttggatacgtatggttaggaagaccttccagtcgttcaactagcggaattaatttatctgctggtaagccaaaataagcggcaatctcttgatatcgatttaaaatttgttcaacgatttcttggggattttggcctgcaattactgcttgggcatatttaatcagtaagtcagtaactttaatatcatcggcaaaacgtttacccggcgcagaagtgacaattacccggcgttgggggtcagaggtaataatattaattgcattttgaaaggcttctccattagccagagaacttccaccaaattttacaactttcatacttaaatactcctttgagaaaattagggttgttaatttatctctaaaataatttaatcgaattctaacacattaaggaagacatgcaaacctttaagttgtataaggtaagtaaaataaactttcttacatctaatggattaaaaaaactttttaaatttaattatttgtattgacattctcataaaagacttataagctatgtataaatcgaagaggcgcaaccgacactagtaaactaatttagtccgccaagacattgaggttagttgaacagggaagttgccgaagcgcttagtttggcacattaagtagctgggtcgtagttgaataagctacggactgtcgcaggacaataagagcctgcgttgcgctatcgacaaatcagaatggataagtgaattccactgtttgtttgcgcagacagtggattttttatagcctctttactacaaatctcatggaggaattacaaatgaacgaacagattactgatcaacaattaaatgccgctggtcatctaacgattgggggatgtgatgcggttgacttagctcatcggtttggtaccccgttagttgtttatgatgttcaacagattcgccaacagattcgagcatttaagcgggtttttgaagaaaataatgttgattatgcggttagctatgctagtaaagctttttcagcaatcgcaatgtatcaagtagttgctgcagaaggtgcgcatgttgatgttgtttctggtggtgaattatatacggcaatcaaagccggctttccaatggctgatgttagttttcacggaaacaataaatcacgggaagaattggaaatggcaattgaccatcacgtgggaacaatcatgattgataacttccatgagattgaattgctagcagacgttttggagaagcttgatgcacatgttgatgtaatgttgcgaattactcctggaatttctgctcatacaaataagtacattcaaactggtcaggttgacagtaagtttgggtttgaccttcaatcaggacaggcagatgaggcgttagcaaaagtcctcgagaatccccggatgcaaatgaaagggttgcatgcccatattggttcacagatttttgagcttgcgggatttgaaggggtagctaagaagttggttgaagttgctgcccactggcaagaaaaatttaactatcaagctgctgtgatcaatgttgggggcggttttggaattcgttatgtaaaagatgatacaccacttgctccagaagaatttgtggcagcaattattaaggtaattaaagctgaaattaaagaaacaaatcttgctatgccagcgatctggatagaacccggacgttcaatcgcggggcccgctggttataatctttatactgttggatcacgtaaagatgtaccagggttgaagccatatgtaacagttgatggggggatgggtgataacattcgtccagcactttatgaagcacaatatgaaacggtcttagcaaataatcctcgtgcagagttggttgaacatgttcgggtagcaggaaagtattgcgagtctggtgatatcctcagtcagaatcaggtattaccggctacaaaaccaggagatgtcttagcgatgcttgatactggtgcttatggttattcaatggcttcaaattataatcggaatcctcgtccagcagttgtctttgcagaaaaaggcacagctcaggttgtaattaaacgagaaacctatgatgatttaattcatttggatgaaccataccaacaataatttgacatatataaaggaagaaagaggtaaataattatggctgaattagatgcacaaacaatcattaactacattagtaacgcacccaagaagacaccggtaaaggtctatcttaaagggaatttgggtgatttagaatttcccacagaagtagaaacatttcttgaacagcgtacgggtgttattttcggtgattggacagttattgaaccgttattaaaggaatacagttcagcaattgaatcttaccatgtggaaaacgatgcgcgtaattcagcagtccctttgcttgatttgaaggatattaatgcccgcattgagccaggagcaattattcgcgataaagtgcttattggtgacaatgctgtcattatgatgggcgcaacaattaatattggtgctgaaattggtgccgattcgatgattgatatgggggcagttcttggtggccgtgcaattgttggtcgccactgtcatattggtgctggtactgtattagctggagtggttgaaccggcttcagctgaaccagtccgcattgatgacaatgtaatgattggcgccaatgcggtggtaattgaaggggttcatgtaggagaaggagcggtcattgctgctggcgccgtggttactcatgatgttgctcctcatacgatggttgcgggagttcctgctaagtttattaagaatgttgatgaccaaactgctggtaagactgaattagaggacgatttacggaagctttaggaggatgaagatgttaacagaagaagaattaattcaaattcgtcgtcatctccaccaaattccggaactagctctccatgaatttgacacccaccaatacttagtggagacggttgctagttttaaccaagcatttttagaagttcgtacttttaaggaattgccaactgctctcatggtgttagttcatggtcagaatccacaacgaacaattggatatcgaacagacattgatgctttaccagttgaggaacaaacaggcttgccatattcatcaactcatccgggaataatgcacgcctgtggtcatgatattcatatgacggttgcattaggggtattgaattattttagtgaacaccagccgcaagataatatcctgtttttcttccaaccggccgaagaaagcgaaaatggtggaaagcgggcatatgaactgggcttgtttagcggaaagtggaaaccagatgagttttacggtttgcatgataatcctgatttgccagcaggagcaattggttgtcggatggggaccttgtttgcgggaaccacggaagttaatattgacctcaatggtaagggcggtcacgcggcgtatcctcaaaatgctaatgatacggtcgttgcggcagcctcattaattcttcaagtgcagactgtgatttcgcggagtatcgatcctattcaaagtggtgtaattactttaggaaagattgacggcgggacgattcgaaatgttatcgctggacatacacggattgaaggaacgattcggggactaacgcagacgatgattgaaactattgatgaccgcttgaaggacgtatgtgaaggaatcgggcgtagttttaacatggatgtttcccttgaattaaatcagggtggctattggccagtagaaaataatccagaattaacaaaacggtttatccattatatggaagaaacaccaactgtaaactttatcgaaacagaaccagcaatgactggggaagactttggctacttactggctaaatttccgggaaccatgttttggcttggggttgaagatgattcacaattacattcggccacccttacccccaatgaaaaagcaattaaacgtggagtagatgcgattactggttttcttgaatatcggatgcaaaattaatagggaacaaataatggaggaaataatatgacattattacaaaatgcagacttaatgacggcaattgtaaccccttttgatgatgagggaaatattgactatggtcgtttagaatatttgacaaattacttaattgaacatgggagtaatggttttgttatcggggggactactggggaaactccagaactcactcatgatgaaaaaattgagctataccaacatttcggtgaaattgtaaacggacgggttccggttattgctggaactggtagcaataatactaaggaaacgattgcctttactaatgaggttgcgcaaattaacggtatcgattatgcccttgttgttgttcctccttataacaaacctaaccaacggggaatggttgctcatttcacagcagttgcggataatgttgacctcccaatcatcatttacaacattcctggtcgtacaggggtaaagatggctcaggaaaccgtagtagaattgtcgcaccatcaaaatatcgccgctgtaaaacaatgtacatctttggaagaacttgaatacattgttgaacaccgcgaccctgattttgcagttttcacgggtgaagatgcacaggcgctaactgcccgggttttaggagcaaatggggttatctcggttgcttcccatacctatgtcgatcaaatgcgccaaatgtatgactcactataccgaggcgattatcaaactgctggtaagttgcaacggtggttaactccccggatggccgctttgtttatgttcccatcaccatcaccagttaaagctgttttgaatgcgcaaggttttaacgttggtagttgtcgcttaccaattcttccattaaatgaagaagaaaaacgcgaattagagactgccttatcattacctactaattcgttgactgccaagaacttacctttaaatttgggggaataaagcatgaaaaaagttttaattgctggtgcgactggagcaatgggacaaaaggcggttgatctagtgaactcactcgctgggtttgaaattactgctgcgcttgcaccaaccttaacaaaagagaatatggctgattttcaccttgcatcatctgttcatccttatcaaactttggatgaaattgaagatggcgttgctgatatttggattgatttcaccttgccaagtgctgtttatcagaatgttaagtttgcgcttgaacacggaatgaggccgattgttggaacgaccggcttaaccgatgaacaacaagcagacctggtgcgcctcagtgaagaaaaacaagtgggtggattgatcgctgctaattttgggatgtcggcagttcttcttatgaaatttgctcaggaagcagctaaatatttcccggacgttgaaattattgaaatgcatcatggtgataaaaaagatgccccatcgggaacggctttgagtaccgcaaagttgatcgatcaagtccgtcctgcacatgagacgaatcctgatgagacagagagcttaaccggtgcgcggggtggcgactaccatggaattaagattcatgctgttcgacttccggggtacattgctcacgaacaagttctctttggtggggatggcgaggccctaactatccgccaagactcatttgaccgtcaatcctttatgaatggggttaaggttgctctggagaaagttgatggattatcaaaattggtaattggcttagaaaatattttataagagggtgaaaaaatgccaagactccatgctgaattagcaacaaccgtaaatagtcatctggcagctgttccgccagcacagattcgcgcatttgatgaagaaatttctgccgttcctggactagtaaaattaacgcttggggaaccggactttgctgtgccagatcatgttaagaaggcagcaattgaaagtattcaaaatgatgattctcactattcgtcgagcaagggtaagattgaattacgcaaagcgattagtaaatatcttgagcagagtcgtcacgtttactatgaccctgaaaccgaaattgtagtaacgattggggcaacagaagcggtaaccgcgacaacttttgcaatgttaaatccgggagataaagtaattattcccactccagcattttcgctatatttcccgagtgtttctctaactggtgctgaaccgatcaaagttaacactgctgaagatggcttcttgttatccgctgaaagactagaagaggtattagcaaaagagggtccggcagtaaaggctgttctcctaaattatcctaataatccaactggccgttcgtacactgaagaagagttaaaagcattggctaaagtaattgaagatcatcatatctatgcgattgttgatgagatttatagttcattgatgtacgatcaacccttccattcacttgcgacacttttgcccgagcagacaattctgattagtggtttatcaaaatcacatgcaatgacgggttatcgtttaggatatgtggctggcccaggagaatttatttcaacgatgtcaaagatgcattcatttatggtaacgtgcccaaatgatactgctcaagcggccgcgattgaagcgttagaaaacgggaatgatgatccgcaagaatttaagcgggcctatcgtcaacggagagataaacttgcgagtgcaatgagaaagatgggctttgaaattgcgttgccagatggcgcattttatatttttgctaaaatccctgcgcaatttgggaaggatgatctcgcttttgctcgtaaactagcccacgaagctaaagttggcgtaattcctggaaatgcatttggtcctggtggagaaggatacattcgcttatcatatgcagcggcagattctgttattgatacggcgattgaacggttacaaaattttatgaataatttaggataggttgaaagaaggaactaagatgagtaaagaatataatgtcgcaattttgggtgctactggtgcagttggtacacggatgattcagcaattggaacaatcaacaattccagtaaagagtgtgaaattactggcatctgctaagtcagctggtaaacaattatcatttaaaggccaaccgatcactgttgaagaaacgacacctgattcttttaatggggttgatattgtgctttcatctgctggtggatcagtatcaaaaaagttccttccagaagcagtaaaacggggagcagtttgtgttgataatacgagtgcttttcgaatggaacctgatgtaccgctagtagttccagaagtaaatgaagaggcgttaaaaaatcatcacggaatcattgctaaccctaactgttcgacaattcaaatggtggtagcattggaaccaatccgccaagcatttggattaaatcaaattattgtttcgacttaccaagcagcttcaggagcaggccaatcagccttaaatgaattacgacaagaaactcaagactaccttgatggtaaagatatgcaagcagatgccaagattttgccaacaaagggtgacaagaagcattatccattagcttttaatttattaccccagatcgatgtctttgaagatgatggttactcccatgaagaatggaagatgatccacgaaacaaagaagatcatgttaaacgacatggacgctaaggatattaaggttactgccacttgtgttcgtgtacctgtcccaattgctcatggagaatcgatttactttactgttgatgatccaacggtaactgttgaccaattgcgggcagtattaaaggacgctcccggggtagttctgcaggatgatcctgcgcaccaggtttatcctcaaccaattaatgctgttggcaagcgtgacacttttgttggtcgtctccgtgcagatgaagaaaatcctggttcctttaatatgtgggttgttgctgataatctccttaaaggggcggcttggaataccgttgaaaatgcagaacgtttagtcgcaaatgggttagtttaaaattttataatcataataaaaaatactctctgaatatagggagtattttttgtatggttataaagtttgtcgatagtaaaaagtaatgtagccaataaaaagttgaaataagtcttcagtatttttaggatctagttcaaaaagttttttaatgcgaagtaatcggttattaagtgtattacggtgtacaaataaattatgcgcagtttgatttacactcatattacacttaatgaactcacggattgtatcgatcaattctttcccatcttttctttttagtaaagcttcatattgatcattaactgctattaaatttaaatcactatctaatacctgtttaataaaagagacttgtgagtaatgcctaaatgatggctttccaaaaatattacttaatcgcagtgttgtaactgcttgctccgctaatctaccaagcaaattaccccaattactgataccgtattcaatttcttgatgttcaagtttttgttgaatatatgtttcttggtgctttgaactgaggataatcaactcaatgtgattagtaagagaaaaaataattgtttcctgatctagtttaaggtttttgattatctgagaactcccagcaattgcaattacaagtcgttgttttgctagatttatatttagacgatttgcttcctcaactagttcactatcaagttgcggattttgatacttgctgacattaatccacctataaataaatctttgtttaactttttcaatttcgtgctcttgttcattttcttgtttttgctgtagcaagagctcgactgctgtttttagcaatgatgctaggggagtaactttattagggtcaccagtaattccaacaacaccaataatttcatttttaaattttaagggcatattaacgcctggctgtccatgatttccatattgttgctccattggtagtgtttttcgctgttttatcgcatcaacagctccaacatgtaaagtatttatcctgcttttatttccacttgcaataatataacctttcttattcataatattaatgttatacggtatttgcgtcatcatatgatcgacaattgattgtgcaagttctggtttgagttccattattttctccttactgattggtaattagacgataagattttgataataggatttgtgtacaaaatgcataataatctttgtgcaaaacataacttgttataagcttgtttaaggattaatgtaaacgatgacaaagggatactgtttcttgtgatattttatcttattttaatatttctttactagcaatcaaagaggaggcttataaaatgatttcttggtggggagcattaataggattagcacttgcgatttttttaattttacgaaaattagatccagtatattcattattactaggtgcaatagtcggcgccgttattggtggggctggtttagaaggaactattaatattttggttaaaggtgaacaaagtgtaatgggaacggtccttcgagtattagcagcaggaatgttagctggtgttatgatggattctggggctgccgaaacccttgcacggacaatcgttaataaatttggtgatcggttagctatttttgcattagctctagcaacgatggtaattacagctgtgggtgtctttatcccagtcgctgttttaattgttgcaccaattgcccttgaagttggtcgcaatatgcatatttcaaaattatctttattggttgccttatctggtggaggcaaggcaggtaacataatctcaccaaatgcaaatacaattgcagcagcaaagggttttgggcttgaactaagtcaagtaatgattgctgattttattcctgccgtcatcgctttaatagttacagttgttgtagctagaatgatccgcaaaaaaggtagggcagttctagaacaagatcttgaagatagtgcaaaaacaatcaagcaaagtgatttgccgacatttaaacaagccatcgttgctcctgttattgcaatagttttacttttattaggaccaattggaactatttgtcatttaccattattagcaaaagtaaatttagatgctacctatgttttgccatttgcagcaataataggtgctctagcaatgggaaaaggtgaaaaaattaagagttatgctcagaccggtgttagtcgaatgactggcgtagtaatgattttaattggtgcaggtgcaattggtgctactattactgcgtctactttcccagagttattaatcgaacttattaaggcaagtcatgtgcctggtgtcttattagcaccactttctggtattctcatggccggagcaactgcttcaacctctacgggtgttattttagctactggttcttttgccaagtctattttaggatttggtgttgcaccacttgcagcggctgcaatggttcatactggggcgattgtcattgaccaattacctcaaggaaactatttccatgttacagcgaatgcaatgcatatggatattaaagaacgatcgcaaggtattttttatgaattcttagttggaggttccgcaatgttaaccgcaactatcttgtatggctttttgcatttactataaatgaaaggatgatcagtgatgaaatttgtaattgctccagattcatttaaaggcggactaacagcaaaagaagcagcaaatgtgatggcagaaggaattaaaagagtgtttccgaatgccgagtatgttttagttccaatggctgatggaggagaaggaactgttcaatccttagttgatgcgactaacggtcgaaaaatgattgctaaagtccacaacccattaaataaattagttaatgctgagtacggaatattaggtgatggggaaacagcagtgattgaaatggcagcggcaagtggccttcaatttgttaataaggagactgcgaacccgcttattacaactacatatggtaccggcgagttaattaaggatgctcttgaccataacataaaaaaaataattattggaattggtggaagtgcaaccgttgatggcggggcgggaatggcccaagcacttggagcacgtttactggatgctgataatcatgaaattggtttaggcggtggtgagttagcaagtttagagcaaatagattttggagacttagatcctcgcttaaaaaatgtagatattcagattgcatcagacgttaccaacccattaacaggaaaaaatggggccgccccagtatttggcccgcaaaaaggagctgatgacgaaatggtgaacatcttggacaaaaatcttcatcattatgcacgaaaaatagttgcagctggtgggccagacgttgaacaaacggcaggtgcaggggcagccggtggtttaggagccggattaatagcatttaccggtgcgacaatgaagcgaggagtagaattagtgattgaagcaactcaactacaaaaaaaggcagttggcgctgattatgtttttactggtgaaggaggaattgatttccagactaaatttggtaaaacgccatatggagtcgctaaggcaactaaagaggtggctcctaatgctccagtaattgtgttggctggaaatattggtaaaggtgtaaatgatctatattcatccacggccatcgatgcaatttttgcaactcctgaaggggctaaaccattaaaagcagcattagcagatgcacctattgatattgcgcaaacagcagaaaacgttgcgcgtttaattaaagtgagtcatgttaataattaggaattaaaagagggtggaaaaaactttgcttttttctcaccctctgctattttcacgaacaattgcaagataacgtagaattagcttcgcgttgtcacaaggctcgcgtccgagcgacaattagcccatacctccgccttagcttagccaaccgccttgtcgagaagactgttttctacgcacattttacagcaaattactggcttggcttagtcttataaagaccgtataatgaattggaagataaccaaggagaatttaaaaatggaagataataaatatcaatatgatgaaaacggctttcgtgaagatttaaaagatgatccagatgtcctccaccagccagatgctgaccgtacacagcgcgatttaataactctggactatgatgagacgttggcatttcttaatggtgaaaaggaagttaagactgtttatgacttttcagatgatgttttggaaaaaataaaagaaaaatatccaaccctaaatgatacaccgatcaataaagtaatcatggaaaaatatcagcagattttatccgctcgatacaatgaatcacaagcaaataataagacggtgcatgccgatgatagcgaggataatgatgaatagtctaataacgtttattatttcaattgcctttttaggattagtgatttgggaaaatcgtttacatagtcaacttggattcttggcaagtcaacgaccagataaagttacaaaggattttattcgggtagttcgtcaagaaaaacggttgaattggatcttgtgtatactagcaattattgttttcatgacgactagtcgttactcagttctattaatgagtattattacaattattgaattgttattagtaactcgtatggatcgtgtaaaaaatgaaatgatagattaaatattattataatgattaatcttttaagaaagagtaacgttttttaagaactatctaataattgctatacgcatttaaaaattaatggtaaagttagaattgtgtatttcactaatttattattgtttgtttagtttttaggaacttattgggagggtgttttatttatatgagtaaaaaaagaacacatcattcaaataaccatcgatctcgtggcgtttttgcaggagcagttagtgccttaagtttattagcagtgacaacacaagcagttaatgctgaacagcttactgttaagtctggtgacactatttgggggcttgcaaaacaacatggactttctattagtgcattagaacaaacaaatccttcagttaagaagataagtgatagcatcgacttaattacagttggtcaacaattaacgttgcctactactcaacatgatgctaacgcggatttgaatactgatggtagttatactgttaagcctggcgacacgcttagctctattgcagatcgttataatgtaactgttagtcaattaatgtcatggaataacttaagctctaatgattcattatacattggacaacaactcagtgtaacaggtcctgcgatctcaactgctgtaaacgcgcccgttgtaagtacccctgttgctgatgcgagtgtatcggctcagcaaccggctgctcaatcgacggacacaacttcattgatccaggttcaaacttcagcagttgcctctgcttctgtgcctcaacaagatgtggctagtagccaaccagcaggaacttcacaagcaactcctgctttgagtgcaacgcaacaagtttcaacttcttcaacagtagctgctcctaaccaaagtgcagccaacaatagtagtaccactattgcgaatagtacaacttcgacttctgctgctgtaacgtcctcagcaactactaatagtccagccattacaacagttgctgctcaacctgctacagctaataatgttcaggttgcttctgcctcagctgaaaatagtgttgcaccgcaaacacaaagttttgctgttagtcaagctacttcaacagctgtgaatactgctgctttatatggacaatcatttgttcaagcagcaccagtagcaagtcaagcttcacaatcacagactgcaccagcatcacaagcgacggataacgttcagaatagtaatgctgcttcgcaacaaacaactgttgtaacgtcacaagctcaaccgcaacaatcacaagcggctgctagtcaacctgcacagcaagcagcaactactaatcaagatttacaacatggttctgtagttagtcttgccactaagattgctaactctaatagtgttccatacgtatggggtggtgaaagtcttagtggaatggattgttctggattagttaagtatgtttatgctaatgcggaaggtaagcaattaccacactatacaggagcacttgaaaactgtgtggaccaacatccagttagtgaagctaagccaggcgatctcttattctggggtaaccatggttcaacttaccatacagctatttacacaggaaataatcaatatgtggccgctgctcacccagggactaatgtttcgacttacacaatcagtccatactttaatccaagttttgccggaacggttaaatagttctgatagattattagagctttttcattagatagtaacaaagatgtaacctaaaaagggttaacattcttctatcctcgtgttatcttacttatattgcaattccagtattgctctaaaaatatttcacatttattggggagtgttaaatatgagtaacaaacatgaaattgaagaagatttataccgtgcacagtcccgtttggatgatttatgtaaacaagagggacaggaaaatacgggcactcagactgttactattcaaccaaaatacggtgaagagatgcaatctttacgggaagaatgcagtcagttacggattattttagaagcaatggaagcttctgaagattaataaactaaaaaagattaacaaaaagcagtaagcgctagaagaaaaaattatcttctggacttactgcttttaacttatttttctgttgtttgccaaattggatattgactaatgtctagggtgaggtcgataaaacgattacctatttcttctccgtcagtttgactaaattctagtgaagtagttgtgatgtggagattatcgctttggaagtggtgggcaaattttgattgatctaaattgcctcgggctaattgcagcaattgccatattgtcataggccatcctttccgttcagcgacgactaattccaatgatggtttctttaacgaagcacttggggcaactttaaatccaccaccgataaatggatggttgctggtaattgcgatgtaagctttaggaaaaataaagcgttcacgcccagattgaatcatcagggtaaagggctcttgatcatagattactccaattgccttttggaggtaggtgaaacgcccaatatgatttttcttgtgacgagccttaaacgtattagcacgactaacaattgccgcgtcaaaaccaatccctaaattattaagaaaataaccttcttcaccccgaatcgcctcatgataatgaccaatgttaattttttgtggtgcgtctgcagttaaaatttgatttaatgccctttgtggatgcatagaaatcccgtaaccgcgggcaaaatcatttcctgtcccagcaggaatatatccaaccgcaagtggttttttattcaatcgcttggccgtcttcataagtccattaacaacttgatgtagcgtaccatcaccaccaatcgcaatgacaattgttgatcccgcattatgagattgggcgatttggctggcaaggtattctccatgattaggatacttagttgtttccatgtgataatcaatttgttgttgatctaagaccggtttaattgacgaccatgccttttctgcattaccattaccagcatgacggttgaggatgattgaataattcatcaatattcctcctttgaatggtgccaaaaagcaaaataatatttatattcgaataattaattcagtatttttctaatgttcataagaaagttggaggctgagaaaaacaagcgtttttctcagcctctgttaatgattaaaagcttagaacgtcgtcaacttaaagttagggttttgcttttcgtaagcaagggccttttcatcaagttgttctacaaattcaatattgtagtcagtgttgtgttcaaccattaaaagtgcttcagcttctgaatcagcttcaatatacaatgattgagtgttttcacgaactgggcgttttgtcttatcagcttggtagtatactttaaaagtcatactgttaaaaactccttaattaaagatattatgcagtaatttactttattattctatcacagataaccaaaagtgtcttaaattttcctaacatggtattattaaataaaggtaaaggccaacgaggtgatagtcatggttatattcttaatctgtattttagcagcaataattgttattgctctttatttaacgatccatcgcgtatttcttaagcgagcaacgatgatggtacagaaaaacgctcaagacgttactgatgcagcgttaaatactagtttgaaagaaatgttacattggaataaaaatctaaattctcaaattgttgccgatgtttggggaaaaggtgtgcttgcttttgaataccattttgattataaaaaagaaaatattaatcttgatgatttcacacgtcaaaaactagcagcagaacttaatgaatatgcaaaacgacaccatttaaagatggctcccaaagcctctcaaccgtttattataaccgattggtggaaatatgaggggattttgcatatcgatattgcctatttgataaatgaagcaactgttgagtacattgaagatttaaaaaaattaaatcaaaatagtaattagtgaaaatggccgggagaaagtgtatttttctctcgaccattttttgtaaaaattaactaatcattactgtatctgcaggcgcctcaaatggttgatctttattaatatgatcgtaaaatagcaccccatgcaaatggtcaatttcatgctgacaaacaattgctggataatgctttaatcgtaccttatgagtttcaccgttaacgtcttgataacgtaatgtgatgcggtcatgtcgtggtacgtagccaggcacgtctttatcaactgaaagacaaccttcgccttcagtaagagcaccatattgaaccgattcactaacgattactggattaatgataacgtccttaaataagggcttttcaccttcagcaggtgcgggaacaaggacagcagccatttgctttgaaacaccaacttgaggagcggcaaggccaactccagctcgtaacttgtacttttcacataattcaggatcttggcttacttctaagtattgcatcatatcctttgctaatttttggtcttcatcagataggggaaatgagaccttagcagctcgtttacgtaaaacgggattgccatcacgggtaatatctttcattaaatacattactcactatgcctccatataaaaattcagtcatattatagtctatcataactatttaaaattgctaatgaatatgaggataacaatatttaactataaattttgaaaaaacgtatacttcacttggaccattttaacaattctgtccattaagtttatgaaagcgcttgtattatttaggcaatcggttatactataaatgtaggtaagcaatcgcttacatgatgttaattggatttggaaaggaatgttgaatatggccaataccaaagctgtcaattttgctgagattaaagccaatgaaggggtaccttatgcaaaacccgtacaaattctggataacgacggaaatgttgttaacgaagaattaatggctaatttcaatgatgaattattagttgacttaatgaaaaaaatggtttgggcacgtgccttgcatgaacaaacaatgagtttttcaaagcaaggtcgattaggtttctatgcgccaacttggggtgaagaagcttctgaaatgggaacagctgctgcatttaagaagcaagacttccttttccctgcttatcgtgatttgccacaattaattcaacatggagcaactgttgctcaaatgtacttatggtcaaagggacacatcaaaggtaacctttttgatgcacgtgctctccggccacaaattattatcggagcgcagatggtcgaaatggctggtggtgctcttggaattaagaagaatggtgaaaaggacactgttgcctatgcttacactggtgaaggtggaagctcacaaggggatacttatgaaggaatgaactttgctggtgcattccaagtacctggtgtatttattattcaaaataatggatgggctatttcgttcccacgaaagctacaaactgaaacacaaacaattgcccaaaaggctgttgctgctggaattccaggtgtccaagttgatggaatggatgtccttgcatgttatgaagttgctaaagaggcacgtgaatttgctgctgctggtaatggaccagtgctaatcgaaacattaacataccggtttggtgctcacagttcagcaggtgatgatcctactcgttaccggactgaggatgaaacaaagccatggtttgataaagatccattgattcgtcttcgcaagtacctaacgaaaaaggggctttggtctgaagaagaagaacaaaaatatgctgatgaatgcaaacaaagctttaaagaagcaatgaaagaagcagactcagtagaacctgaaaaagttagcgatatgttgaagcggacgtttgaagtaccaactccagacattaaagaacaaattaagaagtacgaagaaaaggagtcgaagtaatcatggctaaaaagacttatatcaaagctattactgaaggtattgacatcgctttagccgaagatcctaagactttagtattcggtgaagatgttggtaaaaacggtggtgttttccgtgcgactaatgggcttcaagaaaaatacggtgttgatcgagtatttagtacccctcttgccgaatcaggtattttaggaatgtcaattggtttagcagtaactggctggcgtccagtaccagaaattcaattcatgggctttacttttgaagcaatggattctatcgctgctcaaatgtcacggatacgtttccaatacaatgggactaagcatgcaccaattactattcggactccttatggtggtggtactcatactgctgaactacacggggatgatcttgaaaacttcttcgttggtattccaggattacgggttgttgcaccaagttctgcctatgatgctaagggattaattatttctgcaattgaaaataacgatccagttctttttcttgaaaaccttcgtctctatcgttcagtcaaaggtgaagttcctgatgacaagtatactgttccgttggataaagcaaatgttgttcaagaaggtactgatgttacaattatcgcttatggtggtgaagtatcagaagcacaaaaagccgctaagaaattagctaaggacaatatttctgctgagattatcgacttacgttctctttacccacttgatactgacacgatctttgaatcaattaagaagacgcacagagtagtcattgttcaagaagcgcaaaagatggctggtgttggtgcccaagttgcatcagctatttcagaaggtgcaattatgtatcttgatgctcctgttacccgggttgctgctcctaactcagtatatccattcccacaagctgaaaatgtttggcttccaggtgcacgtgatattgaggatgccgtacgagaagtaattaattactaaaagtgcggaatagaaagggtgttaatacgatatggcatacatttttagactaccagaaatgggagaaggattaactgaaggtgatgttgcttcttggctcgttaaagaaggagaagcaattaaagctgatgatcctttaattgaaattcaaactgataaatcgactactcaattggtatccccagttgatggaactgtcaaaaaattatttgtaaaagaagacgaccacgttgaaaagggcgacaagctcgctgaaattgatgatggtaagcctggtattagtacaaacgtcgaaagcgaagacgacgatgatgaaactgatacaggcagtgaagaagctactgaaagtgaaaaatccacggctccagctgcagattctccttcagaagataattctccaaagggtggagtagctccacttgcagaaccaaacaagcttgtaatggcaatgccttctgttcgtcaatatgcccgtgataagggtgttgatatttcacttgttcaaccaagtggtaaccacggtcaagttcttaaagaagatattgataactttaatgggtcagctgctccagctaaggaagaaaagagtgcagctatgtcagctaagactgctccagttgcagctaagaccgctggtaatacaatcaagccatggaataccgaccttgaagaacgtgaaccaatgtctaatatgcggaagattatcgctaagactactcgtgaatcaaaggatatctcgccacatgttacatcatttgatgaagttgaagtatctgctctaatggctagtcgcaagaagtacaaggcagttgctgcagaacaagatattcacttgactttcttgccatacattattaaggctttagttgccacatgcaagaagttcccagaattaaatgcttcaattgatgattctactcaagaaattgtttacaagcactactataatgttgggatccttacaaacactgaccacggtctctataatccaaatattaagaatgcagattctaagagcatgtttgagattgcaaaagaaattaccgaaaatactcaagcggcctttgataacaagctaagtccggaatcaatggctggtcggactatcagtatcagtaatattggttcaattggcggtggctggttcacccctgttatcaaccaaccagatgttgccattcttggtgttggtcgaattgacaaggaaccatacgttaatgaagatggtgaaattgttgttggtcgaatgatgaagttatcattgacttacgatcaccgtttaattgatggtggacttgcacaacatgcattgaactacatgaacaagttattacatgatccagaattattgatgatggagggctagataatggctgatgttgaacaaaaggatacagtaattgttggtggaggtcctggtggttatgtagccgctattcgagcttcagaattaggtcaaaaggttaccttaattgataagggagaaccaggtttaggtggtgtttgtttaaatgttggatgtgtaccatctaaagcattaattgctgctggtcaccgttaccaagaaactttagactcatctatttatggtatttctaaaaccgatgcaaagctagactttactaagactcaagaatggaaggaccataaagttgtcgaccgtatgattcgtggagttaagatgcttttgaagaagcataaagttgaaatcattgatggagaggcaattcttgataatgaccaccaacttcgtgtaatcaagcctggtccaaagcaattcatggataatgataatggtcgtactatcacgtggaagaatttaattcttgcaacaggaagtcgtccagtagaaattcctcattttaagtttgaaggtcgtgttattgattcaaccggtggcttaaaccttaaggaagtaccagaagaattagttgtaattggtgggggctacattggtacagaattagctggtgcctatgctgatcttggtgctcatgtaacgattattgaaggtactgattcaattcttggtggatttgaccacgatatggttgatattgttgtcaagaatcttgaaaagaagggcgtagacattgtaactaaggcaatggctaaagattctcagcaagatgaaaatagcgttactgtcacttatgaagttgatggtagcgaaaagagcattaaagcagactactgcatggtatctgttggtcgtaaaccaaatactgatgattttgggcttgatatgacaaatgttaagttaaacgaccgtcatcaagtaattgttgatgaacaaggccggacgaatgtacctggtatttgggctattggagatattgttcctggtcctgcacttgctcacaaggcattctttgaagctaagactgccgctggtgccattgctggtaagaatactgctaacgattgggttggagtaccaatggtttgttttgctgatccagaattagctcaagttggtatgacggttgaagaagctaaagataaaggaattgatgtatctactgctcaattcccatttgccggtaatgcccgtgctgtttctcttgatgctgccgaaggatttattcgcttaatctacactaaagataagaaaaatgttattggtgctcaaggtgtcggtcctggtgttagtgaccttgctggtgaactttcattgattgtcaactgtggtatgaatgttgaagatgttgctttaacaattcacccacacccaacattgaatgaacctgttcaagaagctgcagatattgcgcttggcttcccaacacatatttaaattttaataagttagaaaagttcttagtgatggatgactcgattttgaaatcactaagaactttttctgtttggattcttttaggccttttattcctaaatttccgtttggattgtataatacaagtagaaaatgattggagggacaaaaaaatgaattcacataactatagttatccccttgatctatcatggacaactaaagagatggaaacggtaattgccatgtttagggcggttgaagatgcttatgaagttgcgattgatagagataaaattttagattgttatcgtgcctttaagcaagtcgttccctcaaaggctgaagagaaacaattgggtcgcgaatttgaaaagaattcgggttatgttctctaccgtgttgtcaaagcagcacaagagtcaacagataagcgaattaagatggttaggcaaaaaaatgattagtattgaagagttagatcaaaaagcacaacaaataattcgtcaagcaggtcaaaatgcataccagaaaatggaaaatgattaccagattgatacaaagacgaattatactgaccttgtaacgacaattgaccgggaaaatgaacaattaataaatgatcaactacgaaaaattgatcctgatagtcaaattttaagtgaagaaggatttggcgacaaacaaataagcaatatgcaaggacatgtttggattgttgatccgattgatggaacaatgaattttgttaagcagcataataattttgctgttatgttagcattgtatgttgacggtcaaccgatgcttggctatattttagatgtaattaataatcgtctttaccatggtcgaaagggtgctggtgtttatgttaacaaccaaaaaattggccagccagctgacttaggcttgcgagagagtttgttagcgatgaatcggacattaactttaagtggtgattcagcattaaagaaaatcgctcaagacgcaataggcttacggatgtatggaagtgcgggcattgaggtgattggtgtgatcactggtcaattaggtggatatatctctaatttgaagccatgggaccttgctgctgggcgaatgttagcagaagaattagacttagttgtgaaatcaattgacggtagttctattaatgtgttatcatctaatcttgtattagtagcaacgaggcaggttagtcgagatattcgacagatcatcaattagttgtcgaggctgtgaccgcgatgtcacagtttttttatgaaattggcgattgataggccgctgctgttcgacttaaaaatgatatgacgaaagggagaatcaagttttgaaaactcgtgacgacattcgtaacattgcgattattgcccacgttgaccacggtaagactaccttagttaacgaaatgttgaagcaatcagatactttaccagaacacttctcaattgaagatcgtgcgatggatactaacgctattgagcgtgaacgtggtattactattctttcaaaaaatactgctgttaaatatgataatcaccaaattaacatcttggatacaccaggacacgcggacttcggtggtgaagttgaacgtgttatgaagatggttgatggtgtattacttgttgtggatgctttcgaagggacaatgcctcagacacggttcgtccttaagaaggcccttgaacaacacttaacaccaattgttgtgattaacaaggttgaccgtaaaggtgctcgtcctgaagaagttgtggatgaagttcttgacctctttatcgaattaggtgcagatgaagatcaactcgacttcccagttgtttacacttcagcaatgaacggtacttcaagttatgattcagatgtttctactcaagaacacaccatgaagccattgtttgatactattatcaagacaatccctgctccagtagacaattctgatgaaccacttcaattccaagttgctatcttagattacaatgacttcgttggtcgaatcggtatcggtcgtgtcttccgtggtaagattaaggtcggcgataatgttaccttaatgaaacttgatggctcaaagaagaatttccgggttactaagctttttggtttcttcggtttgaagcggttggaaattaatgaagctgaagctggtgatttgattgcggtttctgggatggaagacatcaatgttggtgaaactgtagctgatgcagaacatcccgaagcaattactccattacggattgatccacctacattacaaatgactttccggactaacgattctccattcgctggtcgtgaaggtaaatttgttactgcccgtcagcttgaagatcgtttgaagcgtgaaatgcaaactgatgtgtccttaaaggttgaagatactgatgatccaggtgcatggactgtttctggtcgtggggaattacacctttctatcttgatcgaaacattacgtcgtgaaggatatgagttatctgtatcacgtccacaagttatttaccgtgaaattgatggagtaatgagtgaaccatttgaagaagttcaaatcgatactccagatgaatatactggtgcagttattgatagcctttctaaacgtaaaggtgaaatgaagaacatggaaccaggcgaaaatggtcaaactcgtcttatcttcttagcaccatcacgtggcttgattggatactcaactgaatttatgactatgacccgtggttacggaatcatgagccatacctttgaaaaatacgcaccagttatcaagaactggaaccctggtcgtcaaaagggtactcttgtgtccatgaatgctggtaaggctactacttacgcaatgatgggtatcgaaagtcgtggtcaattattaattgatccaggtacggaagtttacgaaggtatgatcgttggtgaaaacagtcgtgaaaatgatattactgttaacatcaccaagggtaagaacttaacgaacgttcgtgctgctggttctgatgaaatggctcacattaagacccctactcacttctcccttgaagaatcactcgaattcttaaatgaagatgaatactgtgaagtaactccagaaaatatccgtttacggaagaagacccttaacacaaatgcccgtgaaaaggaagctaagcgtcgtcgtgctgcttcacggaagtaaatatttaaaaaagcttgggaggctaactagctttccgagcttttttttgttgtataataatgattgtattttgtttttaggtaggtgcactttgtgaagaaaaagaaattaagattccgtaagattcgttctgtatggaataacgtccgctaccttgattattatattttagttccttaccttgctttatgtttagtaggaattgtaatggtctattcagctagtgcttccattgaaatgcaaaatggtggaaccccattaggatatttagtaaaacaaacaatctatgttgtaatgggagttgcggtaatggcatttatggcaaattatcctttgcggcattatcgaacgccaaggtttttacgagattcaacattggtagttggtgctttacttgtcattgttttggtttttagccgggctgttaacggagctaaaggttggatatccttgggcttctttaatattcaaccggtggaaatttgtaagctatattttatcttatatttagctgatcgaatggctaaaattaggcaacgtggacaacattttaccactgatgctaaaggtccttggctcataattgcagtttttctcgggttgattatgattcaaccagatattggaggaatggcgattaacggagcgattattgcaatcatgcttttagcggcggattataaatggggcgttggtttggaaataattcttgtcttaccagcgcttggctaccttggattggaacgactagttgaaagtggtttgcttcaaggcggtggataccaagttgcgcgttttgttgcctttctaaatccctttggaaatgctagtggttcaggaaatcaattagttaattcctattatgcaatcagcaatggtggtgtatttggggttggacttggaaatagtattcaaaaaatgggatatttgccagagcccaataccgactttattatgtcaattactagtgaagaattgggtctagtcggagtaacggcaattttagttactttactctttttgatctgtcgtattattcaagttggggtgcgggcagatagtttgtatcaaacgctcatctgttatggctcagcaacattctttacgattgaaacactctttaatattggtggagttctaggactcttgccgattacgggggttaccttcccatttattagttatgggggatcaagtatgttgattctttctgcaacggtaggcattataatgaatattagtatgcagcaaaatcgggatcgcttggttatggggaaaccatttattcctgaaacaggaggcgtaaagaatgtttaaattaattccacggcgttccctaataatttacattaacaataatcgtgtgattcgagctcttcgtcattatggtcagattgattatatttcccgacgaatgcattatgtggtaatgtatgtagaccaaagtgatgtcgaaaaaataaaagagaagataagtcgattacgcgcagtgaaaaaggttgaattatcagctcggccagatttagacccgacgttagctgatcttgaattaacaggggtctatcaattacatgatgaggatgataaaaaatgagaattgttgcaggagacttcgggggacgaaagctaagtgctgttccgggaatggcaactcgtccaacaactgataaagttaaagaagcattatttaatataatcggtccttactttaatggcggaaccagtctagatttgtttgccggaagcggtggattaagtattgaagctgtatcgcgcggaatcagtcaggcagtcttagttgatcgtcaatatcaagcaatcaaaacaattaagaagaatattgacgttacaaaacatgttgaacaatttaaagtttataaaatggacgctcacaaagcgttgaatttgtttgcaaaagacaaattgaaatttaacctggtctttttagatccgccctatgctaaacagcaaattgttaatgatatggagcagatggttaaaaataatttgctagctaaagatgcaataattgtggcagaaacagatcagaatgcgaaactgccgacagatttagctgagtttaactttattcgtcgtcaagaatatggaattacggttttaacaatttatcaatataaaggagaatcaaaataatgaaagttgcagtttttcctggatcatttgacccattaacacttggacatttagatttaattaagcgaggaagtgcgttgtttgatcaattggcagtggcggtaatgactaatgaaagtaaaaacccgctgtttactgttgaagaacgagtagcgcaaattaaagaggctgttagtgggctagataatgtttcggttattacaacggaaggcttaactgttgatctaatgaaccgcattggtgcagattacttaatgcgtggtttgcgtaatactactgattttcaatatgaacgtgatattgcggcgatgaataactttttagatgatcagtgtgagaccgtctttttccttgctaagcctgaatatcagcacttatctagtagtttgctgaaagaagtaacatcggctgggggagatatctcagcttaccttcccgctaatattaatgaagcactaaaaaagcgtttaatggaacgagaaatgttacgggttaagaaagacaatgaaaaagcaagataatgtaatattgcgacggataggaattattttagggcttgtccttttactaggctgctttttgttctggcccctaaattcttatattgaaagtccgggaacagctgctgatttacagtcttttgttaaaataaagggacaccccgatcgatataagggaagttttatgttgacgtcggtggcgattcaacgtgcccatcctgcaacatatttatatgccaaaatgatgccctatatgtcaattgagagtgcggaagatgtaactggtggtcaaaatagtgcaacgtatgaccgtgtccaaaaattttatatggatagctcgattaacgaggcaattgcagttgcttataatgccgctcaccaaaaagtaacgcgacgctatctaggaatttatgtattgcaagttcagcctaattctaaatttaaacatgatattcatgttggggacacaattacaaaagtagatggtcatcactttaataccgctcaaggctttcaaaaatatattggtgctaaaaaagttggcactccgttagtggttacttatactcgagatgggaaaactaaaactgtcacccatccgcttgttaaaattaccaatactaataagccaggaattgggatcattcttactaacaatatgcaagttaagactaaggttccagtaaaggttgatgctggtcaatatggcgggccatctggtggcttaatgttcagtttgcaaatatatcaacaaattagtggaaaagatttgcaacggggacgtaaaatcgctggaactggaacaataaattcagacgggaccgttggagaaattggtggaattgacaagaaagtaatcgctgcgcaccgtgcgggagccactattttctttgccccttatataaaaccaacgaaagagattcttaagtatgaagaaggtcatctgactaattatcaaatggctaaaaaagcagctaagaaatatgcaccaggaatgaaggttgtccctgtcacttcctttgacgaagcagtgaaatatttacaaacgcataagtaaattgaaaagcaagaggcaaaatgaaggtctcttgctttttttaatgcaaaatttattttttttcgtatttatatttatagggaggtgagaaacatgcagcaattatcagaattatggataaaatatcgagtacaagtgctgatgatagtgattgctgcagtagttgggggatattggatacttaataaaaataataacgatgctttaatttcaaatactaatgctgttttaacaagtagcgaaacaggaagtagtttaacttctaccactacgatgaaagggaccgttgcaattgatataaagggtgccgtaaaaatgcccggagtttatgaattgaaagcagatgatcgtgtgaacgaagccttgaaagcggcaggtggaccactacccaatgcagacttgcgccaagtaaatcttgctaaacaattaacagaccagcagatgatctatattcctcttcaaggcgaaacgccaatagtttccagcagtacagaaccatcagcagctaataatgaaaatggcagcgatagttctgcaaagataaatctaaacacggctaccaaagaacaactatgtcaaattacagggattggcgataaaaaagccgatttaatattgcaatatcgacaagaacacggtcaatttaagagtattgacgaacttaaagaaataaatggttttggcgaaaaaactgttgctaaactaaaagatcacctatctatctagtttttatttttttgatgaagatatttgctatactatatttcaaatatagaggagtgaaataatatgaaaccgagaattgattgggaccagtattttatgattcaagcagctttattggcgtcgcgaagtacctgcaaccgcctttcagtaggtgcagttttagttcgtgataagcgaataattgccggtgggtacaatggatcagttgctggcgatgcacattgtattgatgaaggctgctatttacgtgatggacattgtgtacgaactattcatgcagaaatgaatgctcttttacagtgtgctaagtttggtatttctgctgatggggcaagtatttatgtaacagattttccttgtttacaatgtaccaaaagtttattgcagactggaattaaggagataaattatattcgtaattatcacaatgatgattatgcaatgaaattacttaaactaaaaaatgttgcgcttcatcagattaaattagatagtgatattttagaagaggtcgatctggaccagtatatcaacccagatcaaaaatagattattcaacacttttggttttttcctgcgctaattgcaagtttagtagcggttagtttctttagttcatattggttaatttttcttttaattgctatattttaccgaattgccgtattaaaaaggccaatagtacttggagttggagtgctgatatgtttattgatggcgattttatgttacagtttacaaaaaaattggacaactattacggcgaataagcaaatggaagttactcaaaaaatattagtttaccctgatgaattaaaattcaatggaaattttatgacaggaactgcaatcgacattcaaactggacaacgtgaagcaataatgatgtcgtttaagtcaccccagatgctaaaaaatattgataagcttacaacaccctcgatatggcttattaatgggcaattaaaaccgattattccccgtacaaatgaaaatcaatttgataatttgacttataatcaccatcgccggatctgtaatcaagttcaaattaaccgggtagagcaaatggttaggcaaaaaagaggaatagttggctggtgtcatacattaagaaagcgaatcagcctctactttgaaactttaccgcctcctcttagtacgtattgccaacaattaataattggtagcagtaatgaggattcggctgaattaatggtaagtattaaaaggcttggtctgcttcatcttttttgcatttcaggaatgcatatcgtgcttttcactgatttattacggcggctgttagttcatttatggtggcgtaaagaatcaattgatttatttttaattatcattttaccgttttatcttctcgttggtggtggagcaacaagcttgataagagcaaccattatggctgagcttggtcttcttcatcgatatttaaatttggacagtcttgatggatgggcactgagcttattaattggattagttattgatccgttgctattgcttacattaggcggtcaattaagctatttgctttcttttattcttcaagttcttccagaatcagtacgtggttttaagcagtctttattattgaatttaattagtttgccttcgttattgagttatgtatatgaggttcatcttctgagttttggggttagttatttaataattccgctattttcgacagttgtttttccagcggtcttggttggggcacttagttttaagctttttgaaccactcgcgtatctaattaatgctggtttaaaatgttttcaatatattttaaattggttatctgattttccaggaatgattcattttgggaagccaccgttaattttggcccttctattatttgcggcatctttatttgttatttctcaagagacatctttaaaatcatggaagatattagccttattgtatgtaattactggagggataattcattttccacttaatggcgaagttacctttgttgatattggacagggggactcgataattattagagaaccttttaatcgacgggtaacaatgattgatacaggaggcaaattaaattttaaaaagccggattgggcgacttcaaagcattctcaagatgatgcccaacgaataaccattaattatttgaaaagtaaaggcatcaggcaaattgataatatttgtttaactcaccatgatgcagatcatatcggctatttaacaacgattttggataatatagcagtgaaaagactgattgtcccagcggggatggaaagacaaccagcacttcttaataaagtaaggactgctgaaaagtcatcgccaatgataattccggtgactgataatgttaagttgtcatcatttccattgcaaattctacatccttttgttccgggtgaagggaaaaatgaagattctttagtgttagctgggaaatttggtgggaaaagattcctttttactggggatttggaccaggaaaatgaagaaaaagttattcaaaagtatccgcaactaaagtcagatatcttaaaagctggtcatcatggcagtaaaactgctagtagttatttatttttgcagacagttgctcctaagtatgcgataatttcagctggacgatttaataggtatcgccatcctgatgaaataacaataaaaaattttcaaagattaaatattaattacttatcaacgcagcaatttggaatgatacaatatgtataccatggtcgaaatggaaaaataaaaacaacattgaggggagatgagacaagttggacattgcccaattatctacacaattaaaaactaaaaccccagcaatggtatatttaattttagggaaacaacaggtccttcaacagcaggcaattgatgcctttataagccttattccagagaatgaacaggttatgaatgttggtcgatatgatatggaagccacaccattggcagttgctttggatgatgcgatggcgactccattttttggtgaacgacgattagttattatcaataaaccgttcttcttaactggtgagaaaagacattcgaaagttgaacatgatttggatagcttaaaaaagtatcttgaacaccctgaaccgtctacaattttagtttttgcggccccttatgaaaagcttgatggacgaaaagggattgtaaagcaattaaagaagacagcagttttagttgatgctagtccacttgatgaacgagcagctcgtcaaagagtgagaactcaattatcaactgctggttttgaaatatcagaagctgctttggatgagttggttcaacggactaatgcggattatgggatgatggatgcaagcttaactaaattaaagattttggcttaccatgaaaaaaagattgatcaaaacatggtagccgctctagttccgcaatcattagatgaaaatgtatttgatttagtcactgcggttcttaagcataatcaaataaaggccttagatctctatcaacagctattagcgggccagcaaccgccgttaaggattaatgcagtgctagtagggcagtttcggctgttgattcaaataaaagtattaagtaaacgcggccttacgcaagggagtctagcgagtcagcttaatgtccatccttatcggattaaattgggattaaaaactgcgcgtgatttctcaatgcaggcgttagaaaacgcctatttgggattaattcgtattgaacaatcgttaaaaacgacacaacgcgatccttcacttttgtttcagttatttatgttacagtattctcagcagagcaaaggagcatgagatacaaaaagaggataagaaaatttgttttcttatcctctttttgcgaaaagttaaaaataaaaaagcaactaacttaatagttgcttttttattacttagcgtaacgtgctgagagacgtgacttgtcacgtgcagccttgttagccttgataaggcccttagagtgggcacggtcaattgctgagatagcagccttgtataagtcgtcaaggttatctgcgccagcaagctttgccttatcgaacttcttaatagcagtccgcatttggcttaattgtgaagcgttacgtgcttcagctttttcactagtacgaacacgttcaattgctgatttgataattggcatgagtttcacctccgttacccgattttcagttgaccagaattttcaacatttgtcattatacaaaagactagcgagcaatgcaatagctaacgacgatcaagtcaaaatttcatagaaatagttgcaacattagtaaattttatgtatatttgtataggttacttcaaacaagtaattaattgcctcttctcagtttaacgatcctcaccgacgttatacttagatcttaggcgcattaatattgaaaggtgggaaaatagcatggctatttcaaaagaacgtaaagatcaaattattaaggaattcgcaactcacgaaggagatactggttctactcaagttcaagttgctgttttaactgctgacatcaacgaattgaacgatcaccttcgtacacacaagcacgattatcattcacaacgtggtttaatgaagaagattggtcaccgtcgtaacttattagcttacttacgtcggactgatttacctgcttaccgtgaacttatccaaaagttaggtttacgtcggtaatattttattatcaaagcactttgccttctacttggaggcaaggtgttttttgtttttactccattattttcactgattgtggtaagatatttataactataatgaacgatataaaattcttatcgctacatattgtaatcgataaggggttcaaaactaaatattaaaggagccaaatcaatggataataatattaaaattattccttttggtggtgtacgcgaaaatggtaaaaatatgtacgccgttgagattgaagaccaaattttaattttggatacggggttaaagtatcctgagaatgaattaatgggaattgatgttgtcattcctgactgggaatatcttcgtgaacataagaacaagatagtcggggtattcttaacacacggacatgcagattcaattggagcactcccgtatttcttgatggactttaatgttccggtatttggaagcgagatgacgattgccttagcaaagctggcagttaaaaaccataaggaagttaagaagtttaatgattttcatgttgttgatgcgtcaacagcaattgattttaatgatgttacagtttcattcttccagacgacccatactattcctgaaactttaggggttgttttagaaactaaagcaggaaatattgtttacactggtgattttaaattcgatcagacagctaaaaagggttatcaaacagaccttgctcgtttagcggaaattggatcacaaggtgtattagcacttttaagtgattctgctggggccggaattacgggtgcgtctgctcgtgaacaagatattggagactatattaaagaaacttttaaatatcaaaacggtcggattattgttgctagtgtagcttcaaatattatgcgtgtacagcagattatcaatgctgctgtagccgttggccggaagattgttttatctggaaaagacattgaacaaattattgatacagcaatgtctttgggaaagttacacttaccagatgacttatttattagtcgcaaggaagcagaaaaactcgaaccaaaccaagttgttattttagaaactggtaaaatgggtgaaccgattaagtcattacagcaaattgcaaacggcgataatcctaatttacaattaacgagtacagatcttgtctttgttactactactccttcttatgcgcaggagactgaggtacaaaagacaaaagatatgatttatcgtacgggagcagaggttaaatttatttctgatgatttgaatccttctggacatgctaaccaaaatgatgaacaattaatgttgaatttcatgaaacccaagttcttcattccaattcaaggtgaataccgtctgttagatcgtcatgcggaattagcagaagaagtaggagttccaaaagaaaatatcttcctcgttaataagggtgatgttctgacttacaaaaatggtaaattccatgttggagaacatattgatgtaagtaatactatgattgacggaacaggtgtcggtgatatcggtaatattgttttacgagatcggcgcgtcctgtcagaggatgggatttttgttgtggtggcaactattgatcggaaaaagaaaaagatcgttgctcgaccacaaattacgtcacgaggattcgtgtttgtaaagactaaccgtcaactaatgcaacagagtgctgacttagttgaaaagattgttcaagaaaatctagatcaaaaggaatttgattggagtcacttgaaacaagatgttcgcgataaattaaaccgattcttgtttgatcaaactaaacggcatccagttattttgccagttattatggagattaatcaacatcaaaagaagattaaaaacaatgttgagaagaaagaagagaaatctgcgaagtcacgttcaacgaaagagcatcatcgtggtcgtggtaaaaaacgaatggcaaaagaaaagaagtagctgtttaatataagtaatgtgaagggaggctgggagaaaactttcgtttttctcccagcctcaactgcttttatgaacaattgtataaagtaatgaaataaaaaagggtgataaaaatgaacgaaccccaacaagatcaatatctccaggctcaaaaattaattgctgaagaaaaatggcaagaagctagtaatattctggaagatcttataaacgaggttgatgattcagaaatcggtcgattgacgataatcgctctgtatcattctcaacaatataccagggcttgtacttacttgtttgagtatttagaagtaatgtttgatagcttggcagatgctcaaattgccattaaaattttgtgtcaaaatgaattatttgttttagcaagacagatgattagtagtctttcgcaatggcaggaagatttgctgacaattgttacaatgggggaggaaaaatctcgtcaagagtaccaggagacattacaaacacgtttgcgagacttttatcatttaggagattactcccttgaagagcagcaaagtaggctgcaggcggcttttaaacttcctttaaatgaatttattacaggcgctaaattcctgcttcgtgatccctacactcatccactggtaaagtctagtttggttgagctgcttagtaagttacaagttgcagatccggttactgtttattggctagataagagagaatatacagttgtgccagctgatattcagcctttaaatttattgccagtcgttagtgaaggtaagagattaattacagaaaagtgtggaaatcaaaacccgcagacagaaaagatggcaattcaagaatttcaattacaggtaatgttcttatatccgcgaattaatcaaattattaaagatattgatgaatggacagatgttttaatcgctagaatagaaggaaagaaagtcgcaacaaatacggtttctagtacgtggcaggaacgactaggtaagcagattgacgaattaatagaaaaacattagtcaaatacatttacaaatgaacagatagttgatattatatttaagaattcttcttcagagcctaagattaaagctttcaattggcgaaaagaagttgtacaatatgtataaaggtatgtcagtcaccgaatcagatgatctggcattatacttgtaaattatcaggaggttttcattaatggctgaaaaagaacattatgaacgtacaaaaccccacgttaacattggtactattggccacgttgaccacgggaagactactttaactgctgctattacaaaggtattggcagccaaaggtttagcaaaggcagaagattacgctgatattgatgctgctccagaagaaaaggaacgtggtatcactatcaacactgcccacgttgaatacgaaactgaaaagcgtcactatgcacacatcgatgcccctggacacgctgactacgttaagaacatgatcactggtgctgcacaaatggatggtgctatccttgttgttgctgctactgatggtcctatgccacaaactcgtgaacacattcttcttgctcgtcaggttggtgttcaatatatcgttgtattcttgaacaagactgacttagttgacgatgatgaattagttgacttagttgaaatggaagttcgtgacttacttagcgaatacgatttccctggtgacgatgttccagttgttcgtggatctgctcttaaggcacttgaaggtgacccagaacaagaaaaagttatccttcacttgatggatgttattgatgactacatcccaactccaaagcgtcctactgacaagccattcatgatgcctgtcgaagacgtatttactatcactggtcgtggtactgttgcttctggtcgtattgaccgtggtactgttaaggtcggtgacgaagttgaaatcgttggtttaactgaagacgttcttaagtcaactgttactggtttggaaatgttccacaagactcttgatcttggtgaagccggggataacgttggtgtacttcttcgtggtatttcacacgaccaaatccaacgtggtcaagttttggctgaaccaggttcaatccaaactcacaagaacttcaagggtgaagtttacgttatgactaaggaagaagggggacgtcacactccattcttctcaaactaccgtccacaattctacttccacacaactgatgttactggtactatcgaattaccagatggtgtagaaatggttatgcctggtgataacgttacgttcactgttaacttacaaaagccagttgctcttgaaaagggtcttaagttcactattcgtgaaggtggacacactgttggtgccggtgttgtatccgacatcttagactaatttttgagtacagatgtgctgaaaggcttggggaaacccaagtctttttctttaacaaaaatatttgaaaataacttggggatcagccgtcaataagttgcaattactggtctcctacggtaaactaatatagtatgtaaagactagttataaatattaattagtcaaattgatttgttattggaggaaataaaatgtcagcaaaatgggaacgcgatagcgatgccagcaaaggtacattgacatttgaaattgatgtcgacactattaacaagggaattgacgaagctttcgttgagactcgtaaaaagatcactgttccgggcttccggaagggtcgtgtccctcgtcaaatctttaaccaaatgtacggtgaagaatcattgtatcaagatgccttaaacaaggtattacctgatgcatataacgaagcagtaaaggaaactaacattcaacctgtagatcaacctaagattgatattaagagcatggaaaagggtcaaccatgggtattaactgctgaagttgacgttatgccagaagttaaattaggtgaatacaagggtatggaagttcctgctcaagacaccactgttactgatgctgatgttgatgatgcacttgaaactaagcgtcaacaacaagctgaacttgtattaaaagaagataagccagccgaaaagggcgacactgtcgttattgattacaagggtagcgttgacggtgaagaatttgatggcggttcagctgaaaactactcactagaattaggttcaggctcatttattccaggttttgaagatcaattaatcggtcacaacgctgatgaagatgttgatgtaaatgttaccttcccagaagattaccacgctaagaatcttgctggcaaggatgcacttttcaaggttaagattcacgaaatcaaggaaaagcaattaccagaacttgacgatgatttcgctaaggatgttgacgaagatgttgatactttagctgaattaaaggaaaagactaagaagcaacttcaagaagaaaaggataaccaagctaaggctgctattgaagatgctgctatcaataaggctgttgctaatgcagaaatccaagatattccacaagcaatgttggatgatgacactaaccgtcaaatgcaacaatacttagcaggaatgcaacaacaaggtatcagtcctcaaatgtacttccaaattactggtacaaaggaagaagatttgaagaagcaatttgctaatgatgctgctcaacgtgtaaagactaaccttgtcttagaagcaattgttgacgatgctaacttagatgctactgatgaagaaattgctaaagaaatttctgaccttgcaaagcaatacggtatggaagaagatgctgttaagaaggcattatctaaagacatgttaatgcatgatattaagatccgtaaggctgttgacttagttgctgattcagcaaagcaagttaaggatgacgaaaagtctgacaagtaatttgttaaataattactaatcaatgaggctggaagaaaacagtagttttcttccagcctcgctattttaatcaaatattagtaagataaagtagaaaataatttactgagtaatttgtcgaaattaaacagtaattttgttattatgttttaataagtcttagaggaggttcatttatgtttgaagataccactggtatggattcagttcactgttcattttgtggaaagtcccaagatgaagtgaaaaaaattgttgctggtcctggcgtctatatttgtaacgaatgtgttgacctttgtaaacaaattattgatcaggaactagcagaagatgaagctaaaaaagctttccgtgtgccaactccaggagagattgttaacgaactggatgactatgtaatcggtcaaggtgatgctaaaaaaacattagcagttgctgtttataaccactataagcgggttaatgcaatgatgagtggcgataataatgatacagaacttcaaaagagcaacattgccgtaattggtccaactggttctgggaaaacctatcttgcccaatcacttgcgcgaattctaaatgttccgtttgcaattgcagatgctacaactttaactgaagctggatacgttggtgaagacgttgaaaatattatccttaaattacttcaggctgctgactttgatgtagaacgtgctgaaaaaggaatcatttacattgatgaaattgataaaatcgcaaagaagagtgaaaatgtatcaattacgcgtgatgtttctggagaaggggttcaacaagctcttttaaagattcttgaaggaacaattgctaatgtaccacctcagggaggacgtaagcatccacagcaagaatttatccaagttgatacgaagaatatcctctttattgttgggggagcctttgatggaatcgaaacaattgttaaggaacgactcggtgataagacaattggatttggaacagactcacgagaagctgaagaggttacggataaaaatattttgcaacatgttatcccagaagaccttcttaagtttggcttgattccagaatttattggacgattacctgtgatgactgctcttgaaaaacttgatgaagatgaccttgttcgaatccttactgagccaaagaatgcattagttaagcaatatcaagagttaattcgccttgatggaagtaagttgacctttactgatggtgcattacgagcaatggcacaactagcaatcaagcgaaatacaggtgctcgtggtctccgttcgattattgaagatgtaatgcgggatgtaatgtttgacttgccaagtcgtaaagatgtagaaaaggtaattattgataaacgatgtgtaacgcaacatacagaacctcgttacgttttaaaggatgaaaaagcttcttaatgaaatgaggtaagcaaatggaagttcacaatgtagatttaacaatcagtgccgtaagtgatgaacaatatcctaaaacaaatattccagaaattgctttagttggtcgttcaaatgttgggaagtcatcgttgacaaatgtcttaatcaaccggcgcaattttgctcatacgtctagtcagccaggtaaaacccagacattaaatttctatgacgttgaggataaggtatattttgtcgatgttccaggatatgggtatgccaaagtctcgaaaaaagagcgagaacgatttggaaaaatgatcgaacaatacttaacccaacgtgaacaattacgcggagttattcaattagttgatgcacggcatgaacccactcctgatgatgtaaatatgtataattggttacaatattataatattccaacattaatcgtagggacaaagattgataaggtaaaacgaagtgcatggaatcgccaactaagccttatcaaaaagacccttgatgttgagagttcaacaccgattattctattttcagctacagagaaaaggggtaaagatgatgtttggcagtggattgaagagcgaatggggaagaactaagttggattttaatgaataccaaaatgcagcaaaacgaaccttatatgggaatgaacaagttttaacaaattgtgcattaggattagctggtgagtcaggacaagtcgttgatttagtaaaaaactatacttttcgtagtcgaaaattagatcgtaaggaactaatccacgaaatgggtgatgtcttatggtatttatctcaaattgcagaatgggccgatattccatttgaagaggttgccaaagcaaatattgaggaattaaatcagcgctatccgactggttttaaaaagcaagattaaaaatagagagtggaaaatagccttctcgacaaagcagttggctaagctagggcgatgattagcacggcacgggctgattatcgttcgtacttagactcgagccttgtggcgacgcgaagttagttccacgttactattgttcataaaagtagtggaggctgggagaaaacaaaagttttctcccagcctcctttgcatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattatttcttttctttatccttgctatctttttcttttttatcgtcattttttttagttgcttttggttttttaggatcaaccgcaaattgatcaaataatttatcaagctgttcgcttcttctagtaactaatcccatttttttagctccttttttatatttgacaaaatgctagcataaattttgctaaatgtacaattatttctaaacactttctttgccttaatgatgatttttcagatataatatattgttagataatttttcggagggattttgcgatggccagtgaacatttagaacataaactagcattgttacctgacaagccaggttgctacctgatgaaaaacattaatgatcagataatttatgttggtaaagctaaaaatttaaaaaatcgggttcggtcttactttaagagtagccacaccggtaaagtagctaaaatggtttcagaagttgcggactttgaaaccattgtaacttcgactaataaggagtcgttcttacttgaaataacgcttattcaaaaacatcaaccttatttcaatatcaaattaaaaaagggaactggttatccctacataaaaataacaaatgagcgggatcctcaaattaagatcgttagtaaaataaaaaaagatggtggatattattttggcccttatccaaatgtctatgctgcggaggagacgatgcattttattcaaaaggtttatccattaagacgatgtaatgggtatcaaggccgtccgtgtttgtattaccatatgggacaatgtttaggagcttgttttaaagacgttcctaagagcgaatatgaagagcaaattaaaaaaattaagtcatttttaagtggaaatacagcgacagttaagcgacagttaaccaaaaagatgcaactagcagcagaaaacatggagtttgaacgagctgctgaaattcgagaccagcttcactatattgaagtgacagttgaaaaacaaaagattatttcaaatgataaaacccctcgtgatttatttaatttctatatggataaagggtggctttctattcaaattttctttattcggcaggcgcggttgatgaaacgagaaaaacgtctatttccaatcgtggatacggcagttgaagaaatgactagctttattctccagttttataatcgtcgcaataatattttgcctcgtgaaattcttcttcctaagggccttcccaataaagaaataagtgaaatattaggggtaccagttcggacaccggttcgtggtgaaaaacgggacctcttagcaatggcacatgaaaatgctcagttgtctttagatgaaaaatttcgactgcttgagatggaccaaagtaagactaccggtgcgatgaaagagattacggatgcccttggacttccagaaggtcaccggattgaagcgtttgatcattctcatattcagggggctgatcctgttagtgcaatggttgtatttgttaatggagaaccagctaaaaatttttaccggaagtataaattgaaaacggtgattaatcatgctgacgaagctgccagtacccgtgaagttattcgacggaggtattcgcgtctcttaaaagagaataagccaatgccggatatgatctttatggatggtggcgaaattcagatggatgcggctaaagatgttttagagaatgaacttggtctcgatattccggtagtagggatggtaaagaatgataaacaccaaaccgctgacttattgttcggggatgatgatcaccatattaatttgaatccacggagccaaggcttttacttagttcaacgcattcaagatgaggttcaccggtttgcaattactttccaccggcgcgttcataccaagcattcgttaagctcgcgtttggatgaaattaagggagtgggaccccgaactcgaacaaaattgcttaaaaaatatggatcaattaccaaaattgctcaagcctcagttgatgaaatccattcactaggaattaatcgacctaccgcccagttaatcaaggtttcattgcagaaaaatgctgaggttgctaagggtagtagtcatgattgagttttgacaggcttgtaaattttaaatatactaaataatagactaaagaacggagacaatcattatgaatatgtttgttgatcaaataaaaattgaagtacatgcaggtaagggtggcgatggaatggtagcatttcgtcgtgaaaagtatgttcctaacggtggccccgctggtggtgatggtggccgtggtggtagcatcattttaaaagttgatgaaggattacggactttaatggatttccgttatcatcgaatttttaaagctaaaaacggtggtaatggaatgagtaaacagatgactggtccaagtgcagaagatacaattattgctgttccccaaggtactaccgttagggaccttgataccggcgagattattggtgatcttgttgaaaaagaccaagaattagtagtggctaaaggtggccgtggtggtcgcggcaacattcactttgctagtgctaaaaaccctgctcctgaaattgctgaaaatggtgaaccaggagaagaccattacttagaattagaattaaagatgcttgctgatgtcggattaattgggttcccttctgttggaaagtcaactttattatcagtagtaaccggtgctaagcctaaaattgctgcatatgaatttacgacattaactcctaatctcggaatggtaatgctaccagatggccgtgattttgcgatggctgacatgcctggtttaattgaaggagcatcgaagggtatcggtcttggattgaagttcttacggcacattgaacgtacccgcgttcttcttcacctagtggatatgagtagtgaagatcctcatcaagcaattgaacgttaccggcaaattaataaggaacttgctaattacgatcctgaattattaaagcgaccacaaattgtagttgcgacaaagatggatttgccaaattctgccgataacttagctgcttttaaagctgatttggcagcagataagactttagaaaagcagccagagattttccctatttcagcggttactcatcaaggtgtccaacaattaatgcaattaacggctgatctcttagataagacacccgcatttgatagtgagagtcatgataaagaattggtcgctgaatatcgtgctgctgctcctgacaagaaggatgagacggactttaccattaccaaggatgaagacggcacctgggtattgggcggtgaaaaacttattcggttatttaagatgactgatttaactcatgaagaaagtcaattacgctttgctcgtcaacttcgccatatgggggttgatgacgcgttaagagctaaaggtgtacaagatggtgatcttgtaagaattgaaaaatttgtttttgaatttattcaataaaattatacgtagcaaaggtaggaaaaatataaatgcaacttgaatttttaggaacaggcgctggttccccaagtaagcaacgtaatgtagcaagtgttgcattgcggttgttagaagaacgaaacgcaatttggttatttgatgttggagaagctactcaacatcaaattctcaatacgacaattaggccacgaaagatagaaaaaatctttattactcacttgcatggtgatcatatctttggtttacctggtttactaagttcccgctcttttcaaggaggaaccgaaccattgacgatctatggaccaataggaataaagcggtatgttcagacttctttgcaagtaagtgagtcacgcctcagttatcctttgcattttgttgaaataacagatgacggggaactatttaatgatcatggttttagagtgattgcacgaaagttggatcacaaaattgcttgttttggataccggattgaagaagcggatcatccaggagaattacaagttgaaaaattacgagaacaaaaagtaccatctgggccaatttacggtcaactaaaagctggaaaaacggttactcttcctgatggtcgcgtattagatggtcatgactttattggcactcctcaacctggacgaattattgcaattttaggcgatactagacaaacaaagaatgcaattttgttagcacaaaatgcggatgtattagtgcatgaaagtacttttgctaaagatgagacgaagatggcatacaattattatcattcaaccagcaaacaagcagctgaaattgcaaaaaaagctggtgttaaaaaattattgttaaatcatatttcagcacgatacaccggtaaagcagcctatcaattggcatatcaagttcgtaatattattcctgatactcgagttgttaatgattttgatgtgattgatattccgtttaaaaaatgaaaagagatggcaaaaaatgctgagaagagtaaagacgttacgttttctgcgaaatgaagttgtattaattactggtggttcaagtggaatcggcaaagagttggcttttgaggcagctcgtcgtggtgcaattgttgttgttgtttctcgtaaccttgagaaattgcaagaggtagccaagaaatgtttaattttatctggtcggccagcatttgcttatcaattggatgtcaccgaccctgatcagattgatgatgtgctttcgaaggttcaacatgaagtaggaggaatcgatgtattaattaattctgctgggcttggtgactttattcccgtagttaaggaatcttacagctcaatggaaaaaatggtacatacgaacctcttagccttaatgtatattagtcggtgtgtagctaaacaaatgatggatcaagggtatggggccattattaatatgggttcattagctggtaaattacctacaccaaatagcgctgtatattcagcaacgaaggctggggtaatccagtttgataacgttttacgaatggaagttgctgattatggtgtccaagtgttgacaattaatcctggcccaattgatacacctttctttgataaagcggataataattatacgtatcgggcccatttaccaaaatggatatttatctctcctgaagacttagctcgacgaatttggaataatgttgggtataagacgagggaaattaatgttccaggatatgtggcttgtcttggctgggcttaccaagttattcccggtttaggtgactgggcaattaaaaaattttttgatttccaacaggataagaagaacttataatatgctcccttattttcgagagattacagaatttaatagtcttttcaaaaaatgaaaggggcaaaataaaagagactgagtttatcccagcctcttgtttaattttggcgttgaaatggtggttaattttaaatgattgatgcaaaatttaagtgggaacttgccgataatgcttcctcagcaactgttgataatcttgaaaaagagttaggcatttctagaatattggcaaccttattagctcagcaaggaatcgattcaaccgaacaagcaaaaaaattctttgaaccatcgatagaagagatccatgatccaaccttattgcatgatatggataaagcagttgagcgaattgagcaggcagttgaaaagcaagaacaaattactatttatggtgattatgatgccgatggaattactagcacatccttaatgtatgaaacgttattatctatcggtgccaatgttaattattatgtcccaaatcggtttacagatggatatgggcctaacatggacgcttaccaacgccttattgacaatggtacccagctttttattacggtggataatggcgttagcggaaaaaatgttatcgataaggtaatggaagcaggagtagatgttgtaattactgaccaccatgagttgcctgctgacttgcctaatgctgttgcgatcgttcaccctcgctatcctggtagtaattatccttttcctgatttgtcaggcgttggtgttgcatttaaggtggcctgggctttaactggtgagtttcctgttgaagaactggacttagttgcaattggtgaaatagctgatgtagtaaacgttatggacgaaaatcatgcgttaatttcctatggcattcagcaattacgacaggggatgcgtccaggattagcggctttaatgaaattagctgatattaaagctaacaatctaactgatcaggatattggatttggaattgcaccacggctaaatgcgcttggccgaattgctgatgctaatgatggagttaagctgctgacgagtttagatgagaatgaatcacaaaaattagctaaagaggtcgatcaggcgaataaagaacgtcagaacctagttgctgatattatgaaagaggcagaagaacaagctaatagttcagctaaccagcagaaaaagaccttattaattgttggaaaaggttggcatcaaggtgtattaggaattgttgccagccggattatgaatgagaccggaaagccaacaattgtcgcatcaactgatcaaaataatccgaccttaataaaaggatctggtagaagcgttgacagttttaatttgttcaatgccttggaggctcatcgtgaactatttacaacatttggtgggcaccctgctgcttgtggtctttcttttgatcagaaaaatattgtacctctgcaaatagccttggaagaagaagcagtcaaacaaaaatttgatccaacggtaaagcaacctcttccaatcgcaatgaaacttgtaccagctgatgttacccaacagttatataacgatattcaacgggttgctccatttggtccaggaaatatggaaccggtttttgaattaaataacgttaaagttgtcgatgtcaaaacaatgggacaggaacaccagcatttaaaattttcgattgtaagtgataaaaaaaatctaacagtcgttgcttttggtcaaggaaatttggcaacactattatccgcgccaaccggacaaattaatttagccgttaaagttagtcttaatgagtggcgtggtaaaaaaagtgtccaactgatgttagaagatctccaaattaatggaacggtaattattgatgaacgaacgaataaactaactcctcagctttttagttcttcagattattacattgtaagagagccaagattgcgagaaaatattgctccccatgtggctcctggctatactttatcgatcgaagaagcaattaagactgatttttctggtcaacaagtaacgctggttgactgcccatctagtgaagaaatgctaaaacggatttttgcagaggatgaagaagaaccagcaactattcgcttattactgtatcagcgaaaaagtgcctatttagctggactgccaacacggaatgattttgcacagctttatcgatttatttataagcaaaaagaattaaaatggcccatgcaagctaaagcagttagcaatcatttaaagattaatatggatcgattaaatctaatgattcaagtgttttctgaagcaggatttgttacaataaaagatgatgtgttaaagtttaatgagtcaactaataagactgatttaacgcaaactaaacgttatcaaaaacaattagcacaatataaagttgaacaacagttgcttttcaatgatgctgcaacggttgctaactggttattgaaatatttaaatttagaataaggagactatttatctcatggctttagacctttataaatacgtagctagtgttcctgattatccagaaaagggtattatctttcgagatattttgccattaatggctgatggggctgcctttaagcaagctactgacgaattagttgattatgctaaggataaaaaggtagatatggtagtaggaccagaagcgcgaggttttattgttgggtgtcctattgctcgcgaactgggtgttggatttgctccagcacgtaaaaagggtaagttgccaagaaaagcaattagtgcatcttatgacttagaatacggaacagctaccttgcaaatggaagccgatgcaattaaaccgggacaacgggttcttgttgtggatgatctcttagctacaggtggaacaatctctgcaacaattgatatggttgaacaaatgggtggtattgttgttggctgtgcattcttaatcgaattaaaagatcttcatggtcgcgataagcttaaagattacgatatgaaggcattaatggaattttaattaggaggaggctggggatactagccttttttctttttaaattatagttgtatatataaaatgaatgcgggacaataacattacgttgataaaaaggagccagttaatttatgattttcttagtaataatgggagccttatttttgattttgggtggtttttatcttgctaattcatggcaacagtatcgcgaatggaaaagcgggacaattattgtagtattgagtattatcgcaattgtttatggtgtgattaatttaccttattttcatcataataattctgctagctcaagccaaagtacttcatcttcacaagtggcgcggtccagtagtttttcatcattttcaaatggattagcgattggcaattcaagtgcaaatgaagcgcaacaagaaagtaagacaatggctgttttgcgtcaaatgcaaaagggttattcaaaattaggttcagttgattataacgaagatagtaagacattccagatcacgccaactgatgataatacggttgaagcattgaaagctttagcgcaagatccaagtcaggctgaacaaatgggctggcctaacttaactaagtcgattaaaagcaattcagggcaagtagaaaaagcattaggtgaaggatattcaattagtattatgaatccaagtgattctagtcaggcgttgtatacggccaaagatggcaaaactacatacgatattgctaatcaataaaactaaataacctaagattagttcaagacagattggggcacttaataggtgtccttttttgtgtaataaaaaagctgatatatcaacgttttaacaacgattgaatatcagcaaaactttagataaaggagacaaggggacttctaataatttgaaaaattctcctataatccttgatattaaagggttttaaaaatatttaattgaaatttgagaacattttgagaacattatactaaactatcggcgaacttgtcggcgattccttgttctggttcagtatctgcattaatataaacttcaagaacagtttccattgtatcgcctaatctatctgctattaattttggctgggtaccaatagaagccaaatgtgtagcatgggtatgacgtaatccatggaatgtaactttctttagattatttctaacaattactttatttaacggcttgtccaattctgcacctaaaacaattttatttttagtgtaggtagagaaaatcaattgctctttttggtgtggattaaaacctagtttagttaaaatatctatctgttgctgtttccatctttttagataggaagcagtttttttatctattgaaatccagcgataagagttagcggttttagggccaccaagatagggatgttttgcgttcttaatagccttgttaatatggattattccaccgctttttgtaaatttaacatcttgccacgtcaaggcttgaagttcttgttttctcatgccagtaaaaagggctaaccatagaaccatgaaagcacgaggatttttttcttcgtagtctttttttatacacttgataaaattgtgaagttgcttttcattaaagaaattattgttagtaaatgttttgtcatgttttttacgaggctttactacagaattcattggattagttgggatcgctcttaattgtactgcgtagtctaacattcgcttagtatagttaaaagggtcactctttactaattcttctttccatttagcagcaacttcagttaataactcaatgctaagatcagcaactttatagtttccaatgcggggtagaatatgatttttaatgatttgttttgttttatgaatagtagaattttctatcccagtctgttcatatactggcaaccatttttttgatagctcttcaacggtcatgttatggttattcatttgaccatattttttaagctccacagctttttcttgttcccacgctacagcgtccgattttaatttgaaacctcgcttactggttgatttaccattaatgcggtatttaacataccacgtaccatttcttttatccttgtatactgacatttttactttcctcctacaatcgcacagctggctggcaagagattgtagagaaaggtttaaaattatttttttaaaattttaaaatatccgttatcatttaaaaactgtgtaagtttttctttgaagggtggtaaatccttgcggaaagcaggatagcgatttgcctcttcgtcaataattaggcttaaatacgtatttgcaagtaattcaaattgttcattaatttgtttaaaatttatttcattggtaattggtacgccggtaagtaatccatctaatgtattccaaacaaattttttaagttgttcatgttctttgtcattgctagattcatctgggtacacaagataaccataattatcaagcaaaacagcagctaataaatgtctttttatgtcgtcacgccctaacccacgttcaataatacttctatcattttcaatatgagcagctttctttttgagagatacggaatcgagcgttgctaaatcatgaaaggtaatattgttgggaattccatagactagaaaatctagaggaacatctaatatttgaggtaaactgtgaaaaatcgaagcaggtataatccgctggccacgttcataattccccaaggctggttgtgatattccaatttttcttgctaagtctttttgagtcatctttttagctttacgaattagtgcaatgttagaacctattttctggtcagatgaaatttctttcacattaattcctccttgtatagttaatatattatacataaccgaaaataacaatacaaaacacaatatattttattttgttgttgcataatatttcattatgttatatattgtaattacgatatgaaataaagaggtgataataatgagtacagctattttagatcagttcattgatcagttagctgaagctgtggctaaaaagctagagaacaataagttacaagatgctaagactgttaaaaccgaaccagagtttatgaataagggccaaactgcggattatctaagtgtttctcgaacaactattgatcgttggattaagacccgaaattttccatcatcaaaggttggaggaaaatatgtatataaacgtgaagatgttgaccgttgggtaaaagaaaattctaagtaataatcgcacagctggctggcaagtgattgtagagaaataaataggaggaggtgagacatatgttacaaaaaattgatggtaagattttagcttactggtggacttcaccagaccaacgcctttgggcttatctagcaacgtttttaccattgctgggtattgttgttgcaattagtaacttattttaaggagtaataagaaatgagtttatacactaaaaaatttgaataagaaatattaagtaaaagaattattgatatagaagacaggattgttaaagctggcagttatataaattcaattactgaagattgttttgaaggtactatcactaaagaaaatggagaaataattgcagatgatccgatttcctcagcagatgaaattattaaggtcgctaaagaaattaaagatttagcaattcaatataaaactttaactgattttgaaaacgactttatggatggtaataaaaaagccgttgatagtgagaacgccaattcagacactaacaacgactaaataaaacttagagaattaaatttagctaataaaaaagccaacaatctttacgggggatgttggacgaattactaatatttaattctctttcattctaacatgagtggagggtttaaacaatggaaaaagataagaaccaagaactagcgtttgaaaatcagttgtgggaagcagattccaatgttgaagaaacaaccggaatagcccaagcactgtatgatcagttaaatgatgtttttgctccaattgtacgagtagacaattatgcagcaatgagtgatgaacaagtgtctacggttgctcaaacagtagtatcacgtaagaaagcattgttagcactatctagtattttgttggataagttagatcaaattcatgatcaattgcaataggtgggacgtgattaatagtgttaagttttgaagaaaaactatccgttaatcctttattagatagtgacaagatggaaaaaattattaattcaacgtcacatccccttaatgagtacgcaaagaaacagtttcagaaagcacttgaatactataacgatgattacaaggttatagaacgagctgttagtagtaaaagtagtagaaaatttattgctctttataaaaataatgaggaaataatttcctactacctaaataaatatcatagcgttaaacctgctattggtgcaatgtgtttttatcttctctactacacaggggatgacgttaaacaagttaaccgaatactgcaccgtacaccactctttaagtattggaataatgctagtcaaaacgaagatcaatcaatagtcgattgggacaatatatacgaagaaacaagtttagacgggaaaagctttgaatatatcaaaacaaaaggcgaagtagagattatcagtcttaaatacaaacgctaaattaccatgtaaagagaggaaaaatatggctaatattgatgacttagtaaataacaatagttttccagaatggttaactgtaagtgataaaggaaataaactggttgatgaaattaagttggctaaatatttagaaaaaaagtatcactttacatccaaccaatttatagaacacggctattggttcgatcctaaaagtagacaatggaaaaattacgctgattcagtcattgaaaaatcaatcaaaaatgaaattgtacctcatggaatatggagaacgaacttattagcatcggtttctaaattaattgccttagattcacaagaaattgtagaagacaatccatttgatcaaccagcaccttataaagcagtgtttggtaaacacacttacaacttgatgacggacactttagaagataattcaccagagaactatcttttacaaaatagaccatatgaattagaaacaaaaggaaaagctacaacgtggaataaatggttaaaacaatcattagtaccctcaactaaagaaatccgtgatgatactggaaaactacaagatgaatatgacctaacagcaattgaaacagtaaaagcctttattggttttgctttagcaggtagttttaaggactttcaaatttatatgattctatacgggttgggtggggatggtaaatctacatttctaaataaactaatggagttaatagggaagcctaacgtttcaaacgtttctttagaagcattatccgaccaaaaagaagctaaatttgctacttctcagctgtatcataaagctgctaatgtttttgctgatataagccccaaatttatggaacagactaatattattaaaacattaactggtgacgacactacaacagctcaatttaaatataaagatccatttaaacttgaaaatgaagctaaattgatttttagcgctaatgatttaccagccttcaatgattttacagacggatttaaaagacgaccaattattgtaacgttccataagattaaacattttaaagagcaattcaaagagcaagactttaaaagagaaatgccagcatttgcctatgaatgcttaaaatcttataaaaaagcacttgattctggtaagtttccagtgactgaatacatggaacagcaaaagcgaagctgggtaaatgctaatgacaatatcggtaattggattaatgattgctgtactacaaatgagaaagataaagaaaaatcagtatatctatatgataattacaaagagtattgtaaaaatactgctgttccttgtcttagtaatcgtaagtttgcgaaagagctaatagcacgaggatacaaacacactacagttaagattaacggtaaaaatgttaaaggttataaaggaattgctcttaaaaattagttatagttttatatttatcggttacctttgcagaagttcttataaagcttgatataaagctatttaaaggtaaccgaaagcattttgaggtaaccgatagtttcgggttactatattaagtaactgcaatgtatcggttacctttatatcctatcggttaccatataaatgttgatataaaggcgattgtgggtacttgaaacggggtaaccgataaaagtaaaaactattttcaattgaagagatgaaaattaacaattaaaactgcttttaccgtacttttattttgaggcagtgaccacataccaccggataggtgaaaagcctattaaggagttaaaaataaagtaacagtagatttcactagaacggctgcaaacgttctactattgcttgtatctgcaagtacaggcagaaaggaataattaaatgcgaagtaataaatacgcaattacacgattaaagcataaggtcacattcggtcatgaaggtggtacggggaaacgtaacccgaatactggtatgatcatgacaggttttgtaggagatgtgacagtacattgtggtaactattcaatcagtgctagtcaagctattagtgaggcaggtagttcaattactgatgatgttatattggtagttcgtcacaagaaagatttaacggacatgaagaaatatccagaagcacaatacaatggcagtatctataaagttgctggttggtcaattgatgatgagttattggcgtatgatattgtaaccttacgcaagcttgatagtcataaataagaggtgaaatggggatgagtaaattaacagtcaacacgcacccagagtataacaactttattaatgtaatgattgaggcaagcggtgatgatccttctaattatcatatgtatactacgctttatagtttaaaattagtctcagtaaatggcagtccattaccattagcgattgatctaggactaccagacaaccaagagctagtaaagtgtattgcacaagtggcagtatgcaaggacgcagaggaaagtcgccaagactgggtgatgatggcaaggtatagactaagcgagtgtgacccttacagcgccgatacaatggagcttgaagcttgcattaagagaacggttaacgatgttaaaagctggcacataagcaggcttgaagcatatagtaaggcaatggaattaattaataagtaagtgctaagggtgtcgtgttatgcgatgcccttttttcataggaggttatcaaatgagtgtagtaaggttttgtagtgctgctggttgtcgagaggtgattccagtaggtcaatatttttgtaaaaaacatcaatatctacaaaaagaatatgaagacaagcgtaaacattggcaacgagataactataaaaagatgaccaaagaacagaaacatgaatacaatagaaaagtatacaaaaagcgaatggaaagaagcgccaaagctcctcatgactataatagattctacaaaacgagtaagtgggttaaattaagccgtcaaacgctccagaaaagcccagtttgtgttatgtgtttacgaaagggaatagtaaaaaaagctgatttagttgaccacattgtacctatacgtgaagattggagtaaaagattggattcaactaatctacaatcactttgctatcgttgtcaccgagaaaagacaagaaaagatcatcaacgagaaaggaaaataaatatgaatagctgaaataattttaatacccccgctattggtatagaccggtaggagccgtaatggtgggggtttcttttaaaaaaattctccctttacaaaaaaacgccttaaaatccgaagatttcaagacgtttctttttattttgtatggttttcttttcaactttattaaataatttagagcctcaaatgtcaaggattttttattataacttttaggcattgaacttaacaaactattcaaatatggtataataagggttaaataatacgataattgaatatgaaatgatgttttttttatttttttaaacaaatagtgacatggtgtcaccaaataaatagaaggaggttaaatagttggctcaaccaatgaagacccgtccagaaggtcatattactaaggcagaaaaagcacaacgtgaagacgctgaaaaagcattggcagaatacccaaacttaacatctcacgcccctaaatggcttgatgatgtagcaaaaaaggaatggcgtagaattgtcccactcttaaagaagagtgcccctattagcgaactagatgttagtttaatcgctactcactgtactttgtattcaacaattatcaaatgtactaaagagattgatcgtactggggtagttattgatacaaaacgaggattacagcagtcaccttactacatggcacgtgataaggctattaaagaaatgaagtcaattgatagtcaaatggcacttagcccacaatcacgggtacgcctagaagtccacaaggcaatgagtgaagaagctcctactgatgagtttgaagagatgttgtcataatggatagagctattcagtatgctaattcagttgttaaaggtgagttaatcgccggtaagttagttattcatgcttgccagcgcttcttagacgacatgaaaaagcaaaagaccgatgactttccttattattattctgaaacgtatgctggtaaggttattaaatttgttgagagcttaccacaaacaaacggtgaaccattgaagctagagccatttgaagtgtttatcttatctaatatctatggttggcgacaggtagacgataattcattgcgcttcaatcggattctattaagtgaagcccgtaaaaatggaaagagcttcttactggcagcgattggcgttgtgtctcttcttatggaaaagcaaccagcccgtaatcgacaaatactatttactgctaacagttcccagcaggcacaccttgcgtttgatattatgagtgaccaactagaaaacttacggcgtaattcaaagtatttaaggcaacgagtgaaaatcaataaacaacgggtgactgacaaaaagacaggtagcttcgcaattccactatctactgatacccacagtacggacggttataacccgacactgggcgtagtcgatgaatatcaccaagctaaagataacactattctaaacgccttgaattcaggtatggctcaacaagacaatggtattctagcgattatttctactgctggttttaatcttaattcacccttcaaaaatgaatgggactatgcagccgatatactcaacggcaaaattaagaatgatcgttactttgcggttatgtattgtcttgataaaaaagaagaaatattcgaccccacaatgtggattaaagctaatcctttgatgagtaatcctaagattgctaagacaatgagggaacacattcaaaatgatttagatgtagccacaaaacaaaataatattaataacgtacttgtaaagaatatgaatatgtttgtacagcagaatgaaaattcatatattagtacgcaagattgggaacatggattgattgaaaaagctccagatattagtaatagagatgtttatattggtgctgatctatcaaaaagccgagatttaacggcgattagttggttagttccgttagaagatggaaagttttacgctgattcccacgcctttgtatctcgttatggtggaattgttactaaatcaaaacgtgatggaattgattatgaaatggctgctaaacgtggagaatgttcaatcagttcattagaaagtggcttgattgattatgattccgtatatgatttcgtgatggacctaatcggtaagtataatctaaatgttaaattcttagtatttgacccttataaatgggctgatcttgttaatcgttttgaacgggcaggactaccacaacttcaattaacacaatcctataagaatttatcggtaccaattgggacttttaaggaagaattaattgctggtaacattcttcacactaacaatcagatgttagcttacaacgtaggaaatgcaatattgaaatataactttaatggtcaagcgttattagacaagactagaaagcaaaataaaatagattgccttgctgctcttatggatgcttgggcggctggttatgattacttcactaagagaaaggagcaagaacgtacaaatgaatactatgaaactgctaaaaatcttttctagctatattaaaccggttttgttgatcaccggaggcgttctaatggagatcagtgctataggattaaccggttggttgtttgggattggctttcttggtattgaaatgattgttctagctttcatgattaactattctgataatcacaagtaaaggagggtagataatgggcctatttagtaagagaacaacgactacaagcgcacaagacccctttctagacgctctagtaagtctttctagtaatgaccctaatagttacgttagtgcttcggctttacgtaatagtgatatatttgctgcaattagttctatcgctggtgatcttgccagtaatccgattaagtctagttctagcctatataacaagatgattaatgatcatcctaacgagttaatggacggcagaagtttcaagtacgccctagcggttgaaatgctattaaatggtaatgcgtttgccgaaattgatttaagttcacacacgctaaattttattcctaacaataaattaactgtccagcaagatgatgtaacgcaaaagctgacttacacatacagcccagatggacgtattaagcgagtaattgcctcttctaacatcttacattttaagtattttacccgtgatggtttagtcggactatcgccactgtatgcgctaaaagatgaaatgaagatacaggcggctggaaacaggttaatgactggattctttaataatggaattcatggcacaacagttgtccaagtccaccaagctgatcttagttcggatggtaaagagaacattagaaaacaatttgatgaggcaactaccggcaataattcacttaacacaattgttactgatgatggtatggacgttaaaagcctaccacttaatacagacgtgttaaagctagtaaattctaatgactggaatacccgtcaaattgcgaaagcgttcggactaccacccgagcgtttaggtgtagaaaacgagcatagcaaccaacaacaaagtaacgttcagtatttacaaggtactttacagcactatgaagattgctttacttctgaattgaactacaagctagggcaagattttagctttgataatagcaagctattaagccttgacccgtccgctcaacagcagatggcagttgatggttatgttaacggtatctacacacgcaatgaagcccgagccttacttaatttagtgccggtaactaatggagataattttattgaaaaagaaggaggagttacagccaatggagaaacgactaacaactaacgcaggtttacaaacggtaagccctaaagaagacccaacaaaagaccagcaagataaccaagatgaaacgcaagcctcacagcctaatacagttgaaggctatgcgttactctttaatcaacccagcaaggacttaggcggttttgttgaagtgattgaccctagcgcccttgataacgtagacctatccaatgtagttatgcttgatcaacacgactacactaagccactagcaagcgttaaggctggttcattacaacttgatgtggacgataaggggcttcacttcaaggcaactattgacccaagtgtaagttacgcaagtgacactcttaataatgttaagaatgggaacattaattctatgtctttccgttttgatgttgatgatggttctgacagttggacacgtgacgacaacggacaaattacacgcaccgttaatcagattaaagatttatttgaggtttcaaccgttacagtgccttcatatgatcagacaaatgttgatgtagataaaacaagcattcgtagttacaaccaatttatcgaaagtgaggaacataataaaatgcaacacacaatcttagaccccaaaaacaatacagaacaaccagctaacgcctttgaaagcttcattcgttcacgtggtgaaacccgtgacggattaacaactaagggggcagaagccgttattccagaagaagttgttactccagtcctagacttaaagaacagtgcttataacttagcaaagtacgctactgtaaagactgtagggactggttccggtcattatccaatcgctacccgttacaacacagcggtacttactactaaggaagaacaagcagaaattgctgatgtagacgctaatatgtttgaagatgtgaagtttgatgtaaagacccgtgccggtaagattgcactatcaaatgaagttgttgacgattcagaagttgatattgtatctgaagtaaagaaccaacttcaaaagttagttgataacactgataacgctgaaattatcaaggtattacaaggcgataactttactaagaaaaccgtagctaatgttgacgacttgaagcaagtattcaacgttgaccttgacccagccttacaaagtacttctacatggttagtaaatcaatcagctttccaagtattagatactttgaaagacaatgaaggacgttacttattacaaccagatgtaaccgctcctagtggattttctttacttggccaacccgttgttaagattagtaataagttcttaccagataacacagacggttcacatccaatgattttaggtgatatttcagaagcggtagcagtattccggcgtaatcaagttacagcccaatgggacaagttcgacagttacagtcaaggtttatctgttatcgtccgtaatgactaccaaccaattagtaatgacgctgcttttaatctctctttaaccacaactaaggcgaccgaaagtaaataatagctactagcacagggtgggcaatatcgcccactctttttttatgaggtgtattaatgcgaaaagaagtaaaaagtctagtaatagtaatactgaaagattatccttcaattaataagaaactaaaaagccgtaagtttgaactaatgcaccctatccgcaaaagagatgaaaatgtaggtggtggacgtgctatcaatcgaccatggacttattacgatgatatgttaataaccattgaccaagatagatatatgcaccgcttaaaacgtgagaaagaagctattgacttagcattacaagacgctggggactgtacccagaagataattaaagaatgctattttaaccctaatcataagacgataaagaacctagtagcaactggcgatatatggtgtagcactacaaaagcgtacaagttacgtgatcaatttatagtagatgttgctaaaaagttagacctagatgtgttctaaaagaaggtgaaattaatgaaatttgatgtagagcagtgggaagtagacaactttaagcaagccttatatcttgacggtgaagaagaagaccaattaatcaaggattatctaaagaacgctaaggcttatgtacaaaacgctgtaaaccccacagcagacttaacccagtatgaacaatatacgttcgctgttcagatgttggcgcaattttggtatcaaaatagaggtattgacatgtcaaataccccttaccaagtgttaagcatgattcaacaattgcgggcgcttgtatagataactagtatagattgatgcgttatatacctaaaatgtatggtataattaatagcgggaagtgagtaaaacttcccgtgaacattaagtgtttggagcaatacagccagcattacagtatttattttctttcaagccttgtaaactccttccagaatatagctatcaaagtcaccatagtagaaagctttattcaattggaaaggggatggttatatggaaataaagtataaccgttttcttgtcgcttagttaagcgataggaagtataaagtcgtgacggacaagaatacaacggcttctttgatgtgtggactgactaatgttattgtttggttggcactcaatgtccacaacatggcataccttgtagagtgtgggttaaagtctttaatggctttcttatttttaatttggtagaataaatatccatattttccttagtcgggctttaattagtccggctttttttgctctcaaacgaaatgaaaaatcactagacgggtaattgatcatcttattttgttagagaaggaattaaaccaagggtagtgtttccagaaatcgagaaaactttttttgtgatgataaataaaaaacgccacgtaaattgtgacgattggaatatgtatttaaataagtagatatgtatcttgccagccagaagatattgagaacattttgagaacaaaaagtgatatatgttgaaatgttgtgataaattaaagggctgttaaaccgctatataaagcaatttgaacaaccctttaacattctgattaattatctaaggagacaaggggatttgaacccctgcacgcttttacacgcctaacggttttcgaaaccgtcctcttcagccacttgagtatgtctccatttcaactatattattgtaacaaaaaaattgtaaagcgtaaagagaatatcaatcaaggaaatagctatttaataattttgcagaaatgatttcttgctgatatgatattctaatatatgatgtaatttgaaatttaattaggggatttttatggtaaaaaaatattatgcagtcaaaaaaggtcgtcatccaggaatatataaaacttgggctgaatgtcagaaggaagttaatggatatccgaatgctaagttcaaaagctttttaacgtttaaaggtgctaatgagtggcttcaggctacgggaaatatcgtaccatcgactaaaacggttgattattctgataacattcttgtttatactgatggaggctcccgtaatcatggcaataaattgggacagcatgttaaggcagatgataaagcggcctgggcttattttattcaaactaaagatcaagcttatacaggaactgctggcgaatttggggctactaataataaaatggagattacagctttaattcaagcactaactaaactattagaacttggcctccaagatcaaccaattacagcgattttggattcacattacgtacttgatccaattatgaaaggctggttaactaattggcagcgacggggatggttaactgctagtggcaagccggtagcaaatcagaagctatgggaagaaatagttacccttttacctcagttccctaatttacattttgattggactaagggtcatgcaacgaatgctggaaataataaggtcgatgaattactaaataagacgatggatcagttataattatttgacaagaggatgataagaaatgagaattggtattgacaaaatggcttttgcaacaacaaatgactatttagaccttgttgaattagcaaaagaacgcagcgtagatcctaataaatttaccattggaattggacaggatctacaggcagttgtgccacctacgcaagatattgtgactttaggagctacggcagcgaaaaaattgcttactccggaattagaaaaaaatatttcgacagtaattgtggcaactgagtcaggaattgacaattcaaaagcgagtgcaatctacattaaacgcttattagggcttagcgacttcacccgaacggtagaaatgaaagaggcttgttattctgcaacagctgctatccaatttgcaaagggagtagtggcgcttaatcctcaagaaactgtattggtgatcgctgctgatattgctcgttatggattaaatacgccaggagaggtgactcaaggagctggagcagttgcaatgctgatttcgcggaaccctcacatcctaacccttgaagatacaacggttgcttatagtaaggatataatggacttttggcggccgttatatgcaacagaagctttagtagatggaaaatactctactaatgtttatattgaatttttccttcaaacttttacccgttaccagcaattaactgggcgagaattagcagattttgctgcccttacattccatatgccatttactaaaatgggaaagaaagggttagaagggctgctcaaagatcgtaatgatgaggtagctcaacgattacgaacacaattaaccgcaagtcaactattttcacgtcaagttggtaacctttacactggctccctatatttatcattaatgtcattgttacaaaatagtgacttaaaagctggaagccgaattgggttatttagctatggttctggtgcagaaggagagttctacacaggaatcctagaagatggctacgagcattatatgaataatattcaagaagaactagaacatcgtcaccaggtttcggtagcagaatacgaaaaactattcagtagtcaattaggaatgaatgaccaggatatcgagtttgatgttactaatgatccattacctttcgttcttaaagggcaaaaggatcatcaacggatttatgaagccaaataacctaaataaaaaggagccccaaaatggactccttttttatttagaaaatatgatcacgaaatagtcccactactttaccaaggatttttacattgtctaagaagattggctccatcgtatcattttctggctgtaaacgaaaacgtgttttttctttatagaatcgtttacaagtagcttcattatcatcattcattgcaataacgatatcaccatttttagcggtggattgtttacgcacaattacttggtcgccattaaaaatccctgctttaatcatactagttccacgaatggtaagcataaacaaatcattattatcttgaatagaaggaggtatcgggaaaaactcagtagcattttcaactgctaaaattggttgcccagccgtaacaacaccaagcattggaatttctttttgaatcggttttacacctaaaatatcaagtcccttgggtgtgatctcaagtgctcgaggtttagaagggtctttttgtaagaatccttgttcaattaagcgagagatgtgtccatggactgttgaagttgaagacaggccaacagcactacaaatttcacgaacagtcggtggatagccatgatcttcaacttgtttatgaatataatttaggacggccatttgtttattttttgctacctttgccatattgacacctcattatcattaattgtgttaagcttatcatagatagatgcatatttcaaacgtacgttcgtgatttgcattaattttataaaataagtaaaatcgactttattaaggagatgattataatggctgaatcgaaagaacaagatgctttattgaagcgaattaatgaacttgctcataagaataaagaagaaggtttaactgaggaagaaactaaagaacgagatcgtttacgtaaggaatacctaaagaactttagagaagcaatgcgtagtaatattgaaatgatgcggatttttgataaagaaggtaaagaggttactcctgaaaaggttcgtgaaattcaacgtaaaaaaggacttcgtgacgattaacagcgatttgctcttttcaaaaattgctctttcgtgtaagatggataggtaacgagcaaaggaggaagtaattgtgggtatgacgatcatgctaatgattcttgcattattagtcggtttggttatcggcttctttggtgcacgtaaatacatggaaaactacctccgcaataatccaccgatttcggaagagatgctgcggacgatgatgcttcaaatgggacaaaaaccatcaagtcgtaaattacatcaaatgatgcaagcgatgaaagcacaagctaaaaagtcaaatcgtaaataatataaaaggatgtgatttttatcacatccttttatattggaaattaaaattcatcattcttcggctttggaggaacaatatatttataattgggatcaatttgtctatctaattggtcaaaggagtcttgcatttgcttttctaagtcagcctgtacttcgggagtgagccgttgctttcggtcaatataaataggcttcccaaatgcaatttggcgcggcttacgggtaaatagctggccaaattttaggggtccctggtaaacagcaggaactaaggggacgtttgccattttagcgatcacggtggccccgccttttaatttagatgagtagcgtgatccgctagggaaaataatggtcgataagtcagtcttctttaaaattgtaaccggctttttaatagcagacggacctggatttttccgatcaaccggataggcatttagtgcttttaagaatttgctagcaattggattcttaaaaagttcttttttagccatgaagctaaattttttgggccatacggcaagcgctagtaagacaggatccatccaagtacgatgaggtgcaataataatataattgccttcagggatgttttcccgattgtatattttaggtcgtccgttaatcaaatttaaaaatggattaacgattttaacgaggaaagtgtacaacatgtcaatcttccaatctataacaaaattaagttttcgttcctcagtatgacgaaaaaaagtggatcttgcaagtacaaaaataatggaggacataatggaaaacagaaatattttaaaaaaggatgaaagaattgatcagttatatagtcaggatgtacggataatccaaaatccccattattttgctttttcgttagatgctgtcttattagcaaactttgtgcgtcccaatcatcgacagaaattaaaaattgttgacttgtgcgctggaaatggggcaatcggcatttttctccacgataagcttggcggaacatttaccgaagttgaattacaaccacagattgctgatatggctgaacggacaattttgctaaatgatttacaagatcgttataccgtcattaatgatgatatcgcaaacgttaatgattatatttctaaggactcgattgatattgtcctttgtaatcctccttatttcccagttacagcccaaagccagaagaatccaaataaagctttagcgattgctcgtcacgaaatagcgactgatttagtgacagttgttaaaaagatgaatggcttattaaaaatgaatggtcatgggtatcttgtgcatcgtccagatcgtttaggtgagattttacaagtgtgtcaggaaaatagattagcacctaaaagaattcaatttattcatcctaaacctgatcgtgatgcgaatattttgttgcttgaagtgattaaggatggccggcctggaggagtaaaagtagtaccaccattgattgttcatggagcagataaccagtatactccagcggttcaggagttattatatggcaagtgagaaatactatatttatgtattgtattgtgcagataatagcttttattgtggctttaccaacaatgttaaacggcgctttcatactcatcaaacttatcaaggggcaaaatatactcgtgtgaaaaagcgtcatccactaaagcttatttattcagaggaatttgaatcaaagcatgatgccttaagtgcggaatattattttaaacatcaaacccgccgccaaaaagaaaaatttttactagaccatggtgttaatttattgaaactacggaggaattaagatgaagatttatatgtatggtgtttatcaggatgaagtcccttacattgaggaatggcaagaggaacatcctgaagtaactgtagactcaacaactaaacttttagacgaaagcacagtcaacttgtctaaaggaagcgatggagtagtagtattccagcaaaagccttattcagacgaggccttacgtcaattagcgtttaatggtattacaaagatgtcattgcggaatgttggggttgataatcttaatcatgaattagtacgagaacttggtttccaaattactaacgtaccagtttattccccagctgcaattgctgaattttcagttactcaagcactcaaccttttacgtcgaacaaaagaattttatttaaaattagcaaaaggagattataactgggcaccgcatattgctaaggaaatgaataagcaggttgtcgggatagttggaacaggaaacattggatccacagcagctaaaatctttgctggttttggtgcaaaagtgattgcatatagccgtcaccaaaataaggaactagaaggaattgttgaatacgttagccttgatgaattatataaacgggcaacaattatttcgctttatttacctcatgttccagcgacagataaaatgcttaatgaaaaaacatttgcaatgatgcaggacggggtcttactggttaacactgcacgtggaccattagtcgatgaaaaggcattgattgaagcgttgaatagcggtaaagtcggaggagctgctttagacgtaatgactggtgaaaccaagatttttaaccagcaaattgatttccaagaagttgattataacgaatttaaggatttagttgatcggccaaatgttttaatcacgccacatattgctttctatactgatcaagcaattaaaaatatggttaagatgagtttgtccgccaatctagatttgattaaaactggcacctcagataaactagttaaattttaaaataagttaagtgaaaaaccttgtcagtttgcaaggttttttgtatactatatttcggtgttacacgccaatttcacacccagaatgatggtggtgagggtgcttaaatagtcccattgccagaagaagactggggaggagaaacaatttggaggtattatttatgtctgttgtatctatgaagcaattgcttgaagccggtgtccacttcggtcaccaaactcgtcgttggaacccaaagatggaagaatacatctttactgaacgtaacggtatttacatcattgacttacaaaagactgttaagttaattgatactgcttacaactacatgaaagatgttgctgctaacgatggtgttgctttatttgttggtacaaagaagcaagctcaagatgctattgaagaagaagctattcgtgcaggtcaatactacgttaaccaccgttggttaggtggtactttgaccaactggaagactatccaatcacggattgctcgtttgaaggaacttaagaagatgagcgaagacggtacatttgatgttcttcctaagaaggaagttgctgtcttaactaagcaacgtgaaaagcttgaacgtttccttggtggtattgaagatatgccacggatcccagatgttatgttcattgttgatcctcacaaggaacaaatcgctgttaaggaagctcaaaagttacacattccaatcgtagctatggttgatactaacactgacccagacgacattgattacgttatcccatcaaacgatgatgctatccgtgccgttcgcttaatcacttcaaagatggctgatgcttttgttgaaggtaagcaaggtcaagacgatgctcaacaagaaactgctgatgataacgctgctaacgaaactgttagcgaagattcattaaagaacttgaagaacagcgttgaaggtaaagaagactaaaaatattaaattcttgggctgttttgtacggaccattctggcctaagtactaaacagcccttttttcaaaaaagattataaaaggagagatttcgtcatggctgaaattaaagctgctcaagttatgcaattacgtaaaaaatccggtgccggtatcatggatgctaagaaggcattagttgctagtaatggtgacatggacaaagcaatggactaccttcgtgaaaagggtattgctaaggcagccaagaagagtgatcgtgttgcagctgaaggcttagctgatattgctgttaatggcaatacagctgcaatcgttgaattgaattcagaaactgatttcgttgctgctagtgaaccatttaaggacttattgaagaaggttactaagttaattagtgaaaacaagcctgctaatgttgaagaagcattagaaatcaagactgaaaatggcacattaaatgatgatattatcagtactacacaaaaaactggtgaaaaggttagccttcgtcggtttactgttgtagaaaaggatgacggcgatagctttggtgcatacttacaccaaggtggtcaaattgctgcattggttgtcttagaaggtgctgacgatgccactgctaaagacgttgcaatgcacgttgcagctatcaaccctgaattcatgactcgtgatgatgtttctcaagaacgtcttgaccatgaacgtgctatcttcaaggaagaaactttaaacgaaggaaagcctgaaaagatcgttgacaagattgttgaaggtcgtttaaacaagttcctttcacaaatttgtttagcagatcaagactttgttaaggattctgaccaaactgttgaacaatacgtttcaagcaagaatggtaagttgaagtccttcattcgttacgaagtcggtgaaggaatcgaaaaaaagcaagatgactttgctcaagaagttaaggaccaaatgaactaagcgttcggtcaaaaggaggacgtactcaatgtagtgcgtccttttttaaagattaacttaccaattcaaggaggatatcatatggcagatattaaatataagcgagtaattttaaagctcagtggagaagcattagctggcgacaagggttttgggattaacccacccgttttaaaggatgtagctaaagaattaaaagaagttcataatttgggcgttcaaattgccatcgttgttggtggtggtaacatgtggcgtggtgttactggtgctgaattagggatggaacgtgcgcaagctgattacattggaatgttagcaactattatgaatgccttatcacttcaagatgcgcttgaatcaattggtgttcctacccgggtacaaacttcaattgaaatgcgccaaattgctgaaccatatattcggcggaaagctattcgtcatttagagaaagatcgaatcgttatttttgctggtggaacaggaagtccttacttctcaactgatactactgctgcattacgagcagcagaaattaacgctgatgccattttaatgggtaaaaatggggttgacggcgtttactcagctgatccaaataaagttaaggatgctactaagtttgatcatttaacccatatggatatcattgaaaagaatttacatgtaatggatactactgctagttcactatcgatggacaatcatattccattggtagtcttcaacttgaacacatcaggcaatattatgaaagtagtaactggtcaagaagttggtacaacaattgaaggagactaataatatggctacaggaaaagaaattttaaatgatgccaaacaaaaaatggcaaaatcaggtgatgcacttcagcggacacttgctgatattcgtgcgggtcaagccaatgcaagtttattaaattctgttaaagttgaatattacggagcaccaactccattaaatcaagttgcatcaatcacaattccagaagcacggcaattattaatcaccccttatgacgaaagcgtgcttgaagaaattgaaaaagcaatctatgcatctaatttaggattaactcctcaaaacgacggaagttcaattcgcttaatcatcccacaattaactgaagatcggcggaaagaattagtaaaggacgttaaagctgaattagaaaaggcaaaagttgcagttcgaaatgttcgtcgtgaagcgatggatgacttaaagaagggtaacaagaatggcgactttaatgatgatgaattccatgatcttgaaaagaaagttcaaaacgaaacagatgctggaattaagaaccttgaagatattgcgaatacaaaagaaaaggaattaatggaaggctagttttcagaaataaaaaggttgtgaactttgcgtaagtccacaacctttttattttggctaaaattgaattgttatgataaaactatgtaacaatttactgtggattgacaaatcgaaatttgcctctggtataataaaggctataattaattggcagacgtgaatttttaagaagtgtctgtaattaatcttaagtacatgataaaaaatggaggaacaattagtgttttccaaaagtaaacatgatgaaataaatcagcaacttgatatggaacgtattcctaaccatattgcaattattatggacggtaatggtaggtgggcgcagaaacgacaccttccacgggttgctggtcataagcaaggaatgcaaacagtaaaaaagattacaattgctgccagtgaattaggggtaaaagtcttatcattatatgctttttcaaccgaaaactggaaacgtccttcttcagaggtaagttatttaatgcagttgcctgtccgcttcttctcaacatttgttccagatcttgtcaaacataatgttaaggtgacagtgatgggagatattacgcaactgcctgaagctacgcaaaaagctgttaaagatgcaatggctgatacagcccattgtacggggatgattctcaattttgctttgaattatgggagtcgagatgagatcactcaagctgctaaagagattgcagaagacgttcaaaatgggaacttggcacttgcggatattgatgaagcttcgtttggtaagtacttgatgtcagcacaactgggtcaatttgcagatcctgacctgctaatcagaacaagtggcgaagagcggattagtaactttatgctgtggcaaattgcttatagtgaattggagtttgttccagaacactggccagactttgatgaagattcattacggtcagcaataattgcctatcaaggacgtcatcggcggttcggtggactaaaaaatcaataaataataaggggattttgttttgaaaacaagaataacgaccgcggtaattgcacttgcaatctttataccgcttattatatatggtcattggccattaacaattgcagccgttgccttaggaatggttgcaatgtcagaagtattggtaatgaaaaaaatgtttgtaatttcgtttgaagctttgatcagttatctgggggttgcattattaatactgccggatagttggcttgacttcttgcctagtgttgcaactcgatggttcggattctatattttagttgttttacttctattacatacggttattcgaaaacaacgctttactttcgatgatgctggggttttaacattagcaatgctctatattggaatgggatttcgctattttattgctgctcgtgcaatcaattttcaaacgctattatatggaatgttaatcgtttggattacagatagtggagcatatttaattggccgaaaaattggtaaaaataaactcgctcctaagattagtcctaataaaacttgggaaggttcaattggtggtacattagctgctgttattattttggctatttattgctactttatccctgttggtgcaggttgggtaacaatgatattcgttactttgattctttcaatcttcggtcaatttggtgacttaatcgaatcatcattaaaacgctactatggtgtaaaggattcgggaaaaattcttccaggccatggcggaattttagatcggtttgatagtatgctaattgttatgccaatgcttcatttattagggatcatttaatcaaacgtaaggaagagattttttgataataacaattattacatttattattgtttttggaatccttgtccttgttcatgaatatggtcattattattttgctaaacgagcaggaattctggttcgtgaattttcaataggaatgggtccaaaaatttggtggaaacgaaaaaatggtactacctatactattcgaattttgcccctcggtggttatgttcgtttagctggtgctgatgatgaggaccaagatgagttaaagccaggtacccctctaacgattcaactaaatgatcaagataaagttattagtattaatgctagtgataaaacaaccttatttcaggggatcccccttcaattagttgcttgtgatttagaagatggcttatggataaaaggatatgtcaatggggacgaagatcagctgaaggtatatagtgttgaccatgatgcaatgattattgaacgagacggaaccgaggtacagattgctccacgtgatgtgcaatttcgttcagcaagtctgcctgcacggatgatgactaattttgctggtccaatgaataattttattttgtccttagtagtatttatcattcttggttttaccttaacgggcgtaccaactaatagcaatcagttagggcaagtgaatgccggttccgtagctgccaaagcgggcttaaaagcaaatgatcggattgttaaggttaacaaccaaaaaataaataattggactgacctttcaactaatatttcaaataagcctaacaagacagtatcagtaacgtatgagcgtggtaataagacatatcatactaagctaacaccaaaagcagttgagcgagggcatcagaaagttggccaaattggaattgttgaaaagcaagagagaagtttagctgctcgattaaagtttggttggcaacaatttatccaagcgggaacattaatctttagtgttcttggtcatatggttacccatggatttagcttaaatgaccttggtggaccggtagcaatttatgctgggacatcacaagccacctcattgggaatcaatggagttttaaatttcttagccctcttatcaattaatttaggaattgttaacttattaccaattccagcattagatggtgggaaattattattgaatattgttgaagcgatcattcggcgaccaattcctgaaaaagctgagggaattatcacaatgattggttttctaatcttactaacacttatggttctagtaacatggaacgatattcaaagatattttattcggtaattaaaaacaaaggagtatagttttaatgaaacagtcaaaggtattaattccaacaaaaaaagaggccccaagtgatgcagaagccttaagtcataagatgatgattcgtgccggctacatttaccaagtatctgcaggggtatggtcatatttaccattagcttaccgggttattcgaaaagtagaaaatattattcgtgatgaaatggataaggccggagcggttgaaatgcttatgccgggacttcttccagctgatttgtggaaggaatctggtcgttacgaaagctatggtgataatctttttaaacttaaagatcgtcgtgaccgtgactttattttgggcccaactcatgaagaaacctttactgaagtattgcgtgatagtattaagtcgtacaagaagctgccattagtagtttatcaattacaagataagtttcgtgatgaagatcgtcctcgttatggaattcttcgtggaaaagaatttgaaatgcttgatggttattccttctcagcagatcaagaaggattagacgaagcctacaataatcaagcaaaggcttaccggaacatttttgatcggattggcttaaactataaagttattctcgctgattcgggaacaatgggtggtaagaactcacaagaattctctgcaccagctgaagtaggggaagacataatcgcttatactgatggagattacgctgccaatattgagaaagctgaaagtaaatttactggtgtacaacgaacagctgctcctgcaccaattgagaaaaaagctactccgggtgctcatacggtagatgaagctgcagaaagtttagatcttgatcctaatcaagttatcaaatcaatgctttacattgctaaaatgagtgaagatgaataccaaccggtcttagtattaatgcgtggcgacgatgaagttaatgaagcaaaggtaacgaatgctcttgattgtgaagaacttgaattagctacagaagaagatgccgaaaagtaccttaatgctcatcctggatcattaggacctgtaggagtaggcgaagaagtaaaaattcttgctgataattatgttaaggttttagttaacatggcatgtggtgctaatgaagatggttaccattatattaatgctaatattgaccgtgacttccgcgttgatcaatttggtgacttccggaatgttaaagaaggcgagattgctcctgatggtaaaccacttaaatttactcccggaattgaaattggtcatatctttaagttaggtactcattactcaagcaaacttggtgcccaagttcttgatagcaatggtcgtttgacagacgtaatcatgggaagttacggtattggtgtaacccgtctattgtcagctgttgcagaacaaaatgctgatgaaaatggtcttgtctggcctaatagtattgctccatttgatgttcatgtaattccagttaatgcgaagaaagaagatcaaatggcaatggctgataagatcgatcaacaattaactgaagctggttatgaggtattagtagatgaccgaaaagaacgagcaggggttaaatttgctgattcagacttgattggtattccaattcgggttactgttggtaagaaagctcaagatggtattgttgaaattaagatccgtaaaactggtgaaactgttgaagttaaacaggaagagctagtaaatacggtgggaattttactaaagcaattgaacgaagaaaaaaacaaataatttaaactaatgtggctgcgatgttaagataaataacgttactcgcaccacatttttaagtaggaggattagaacgtgggattaagtcgccaagaattatttggaaaactattagaacaaattcactttccggaaaaagacaattctgcattcagaaatgccgcagttcaatcagttgttgttcataaaaagtctcggcactgggaatttcacttaatctttaataaagctttaccgtatgacctatttacgcagttcaaccagagcttacagctagggttcaaagatattgctaaagttagtttgaagattagtactcccatgacaaaacttgatgaatcacagatagctaattattggcagttcatcattaataaggcaattagtgatacaccaatgctccaacaagcttgcttacaaacggctcccgaggttaaggagggtcgtgtaacgctagttgttgaaaatgaggtaattaaagacttactagcacagaaagcattagataagattgaaaaatcataccaagagctgggctttcctaaatttaggattcacccatttgttgaccagtcagcctcgcaagcaaaaattgaagaattaaaggctaaacacgagaaagccgatgctgcgcttgctgccaaggcggctgcccggatcaagaaaaatgaggctgcaaagaagacagcaaagaagagtgcaccagttgctcctgctgatggcccagttcaacttggccggatgattgatagtaagcagaatgttattcaaatgaaagacattgagggtgaagagcggtccgtggttgttgaaggatatgtatttaatgcagaaattcgcgaactacgctcaggtcgtcaattattaacctttgaaattactgactacacttcttcttttgctgtcaagaaattctcacgcaacagtgatgaagaagcacaatttgccaatatcaaagcaggaatgtggttgaaagttcgcgggcctgtacaagaagatacttggatgcgagacttggtaatcacggcttatgatgttaatgaagtaactcatacggcgcgtcaagataaagctcctcaagatgataaacgagttgaacttcatacgcatacaacaatgagtcagatggatgccactaattcgattactgagcttgcaactcgtgctcataagtggggacatccagcaattgcggtaaccgatcatgggaatgtccaggcttttccagaagcatttagcgtggcccaaaaaacgggcattaaaatgctatatggaatggaagctaatgttgttgatgatggaattccattggtatacaacgagaatcatgaagaactcgctcatcagacctatgtcatttttgacgtggaaacgacagggttatcggcaatttacgataaggtaattgaattgtctgcagttaaaatgcaagatggaaatgtcttagaacgttttgatgaattcatcgatcctggtttcccgttatcagaacaaacaactaatttaactagtatcaccactgaaatggttcagggttcaaaaactgaagaagaagtttttcagatgtttaaggacttttgtaagggctgtatcattgctggtcataacgttgcatttgatatgggttttatgaatactggctatgaacgtcatcaaatgggaaaaatcgcggaaccagtaatcgatacattaccactggcgcgattcttatatcctgatatgcgaggataccgattaaacacgcttagtaaaaagtttaaggtagcattggaacatcaccaccgtgctaactatgattcggaagctacaggacacttgctttataagttcttgaaagatgctgaagcccgttatgatgtgaagtatgtggatgatttaaataagcacatggaagaaaataatgcttaccgtcatgcgcggccttttcatgtaacgatttttgcgcagacccaggctggtttgaaaaacttatttaagttagtatcgctatcaaacgttgaatatttttaccgagtaccgcgaatcccgcgaacagtgctgacgaaatatcgtgaaggactgcttttgggaactgcttgttcatcgggagaagtatttaccgcgatgatggagaaaggttacgatcaagcactagaaaaggcgcgctactatgattttattgaagttcagcccaagccaaactatgcaccgttacttgaacaacatgtgattgcagatgaagaccacctcgaagatatcctcaaaaatatggtcaaactaggggatgagttggaaaaaacagtggttgccactggagatgtccattaccttgatccacatgatgcaatttaccgtaagatcctgattaattcgcaaggtggcgcaaacccgttaaatcgaactgagcgtccagaagtgcactttaggaccactgatgaaatgttaaatgaatttgcttttctcggtgaagaaaaagcccacgaattagttgtagagaatagtaataagattgcagctgagattgatgacaatattcggccagtaaaagataaactttatccaccgcatatgaagggggccgaacaggaaatccaagatcggacatggaatactgcgcgaaaatggtatggtgatcctttgccacaactagttcaggaccggattgaattagagttgaacagtattgttaagaacggattctctgttcactatttaattgcccaacgactagtagctaagtctaataaagacggatacttagtaggttcgcggggatctgttggttcaagtgtggttgcaacgctttcgggaattacagaagttaacccgttgccaccgcattaccgttgtccaaattgtcaatttacccacttctatacgcaaggggaatatagttcaggtttcgatttgccagataaaaaatgtccaaagtgtggcactctaatggtaaaagacggtcatgatattccattccaaactttccttgggtttaagggtaataaggtaccagatattgatttaaacttctctggtgactaccagccaattgcccataactatatgaaagtcttattcggtgaaaaaaatgtattccgtgccgggacaattggtacggttgctgataagacggcatatggatatgtgaaggcttacgaacgagatacagaaaaggaatttagaaaggcagaggaggatcgcttagcaaaaggagctactggtgttaagcgaactactggtcagcacccagcgggaattattattgttcctgatgatatggatatttatgactttacacctgtacagtatcctgctgatgatcaaacagctgcctgggaaacaactcactttgatttccactcgattcacgataatattcttaaaatggatattttgggacatgatgatccaacgatgattcgtgccttgcaagatttatcaggaattgatcctcaatcgattccaatggatgatccaggggtgatggccttattctctagtcctaaggtattaggggtaactgaagaacaaattcaaagtaaaactggtacactaggattgccggaattcgggacgcgatttgtccgggggatgctggaggatactcatccgaaaaattactcgcaattattacaaatttctggtctttcacatgggactggtgtgtggctagataatgcccaggaactaatcaaacagggaattgccactatcgctaatgttattggttgtcgtgataacatcatgaccgacttaatccactatggaatggactcagaaatttctttccaaattatggaacacgtacggaaggggcgcgggattccagacgagtggcaagaaaagatgcatgaagctaatgttccacaatggtatatggactcatgtttgaagattaagtatatgttcccgcgggcgcacgcggctgcttatgtcttgatggctctacgaattgcttactttaaggtttatttcccgttagtttattattgtgcattcttctctgtgcgagcagatgactttgatgtagtagcgatgtctcatggtaaagatgcggttaagcaacggatgaaagaaatcaatgataagggaaatgatgccagtgcaaaagagaagaatctcttaacaattcttgaactagctaatgagatgctggaacggggctttaagtttaagatggttgatattgaaaaatcagatgcctccgattggttgattgatggtgattcattaattgcaccattccgagcagttcctggattagggctaaacgttgctaagcaaattgttgccgcacgtgaagaacgtccattcctttctaaagaagatttggcagagcgtggaaaggtttcgcagacacttattgactttttgacagataatcatgtattagataagctgcctgacgaaaatcaacttagcttgttttaaggaatagtaatgaaaacatgcttcattgcttgccagtggctgtgttacatgctacaatagattatggtaaataactcgtgggagtgagcagagatgctcgctctttttattgcaaataatggaggtgacacgtttgagcagtgttgtagaaactgtaacagatcttgtaacgccgattttacaggaccatgatttttacttatatgatttagagtttgtaaaagaaggtaaaagctggtacctccgcgtttatattgataaagacggtgggattacgctagaagattgcgcacttgtcagtgatgaattaagtgaagcattagataatgttgaacctgatccaattccacaggcttactttttagaagtttcctcaccaggtgctgaacgcccactgaagaaagaggaagattatcaacgagcaattgaccattacattcacatttctctttaccaacagattaatggtcaaaaggtttatgagggtacgttaacgcaattgtctaataaagaaattacgttggattatttagacaagactcgtcatcggcaaattacgattgatcgtcagaaaattgcccaggcccgattagcgattaaattctagtattaaaggagtgtcgaaaggtgagtaagccaaaaattaacactgagatgattggcgcccttgattatcttgaaaaagaaaaggggatcaagaaagagattgttattgaagcgttagaacaagcacttgaatcagcatacaagcaaaattacggtgataagaatgttgaagtagaattcaattcattgactggtaatattaaagtctacgctgtaaaaacaattactgatgatgaagaagcagtcgaagcagacagcaacgaatttatgagtttagctgatgcacggaagcttcctcatggccaaggttatgatattggtgatgaaattcgcgaagaagttacccctcgtgattttggtcggattgctgcccaaactgctaaacaagtagtaatgcagcgtctccgtgaagaagaacggaaaatcatttacgacaagtataagacttatgaaaatgagattatcactggtgaagtttcacgagaagataagcgtttcacatatgttgatttaggagatggtgtagaaggtgccatgggctttagagataagatgcctaatgagcactaccacgtccatgatcggattcaagtatacgtaacgaaagtaaatgacgatcgtcggggaccacaaatttttgttagccggactgctccagaacttttaaagcgattatttgaacgagaagtgcctgaaatcaaggatgggactgtcttaatcgaaaatattgctcgtgaagcaggtgatcgtgctaaggttgcagtatactcaaatgatcctaatgttgatccagttggaacttgcgttggtccacgaggttctcgtgtacaagcaatcgttaatgaacttgatggcgagaatatggatattgtggagtatgttaaggagcccgctaagtttatcgctaatgcattgaacccagcagaagtactggatgtaatctttaacgaagagaaggcagcaagcgaaactgaggatagcgaaggtgaagaaacgactgaaggacaaacagaacgttcatgcactgtcgttgtcccagatagccaattatccttagccatcggtaagcgaggacaaaatgctcgtcttgctgctcggttgactaagtacaagattgatatcaagtctgaatctgaaatggctgaaaatgaccaagaatctgaagaagtagctgatttagaagaaaatgttgacaataacgaagaataactagaaattaagcagcggggtgaaaataatgaaaaagagaaaaataccgatgcgtaaagacattgttaccggtgaaatgatgcctaaaaggcaattgattcgggtagttaagaataaggaaaatgaagtctccttagacccaactggtaaaaagcctggtcgtggagcatatgttgcagtagatgtggatattgcaaagcgcgccaagaaagaaaaaacttttgaaaaagcttttcatgttcaacttgatgaatcattttatgatgaattaatcaagtatgcagaccacctacaggcacgacaagagttatttggtaatgatcaaaaataaagaacaggtcttaaacctccttggaatcgctcggcgtgcccggcaacttcagagtggggaagagattgtcttaaaaaatattcaaactaaaaaggcaaagtttgtattcctagcttcagatgctggaaaagctagtgcaaaaaagattactgataaatgtaaattttatggcattcctttttcaacagatttcactagagaacaacttagccgggcaacagggcaagcacgaacagttttttgtgtaatgcaatcaggttttgcaagaaagtttgaggaactactaactatgagataaggagtgtgagcatatggccaaagaacgaatttatgaattagctaaggaattaaaaatgcctagcaaagacttagttaatatggccaatcggcaaggaatgggagttaaaagtcacatgtcttctgttaccccagatcaagcgcaacaattacgtcaacttgcaaagggtggacaaaaaacaactaataatcaacgccaaccagtaaagaaaaatgatggtcacaataagcaaaataaccatcaagcacaaaatcacaatcaacaccacgatcatgataaggcacaaaatgagcgtccacaaaagaaaaacaatagccgaccaaacaatggaacaaaagataataatcaacaccaaaacaatggtggtcgatttggcggcagcttaaataacgatcaaggccgtaatggcaaacgctttaataagaaaaataagaagaataagaaacacaataagaacaagcggttacgtgaagtagctcataagcaaccaacacaacgaaaagataagccgcttccagaagtattagaatatactgatgggatgaatgcccaagacttaggaaagatcttacaccgttcaccagcagaaatcgttaaaaagttatttatgcttggtgtaatgatcaaccaaaatcagtcacttgataaggatacaattgaattattagcaactgattacggtattgaggctaaggaaaaggttcaagttgacgtttcagacattgataagatgtttgaagatgaacaaaataatactgaacatcaagtaacgcggccagctgttgttactgttatgggacacgttgaccatggtaagacaaccttgcttgataagttacgtcactctcatgttactgaacatgaagcagggggaatcacccaggaaattggtgcttaccaagttcactataatgatcaattaattacgttccttgatacgccaggacacgcggcctttactgaaatgcgtgcacgaggagctaatattactgatatcacggtccttgttgttgcagctgatgatggagttatgccacagacagttgaagctattcaccacgcgcaagctgcccaaacaccaattattgttgcagttaacaagattgataagccaggtgcaaatccagatcgtgtaactgaagaattagcaaagtataacttgattcctgaagactggggtggagatacgatttttgttaagatttctgccaaatttggtaagaatcttgatgaattacttgatatgattctactccaagctgaaatgctggaattaaaggctaatccggatcaaaatgcggctggatcagttgttgaagcccgccttgatcaaggtcggggatcagttgccactgttttaattcaacaaggtactcttcatgttggggacccaattgttgttggtaacacatttggtcgtgtgcggacaatgacaaatgaaaatggtcgtcgtattaaagaagctaccccatctactcctgttgagattactgggttaaatgaagtaccagaagccggggatcggtttgttgtctttgatgatgaaaagactgcccgtgcagcaggtgaagaacgggcaaaacgagcaatggataaggaacgtcaaaagacttctcatgttacattagataacctctttgcaactatgaagaagggtcaaatgaagaccttaccgattatcattaaagccgatgttcagggatctgttgaggctctaagtcaaagccttcaaaagattaaagttgacggtgttcgtgttgatattattcaccaagccgttggtgccattaatcaaagtgatgttaccttagctgaagcgtctaatgcggttatcattggttttaatgttcgcccaactgccgtagctaagacattggctgactctaatagtattgatatccgtcttcaccgtgtcatttacgatgcaattgaagaagttgaagatgcgatgaagggaatgcttgaaccggtatacaaggaagaaacaattggtcaggtagaagttcgtcaaatctataaggcatcaaaagttggtacaattgccgggggaatggttacttctggtaagattacccgtgatgcaaaggttcgtttagttcgtgatggcgttgttatttacgaaggtgaattaggtagtcttaagcgcttcaaagatgatgtcaaagaagttaagcaaggttacgaatgtgggttgacaattgaaaactacaatgacattaaagaaatggatgttattgaagcctacaagatgaaagaagttccagttaagtaaaagctgaggagagataaagatgccaagtaaacaatatcgagtagaccgtttagctcaagaaattcaaaaagatgttgatgaaatcttgttaaaacgtgttcgtgatccacgtgtacaaaacgttacaattacaggtgtggatgttactggtgatctccagcaagcaaccatctattacagtatcttgtcagatcttgcttctgatgcggagaaggcacaggctggattagataaggcaactgggttaattcgcagtgaattaggcgcacgtcttaatatttttaagactccagaaatcaaatttgtaagagacccatcagttgcttacggtagtcgaattgatcaactcattaacgacttacacaaaaaagaaaaataattagcaggaaaagggagcgagacagaagttacttgtgacttcgtttttcgacgcgaagcaagcctctgggagcccctcgcaagcaacaggcctccaacgttcgtttttttaccgagcgatgggggccattgttgtactgcactatttgtcttttgtgaaagtaacttgacttatatcacagcagccccttggaggaataatgatggatggaataatacccttatataaagaacgtgggatgactagttttgcatgtgttagtcgactacgacaaattttaaaaactaaaaagattggtcattcaggaacacttgatccaggtgtagcgggtgttttaccaatttgtgttggaaatgctaccaaagttgttgattatttgatgcaatcaggaaaacaatatcaaggcgagcttttaattggttttgcgactactactcaagaccttgatggagaaaaaattgaggacaaagaagttacaaatgaaattccgactagtgaaatcctatcagccatgaattcattaacggggacaataatacaaatcccaccgatgtattcggctgtaaaagtaaatggaaaaaaactttatgaatatgcaagaactggtgaaactgttgaacggcccaaacgacaagtgactattagcaaatttgaattactaagctcaaagtatgatgaggaaaataaacaacaacgaatccgttttaatgttgaatgtagtaagggtacttatattcggacgcttgttgttgaccttgcacgtaaactagggtatccaggagtaatgagtttgttaacgcggttgaagagtggaggctttactcttgatcagactctaagtttagacgacgttcgcgatgctgttgcgacccaaactctccagcaatatttgtatcctttagattatgctttgaaggactatccgcaattaacgattcaagaggctcaatggaaaaaggttcaaaatggaggatggctttctccaagtgaacttaatactagtgagaaggaaattgtgttatcatttgatggacaagtaaaagcactatatcattttgatccgaaaaataaaatgtataagccaactaaaatgtttgcagttaattgaggagtgtaggagttgcaagttattaaaattcaccatcctttggaaaaaagactaattcctgcggggccaattgtacttgcaatgggtttctttgatggtgttcatcggggacatcaggcagtaatcaaacgtgcccgtgaaattgcccgtgaaaaaggattgccattagtagttttgacgtatgatcatgctccaggaattgtttatcgtcaatataagggcggctttaaatatctatcaacggtcgataggaagcttgagttattaaatgaccttgatgtcgatcgggtttatttaataagctttacctcgtcttttgcaagtctttctcctcagcaatttgttgatgagtatttggtaggctttcatgctcaaacggtcgtagcaggttttgatcatacttatggaaaagaagatattgcatcaatgaagttgcttcctaagtatgcagcgggacggtttgaagttgtaactgtgcccaaatttactgaggatggaagtcaagaaaaggtcggttcgcgagaaattcggaaattaattgatgctggtaatgtagaagcagccaaccaagcactagggtatccttatcaaacaactggcttagtagttcatggcttagctcgtggacgaacacttggttttcctacaatcaatgttgagcatccagaagaggagcgaattcctgggattggggtctatgctgtcaaagttaagctcggtaagaagtggtatgacggcatggcaagtgttggccataacataacatttggcgatgctaatcaattaacggttgagattaatctatttgattttcaacaaatggtgtatggtgaagaagtagttgtgcgctggtatcagtaccttcgtggcgaagaaaagttcacgggagcggatgcattagtagcacagatgaagcaagatgaacaaaacgcccgtcgtattttagaaaaatataaataaaagaggtttagattgatctttcgtggcaatttcgccaccaagattcatcaaacctcttttttaatgccgacttccccgatgactggtagtctggttaattttatgaatatttcgttcaaatttgaatccgccatcagtcactaatttgaaatgccgcattttcccgttaaaaggctggccgtttaagcgtactgttgtccagttacgcataatttcggtcatggaagcaagtgccttaagttgattaggattgttctccttaattgcttcgtctttaatatctgactgcaaacgatagattaggttgttatggtattctaatagttcattcgttagggacgcattgcggtatttattaaataacttctgaattaataacattgcttcttgagtattctgaggttgaatatagcgatgttctttatgtttcatggataaagctccttttaaaaattatttgacgtttcttgacttttaggggagtaattggtatattatacagtgtgtttagcacttgaccctaatgagtgctaaaaggggaagtgatatacgatgctaacacaacgacagaaaaagattctgcaagcgattgtacgtcaatacacatcaactggtcaaccggttggatcaaaacatttagcagaaaagttgccttttaaggtcagttcagcaactgtccgtaatgagatggcggttttagaggacaatgatttgatcttaaaagagcactcttcatcaggccggattccatctaaacgaggttaccgttattatgttgataatttgcttgatccacaagcagttactgataatgacctggtagtaattcaaaactcacttggaaccggttttcaaaagattgacgagattatttcacattcagcagatatcttatcaaacttaacttcatatactgcttttacattaaagcctgagcaagaaagtgttcgtttgagtggctttcgagttgtgccgctaggaaatcataaggttattgcgatcttggttaccgatagcggtgaggttgaaaatcagtcattcactttgccggcagacattgacacagatgcattgcagacagtaattagaatgattaatgatcaattagttggtttgccgctatcagaagtggtaaaacgactaaaagatgatattccacttcaggttctgcattatatgcatagtcccgatggtttccttgatatttttgataatgtcttatctcaagcagcacgtgagcggtttttcgttggtggtcgattgaacttactggattttgcaagtactcatgatccccatgcaatccaatcactgtatggcttgttagataagaacgacaacttatcgaatatcttggattcaacacttacctcagataatggagttaatgttaaaatcggtcaagaaatctctaagaataagcttcttgatgattatagcttgattactgcaagttataatgttgaacaatatggacgaggaattattgcagttcttggtccaacaaggatgccttattcacggacgattggaattgtaaatgcctttcgccaagaattagcaaaacggctattagatttctaccgtcactattatgattcataggaggcgagttaattggccaaggaaaaacaagaagaacaacaaaaacaaactgcgcctgaaaatgaaaaggcacctaaaaaagatataaaaaaagaggcttcagataagaaggatgatcaaactgttaaattaaaagaagagatcgctgacttaaagaagcagctcgctgataaagatgacaaatatttacgagcagaagcagaaattcaaaatatgactaatcgttttaataaagaacgggctcaaatccttaaatatgatggtcaggatttagcaaagtcaattttaccagtgcttgataaccttaaacgggctttagcaattgaagttgtagacgataatggcaagcaacttaaaaagggcattcaaatggtccatgatcatcttgtaaaggcattaaatgatcatggcatcactgaaatcaaagctgatggtgaaacatttgatcctactcttcaccaggcagttcaaactgtttcggtcgaagaaggtcagaagcctgaaactgttgttaatgttcttcaagcaggatatcaactcaaagaccgggtattacgcccagcaatggttgttgtagctcaataaatttgtgagagaaggaaataaattatggcaagtaataagattattggtattgatttaggtactactaactctgcggttgctgttatggaaggtaatgaacctaagattatcaccaacccagaaggaagtcggacaacaccatctgttgtttcatttaagaatggtgaaactcaagttggagaagtagcaaagcgtcaagcgattactaatcctaacactatttcatcaatcaagagtcacatgggtgaagcaggatacactgttgaagttgatggtaagaaatatactccacaagaaatttcagcaatgattttgcaataccttaagaaatatgctgaagactacattggtgatactgttactcaagcagttattactgttcctgcatacttcaatgatgctcaacgtcaagctactaaggatgccggtaaaattgcgggccttgatgtaaagcggattattaacgaacctactgcttcatccctagcatacggtcttgacaagaaggacaaagatgaaaagatccttgtttatgaccttggtggtggtacattcgatgtttccatccttgaattaggtgacggtgtcttccaagttctttctactaatggtgatactcatttaggtggggatgactttgaccaaaagatcatggattggttaattgatggctttaaggaagaacatggtgttgatctttctcaagataagatggctcttcaacgtttgaaggatgctgctgaaaaggctaagaaggacttgtcaggtgttcaagaggcacaaatcagcttaccatttatttcagctggtgaaaacggtccattacacttggaaaagacattaagccgggcacaatttaaccaattaactaatgacttagttgaacggacaaagcaaccagtattgaatgctttgaaagatgctgatcttacttttgatgacattgatgaagttatcttaaacggtggatctactcgtattcctgctgttcaagaaatggttaaggaattaactggtaaggaacctaaccactcaattaatcctgacgaagccgttgctcttggtgcagctattcaaggtggggttcttactggtgatgttaaggatgtcgtattacttgatgttactccactttcacttggtattgaaaccatgggtggtgtcttcactaagttgattgaccgtaacacaactattcctacttcaaagagtcaaatcttctctactgctgctgataaccaaccagctgttgatattcacgttcttcaaggtgaacgtccaatggcagcagataacaagactttaggtaacttccaactaactgatattcctgctgctcctcgtggtgttcctcaaatcaaagttacatttgatatcgataagaacggtattgttaatgtttctgctgaagatcaaggaactcacaagaagcaaaatatcactatcaagtctaactcaggcttaagtgatgaagaaattgaacggatgaagaaggatgctgaagagcatgctgaagccgacaagaagaagaaggaagaagttgacttaaagaatgaagttgaccaagaactcttccaagttgataagactttgaaggaagttaagggtaaagttcctgaagatgatatcaagaaggctgaaagtgctcgtgacgaattaaagaaggctaaagaaagcggcaaccttgatgaaatgaaagctaagaaggatgctttaaacaaagttattcaagaccttagcgtaaagctttaccaacaagctcaaggtgcacaaggtggcgctgctaatggtcagcctggtgataaccaacaaaatggtaataacaacggtaatgatgacaatactgttgatggtgattttaaggacgttacaccagacgacaagaaatagcctgcggtaaacagtcttaaaatgttagtgtaaaagccaaaggccagaaaaaaggactttggcttttactttcgtttgctggctgtggtataactaaacaagcaataaagtaatgaggtatttattatatggcagaacaagattattatgacattttaggtgtctctaaggatgcatccgaaaaagacatcaagcgtgcatatcgtcggcttgcggcaaaataccacccagatgttaaccacgagcctggtgcagaagaaaagtttaagaagattaatgaagcatatgagacattaagtgatagccaaaaacgtgctcaatatgatcaatttggttcagctggcccacaaggtgctggcggtcaaggctttggcggctttggtggtggtcaagcttattctaactttggcggcggctttgacgacatctttagtcaattctttggtggcggtggtcgtactcgtcgggacccaacagccccgcgtcaaggacgtgatttacaatatgcaatgactcttgattttatggatgcggtttttggtaaaacaactactatcaagtataaccgtgatgcagaatgtaagacttgtcatggaaccggagcaaagcctggtaaatcgccaataacttgtccacggtgtcatggtgccggcgtgattacgagtgttcgtcaaacaccactaggcaatatgcaaactcaaaccacttgtccagaatgtaatggaactggaaagattattaagccagaagatcgttgtgatacttgccatggtgcaggacatattcacgaacgtcatgagctagaagtgaaggtgcctgccggtgttgatgatggtcaacaaatgcggctccaacaccaaggagacgctggtgagaatggtggcccagccggagatttgtatattgtcttccgggtaacaccaagtcgtgaattccgtcgtgacggttcaacaatttacgttgatcgtgatatttcgtttgctcaagcagccttgggagatgaagtaaaagttaaaacggttcatggtgatgttaaccttaagattcctgcgggaacccaatcagaaactaatttccgcttgcgtggcaaaggggttccacaccttaacggtaatggtaacggagatgaacatgttactgtccatgttaagacacctaagagccttaacaagcgtcagcgtgaagcaatgttagcttttgcggctgctagtggtgaagatgttaagggtgtgaagaagacagttcttgataagttacgtgatgcctttgaggataagtaaataatttttatgaagcaggaaaagcttaatatttttcctgctttttgtatatctagtagaaggtttcccattctaaacgaggatttggtatactagataaagaatattcgttgaaagtgagtctttttaaatgaacctagaagaaatgaaagagcggcaaaaacacattcggaatttctcaattgttgcccacattgaccatggaaaatcaacgcttgctgatcgtattttagaaatgactgattcaatcagcaaacgtgaaatgaaaaaccagattcttgatgatatgcctctagaacgtgaacggggcattacaatcaaattaaatgccgtcgccttgacatatcatgctaaagacggtgaagattacattttccatttaatcgatacaccaggccacgtcgatttttcttatgaagtatcacggtctcttgctgcctgtgaaggtgccgtcttagtggtcgatgcaacgcaaggggtagaagcacagacccttgctaacgtctttttagcgcttgacaatgaccttgagatcttacctgttatcaataagatcgatttaccttctgctgatcctgagggtactaagaaacagattgaagacgagattggtttagatactgatgaggcagttgatattagtgctaagactggaatgggcgttgatgaagtccttgaaaaaatcgttaaggatgtcccagcaccaacaggagatttaactgcgccgttaaaagcccttatctttgattcaaagtatgatgattatcggggcgtggttcttagtgtccgggttgttgaaggaacggttaaaaaaggtgaccgaattaagttaatgaacggtggtaccgaatatgaagttgctgaagtaggaattaactctcctaaaccattggcacgtgatgtattgatggctggggatgtaggttatattaccgcggcaattaaagacattaaagatactcgggtcggtgatacggttacaagtgcagataatcctacagataagccgttagaaggatatcggcaaatgacgccaatggtatatgctggactttatccaactgataatgctaaatttaatgatttacgtgatgcgttggaaaagcttcaacttaatgatgcagcattaacctttgaaccggaatcatcgcaagcattgggatttggattccgttgtggtttcttaggattacttcacatggacgttattcaagaacgacttgaacgtgaatttaatcttgatttaatcacaactgcaccatctgttacttaccatgttgaattagcggatgggacaacaaaagaagtggaaaatccagctgaaatgccagacgcttcttccattaaagcgattaaggaaccatatgtccgcgcttcaatcatggtacccaatgattatgttggcccagtaatggagctttgccaacgtaaacggggagactttgatacgatggaatatctaagtgatacccgggtaaacgttatttatcatattccgctgtcagaaattatttttgacttctttgacaagttaaagagttctacacggggatacgcttccttagattatgaaattgatggttaccggtcaagtaatttggttaagattgacatcttgctcaatggcgataaggtggatgcattgagctttattgctcaccgtgactttgcggcagaacgtggtcgggaaattactgctaagttaaagaagattattccacggcaaaactttgaaatcccaattcaagcagcaataggctcaaaaattattgcccggaccaatattaaagcctaccgaaaagacgttactgcccgtattcatacaggggatccagaccggcgtgctaaattattagataagcagaaacgtgggaagaaacggatgaaggctgtcggaaaagttgatattcctcaggccgcctttatggccgttttgaagaccgatgagcaattggatgagaagtaaacgttgatgtaaaggtatttattggctttgtataaaacaaaaaatatacaaaactagtaatttttaccacgtgagcttaaaatgtggtaaaaattaaggatcagtattccctaagaaatagaggtactgatccttttttgttatggttctacaatatctggtgttgatatagaaatattacattctataccaatatcagattttttgtttttaaactaaaaaagaggctcgccctctgatacaatgaaatcgccaaatcacatagaaaagaaggtaaccccataaataataatacaaggactctcctcgatttaacagattctcatttaattttttcatcattcgattaaacatggtgggtttttatactcgctcaatactgcagtcctcaccaaattagcgtatcatagataatgtaatcgctattatttgaggaggaaataaatatgcaaaataaagatgcttgtacatcaattatggtcggtaaaaaggcttctctcgacggtgctaattatattgctcgtaatgaagatcgcgtaaaagcaattgaacccaagcgatttttagtaaaaccggcagtaaaaggacgccacgaaacctacgtatcaccttacaataaagtaactgtagctttgccggaagagagaatgcgttatacttctacgcctacccttgatcaaacagccggacctaatgaagaagatggaattaatgaagcaaatgtggcagcttcctttactgagagtgtttatgcaaatgatcgggtgttagcatatgatccatacgtaaaaaatggcctggcagaagactcactttgtactttagtattaccgtatattcattctgcccgtgaaggagttgaatatactggaaaattaattgctgaattgggctctgctgagggaaatggaatgcaatttgcagatgcagatgatatttggtatatgtaagtagtaactggtcaccaatgggttgcagttcgtattcctgatgattgttatgctgttactcctaaccaggtagcaattgaagatatcgattttgacgatcctgataattatatgtgggctgatggaattcaagaatttgttgaagaacaccaattaaaccctgaccatgaccggtgggatttccgtcatatttttggtaccagtacacaaaaagaccgtcattacaacacaccgcggacctggtttgctcaacgttaccttagtcctaatgcttcattaggccaacgtcccgaagattctgaaatgccatttattcgtaaggctgaatttaagattgctaatgaagacatccaatatgttctaaaatcgcattttaatgagacaccttacgatccaatgggggatgctcctgaacgtaagacttaccgagctatctctttatcacggacggcccaatcacatattttacaagtgcgcaatctgaataaatataaaacaagtattcattggattgaattaggggtcccagcctttaacccttatgttccattttttgctaatgctgacgatactgatgaatcgtatcgaaacgtaccggaaaaaatgaacttagagtctgcattctggttaaatgaagccttagcagaggttgttgaaagtcattatcaagaatttatggaaaaagatgaagactaccaaaaggagctaaatgaatgggcacgccgtaaaattgcgcaggttgataaagaagcagctagtcttgaaaggcaggcattaactgattatctaactgggcaaaatcatgaaatagctacccattataatgaacggacaaaggccctcttctttgaattattaactgaaggctgtgagctttcaaagatgtcatttaagatggatcctaacctttaagatattttgaatattgacatttctcactttattattaaaatataattaatgtaaaatgagagaaggataaaaaggagaattcaagcaaccgatgaacggcattatctagtagaagtttttacaaaattgggatttaaccaagatgacagtcaattattagcagacactctagttgatgcggatttacgcgggatctcatctcatgggattcaacgattagcatggtatcgtcggatgattaaagagggaacgattattccccaaaataaggtcaaaattattcgtgagttaccaggatccgtccttgttgacgctaatcaaaatatgggacagctcgcaacggttttagcgactcaaaaaataattgaaaaggctaagaaaacaggggtggcaattgctgttattcgcaattcgaatcacttcggcaccgctggttactatacaagattagcgttagaagctggattggtaggagttgcccttactaacactcgtcccctggtagtcccaactaatgctactcaggcttttcttgggtctaatgcttttgcgtttggctttcctgcttctccacatccatttatgtttgatggtgccacttgtgttgtttcaggtggaaaaattcaagttcatgctaaaaaaggcgaaccgttgccaggcgaatgggcagttgataaagatcggcaggtagtaactgatgcgcaagaggcagaagatattcttgccaccgcggcctttactgaaggggaacaaaaaggtggaggagttctcactcttggcggaaatgatgaggaaaattctaattataaggggatgggaaattctatcgtaattgaattattgacgggtattttagctcaaggctctatctctgccgatactgttagtggtaaacatgattttagtcaatttgtaatggttcttaatccagcattctttggtgatccagaggtattgaaagaaagatgccacatcaatgctagatcgaattcgccagcttgaacatattcctggtaaagaaatttgggtacccggtgatcgtgagtaccgtttattagcagaaaataaagaaaaaggtgtcacgattgatgaaaagacctatcaagaaatgaaagaaataggaactgaacttggtattgatgttccttaataattgataaactccttcaaatcctgataagtgaaagtggtacactgaatatatgaggaaaaaggagcattttaaatggaagatcgagaattagtaatgttttggctcgcaggtgatcataagttagcaattcgaaaggggcttacttcggcaattttagcgagtgaacttagaaaaaagggttataaggataaattaatagaagactttcttgatgattttgcacgtgacttaaaaaatgatcaaaaataggcaaaaaaactcccaacgttttactaaacgctgagagttttttagtagcacgataatctatcgttttatttatgaatacggcttagttgttaccttgtaactttgccataccgttcttagcaacttcttccaattgcttagcagagtcggccatagccttcttttcacggtcgttaagtggaacttcaataacctttgcaacaccagaagcattaacaacagctggagtaccgatgtaaaggtcgttaagtccgtattcaccgttcattggggcaccgatagggagaacagaattttcatcacgaagaatagcctttgaaatccgcattaaagcagtggcaacaccatagaaggtagcacctttgcggttaatgatttcgtatgccttgttacgaacatcatcttcaatcttaagtaattcatcttctgaaataccttcatccttagcgatgtcaagtaatggcttgccaccaacagtagcacttgagtaagcagcaaattcggaatcaccatgttcacccataatgttagcaataacatcacgagggtcaacatcaagcttcttaccaagagcaacccgaagacgtgcggaatcaagtgaagtacctgaaccaacaaccttgttcttagggaagccagaaagcttttgaacagcataggtaaggatgtcaactgggttagctgcaactaagaagattccgtcaaaaccagacttaacgattggttctacaacggacttaatgatcttcaagttcttatcaactaattgaagacgagtttcaccaggcttttgtggagcaccagcagtaataacaactaaatcagcgtctttgcaagtgtcgtaatctgctgagtagatgttcttaggagcggtgaaggcagtagcgtcttcaaggtccattgcgtccccttcagtccgttccttaataatatcaacgatagcaaattcttcagcaattccttgttgtgccattgcgaaggcgtaacttgaaccgacagcaccgtcaccaacaagaacaactttttgatgattcttagacataataaacagtctccctttcatcttatgtatacattatttgagatttctctcacagtaatgattataacattccgcagaaaaattactataagattttatagataaattagttagtgaataaacctgctcctaagataataactgctaaaaggatcgctggccaaagtaaaacatgaattaatgtcccgattaatagaataagaaggattagaccaatgaacttaaccgttaaacccccaatcttccatagcaaccagcagataagaatagcaattaagagactcactattgtaatcacctttccttaaagtatcgtgaacatagtatagcatttttttgaaaattaaagtttaaacatagattaaactttggaacgttggtgacctgtgctaaaatatacctatctagggagattaatttaaaattgatcaggaataataatagaggaggtggttaccattctgaatcgaactaagcagtttatgcgcgacaatgatttaatgtataaaaaagagtacattcggccaatgatgacaccccaacacgtatatgtgttccgctttggtaaacacagactaaataatcgggtaattgttcgttattcccatacttggaccggacgattaaaaattaacgagattgatgttcggttgcatcaccaacatcatccccgtattttcttgactgagtccgacttaatcgattacttaagtcatcatttagaaaaagaaaagaaacgtgaacaagaacgaccacatattagtaaagttgataatgaaaatgattagactttattaagttggtatttatcgtgaccatttacttttattgtggtcacgattttattatttaaggaggtcattaaatggattggacagcaataaaggtaataacttctagtgaggctgttgaagcagttagctatattttgacagatatgggagcacaaggcgttcaaattgaagatgctgctgattttgcaaacttacatgagggaaagtatggggaccacggtgaatttattgatccatcatcaattccgcaccgaaaaaatggcgcagcagtatctggatatttcccccaaaacgtatttgttcctgaactattgccaactatccatcaacgagtagcaaaattaagggattacggcctgaatccaggagaaaatgatgtctcagcagcgatcgtcgataatcaacaatgggcaacggtttggcaaaaatattatcacccattaagagtaacggatcagttaacgattgttccgcaatgggaagaatatgagccagcagatcctaaagaaaaattaatctttcttgatccaggaatggcctttggtaccgggactcatccaactactcgtttaatgctggaggcccttgaaaaaacagttgttggtaatgaatatgtaatcgatgtcgggacaggttctggtgttttaagtattgctgccaagcacttaggggcaggaaaagttgatgcttatgatattgatgaagtagcagtcaactcagcaaaaaagaatcttgcactaaacccggtcgctaaagatgttaaggttggcgtaaatagcctattagatgggatccatacccaggcagatttgattgttgctaatatgcttgcggaaatcatcgtacctcttattcctcaagcatatgaaaatcttaagccagatggcaaattccttgtttctggaattatcgatgataaggctccgttgattcgtcaaaagttgcaagagcaaggatttataattgacgatgaacagcagatgaaggactggcacggaatgattacccacaagccaatcgaggtgaaataaatgcaacgctattttgttaatgtaactccagctaatgaagtaacattgccatctgaagcagcccaccacttgttaaaggtaatgcgcgcagaggttggaacaagtgttgagcttgtattagccgaccactgtgtttaccttgcgactcttagtactacagaaccaacggcgacattaaaaatcaatcagaagttagatgctgatagtgaattgccagtttcggtaacgcttgcctgcggaattccaaagactaaagagaaaccagaattaattgttcaaaaggcaactgaattgggggcagacaaaattgttttcttcgatgctgctcgctccattagtcattggcagggaaataagcagaaacgaaagatcgaacgtctgcaaaaaatagctgaatcagcagcagaacaatcccatcgaaataaaattccgcaggttgaatacagtgcaaatcttgatcaattgttagccgattatcccgctaccaaacggatagttgcttgggaagaatcagctaaacagggtgaaacaagtgctttagcgcaacaatttaatgcccttaacccgggagactcgctccttgccatttttggtccagaaggtggattaacggaaaatgaaattgctaaaatgaatgaagctggcgtggtagcagcaggtttaggaccacgaattctacgaactgaaacagcgcctttatatttcatggcggctatctcatatgcaatggaattgtcataatgtagctggcttacttatggtaaaataaagaacagctttaatcggtgatttaaaactgaatataggtgttgaaagagaatgaattttatgaaaaaagcatgggaacgtttagataaaccattatggctagctagcattttaattgggattgtattgacgctcgttgttgataagcttccatttgttacgcgagtggtaatggtagagattgtcttaatccttattaatggtatttttagtatttggtccggttattggatttataagcaccagcgaaaatggggcgagttattcatttttccaatcctttacttgataactgcgtatttctttatgccccgatatacttattattttgcccttgcttacttagcgcttgcgtacttatcctgggcaatgcgtcaacaaaagtaattgaaaggaggtcgttcgatgtcaaaagaaaaggaattgacacatgaagatgttcaaaaaatagttagttcttatatgaatgaagaacacgttgctttagttgaaaaggcatatcattttgccgaggtagctcaccatgatcaacgacgtaaatctggggaaccgtatattattcatcctatccaagttgcggggatccttgctaatcttcatatggatcccgaaacagtttgtgcaggatatttacatgatattgtagaagatactggcgcaaccttagatgatattaaagaactctttggatcaaccattgcaatgatcgttgatggtgatacaaagcttggtaagattcgttacaaatcaaataaagaacaaatggctgctactcatcgtaaattattacttgcaatgtcaaaggatattcgggtaatgattgtcaagcttgcggaccgtcttcataatatgcgcactcttaagcatttgcgtcctgataagcagcgccgcatctcaaatgaaacccttgaaatttatgctccaattgcggatcgcttgggtatcagtactattaagtgggaactagaagatctatcattacggtacttaaatccgcaacaatattaccggattgtccatttaatgaattcacggcgcgatcagcgggttgactatattgatgagtcaattaagttgataaaaaaggcgattgcagatttggacttaggaccgaatgttgaaatttatggccggcctaaacatatttattctgtctaccgtaaaatggttactcagcataagcaatttagccaaatctatgatcttcttgcagttcgaattgtcgttgactcaatccgggactgctatgctgctcttggagcgatccatactaattggaaaccaatgcctggacggtttaaggattatattgcaatgcctaagactaacgggtaccaatccttgcatacaacaattattggaccggaaggacggccattagaagtacagattcgaactcacaagatgcatgaaattgctgaatatggggttgctgctcactgggcatataaagaaggaaagactaatggaatccaacaaactcaggatagccaaaagctaaatgtcgtcaaagaaatccttgaattacgaagtgaaagtcaaggcacagatgaatttatgcaggggattcagagcgatatatttactgataaggtctatgcattcacccctaaaggtgacgtaattgaaatgcctaagggatctggaccacttgatatggcttaccaaattcatactgaagttggtaatcatacaactggagctaaagtaaatggacggattgtaccccttgattatgagatcaaaaatggtgatattgttgatattttgacttcatcatcatcagctggtccgagtcgtgattggtttgatttggtttcaacgcggcgagctcgtaataagattcgccaattcttccgtgcacacgatcgagaaaagaacattgaagaaggaaaacaacttcttgaaaacgaactccgtgaagcaggatattcgccagcagaattaatgactgatgaaaaatgtgaggaagttgctcaagagactcattacaatagtagtgatgatatgtttgcggccctaggatttggtgacttggctcccgttggtattagaaatcgttttactgctgatatccgtcagcaagttgaaagcgaccgccaacaagcagcagaaaaagctgtactagaagatcaccagactcttgagaagccaaatgaacgtgaaaagcaaaaacaggctaaggcatcgagcgagggcgtaattgttgaaggagttgacaatcttcttgttcgtttaagtcattgctgtagtccaatcccaggagatgctattactggctacattacaaagggacggggagtatcggttcaccgggatgattgtccgaatattaaagctgcccgtaagaatggcgaacgaattgttagtgtatattgggcaaatcctaatggcgacaaaacaaactacaatgctgacttggaagttcagggatacaatcgaaatggcttgttaaatgatgttttacgttcagtaaataacagtactcgcttcttaaattcagttaacggaaaagttgaccataacaagatggtaacaattagtttgattatcggagtgcgtaatttacgacagttgcaattaatcatggatggtttaaaaaacattccagatgtttacgttgtcaaaagaattattcgataggaggatgcttgtgcgagtcgttttacaaaaagtaaatcatgcagcagtttcaattgatgatgaagttgttggtaaaattggccttggctattttctcttagtcggttttgctccagatgataccgaagaaaaattagactacttagtacataagattactaatcttcgtgtttttgaggatgaaaacggtaagatgaataaggggctacgggatgttaatggtgcaattttatcagtctcccaatttaccctttatgctgacactaagcatggaaatcgtcctggattttcacaggctgctcgtcctgagattgctgaaccgttatatgatctttttaatcaaaaactagctgctactggtattcctgttgaaaccggacattttggagccatgatgaaaattgatctggaaaatgatggccccacgacaattatttatgaacgctaaaaaagcaaagagggggctcgaaaaacgaagctagcctctgggagcccccgcaagcaacaataggcctctaatgttcggtttgccggacattagaggccattgttgtactgcgtatttgctttttatgaaagtaacttaacttatgtcacagtttagtattgacttaaaatttgatcgactgcgccaccatagctctcgccgaataagattaaatgcatgcataggtaatagaaacgataccatgaaaggcgttcctctaaatgatcatcaaagggaaagacgctgctatatgcctgataaaaactattatcgaaaccgccaaaaacagttgtcatagctaaatcaaattcacgatccccaaataatgcatctggatcgattaagtatggtttatgatcgccagcaaataagaagttaccggcccataaatcaccatgaagaagactagggatgacttcatggtgttggtagtaatcagtaaatttattaaccatttgttggtaatgttcttgtcgccatttattccatcggccacgttggcttgccacttgtacttctggttctaggcgctgattaatataaaaatcaagccagcttgaattccaagaattatcttttacgagggccttggtttgatgattatccataaagccgaattcttcattatgctgttggtgcattttggcaactgctaatcccaggtcggcctgattaccccaagtttcatcaagccagtttaaaattaaataggcattcccatcgatttcaccatggtaaagtggggttggggtattaatgaccttaccgatagctttgagaccattaatttcatgactgaaataatcttgtgaatggttaggttggacctttataaagtacctatttccatcagtagttgtggtttgatatgctaaattaatatcaccaccactgactggtttaacagaagtgagattttttaatggaaggcgcttaaaccatgctgtatttggactttccaattgatgtccctcctttactaaattactttatttataccatttttaggcaagtattgttaaataaagttgatttataaggcactaattaacgttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggtagtttatttgaagctgaacagattattttaaaaggggtattggagttaggacaagtaatcatgcaaaactttttggaaagcttagatcgaagcttaaagtcccaagctccagcgaactatcaagtaatcaataaacagccacggacgcttaactttatctttggcccggtgacttttcaacgacggtattatcaggctgggacaaagaaacgtgaattttacttagaccaacaattaaaaattaaaccacgtcgtcgtttatcgccacactacttaatgatgatggctaagattgcccaaacaactacaatgcgcaatactgccgacattttgaaccttgtatttgacagcggaattactaccgattcggtaatgcacgccgtgcatgagttaggaaatcaggtagctaaacaaactcaagcaaaagaacaccaagctactcctcgccatatgcctaaaaatttaactattgagggtgatgcttttatgattaaaggcaaaaaagaagcaggtcagctgactcttgtgcaccattatagggtttatgagcgagtagctaatcaaatcattaatcggcatgactttctcagtgttgggcaccaaggacggcttgaagcacgactaagtgattatttagaccgccattataagcttgccggtcaaacgatctttttggtcagtgacgctggcccaggttacgaaccagctaagctattaagtctagttcctcaaggtgcacatggtgaatactttctcgaccgctatcattgtttacagaaaattgaacatactttaggccggcacaacgaattagccatgcgagcaattaaagccgttcgtcatcatgatcaagcagagctaacaataattttagatacttatgaatcacaaaacctaacggaaaaacaagcagacgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactgagcagggggctaaagccatgattggtttaattgaagcccgaatgaatggtgaactgcaagctagtttaaatacaatcctagaacaattaacagttcatcctcgagtggctcaaaccagcctattacaggaaatgcatattcgaactggagagtttctaagaaaagcaccgacaaagccgtcaattggagcagtacaaggaataattccgattaacacggccacaagtagaccaatgggacaactttttaaggcactaacccactaaaactgtatatttaaaggctacctatgaaaacttgacagatacctaattaaccttagtattgacatttatgaggggatcgagtaaggtaaaaatgtaaattaaagatattaatagctgttgataaagaatgctcgggtacttgaaattatcagcgattggagaaaggtgagagctccaaatattttggcctcgattgacacttttgaagctgggcaatatgctccgtcgtttagacgttatttttgagtgataccaaggtggtaccgtgcatttgcacccttgtaatttcaagggtgctttttatttaaactgttattaaaaactgaaagaggtaagcggagaatgaagagaacaaattatgctggggatacaaatgaacagcaagttggacaagaagttgtcttaaagggttgggtagctaagcgtcgtaacctaggtggacttatctttattgatttatgggatcgggaaggaattgttcaactagtattcaacgaaaaagaaaatccagaagcatttgaaatcgcaaatgcggttcgtaaccaatatgttcttgaggttcaaggaaaagttcaattacgggcagaaaaagaaattaatccagatatgaagactggaaaagttgaagtagccgttgataaggttaaggtattagcaaaatcagaaacaacgccatttgatattactgatggtgttgatgcttctgaagacttacggatgaagtaccgttaccttgatttacggcgcccagaaatgatgcgtaatttgaagttgcggagtaaggttgcttcgattgtgcacaattactatgataatgaaggctttatggatgttgaaacccctgatttaacacggtcaacaccagaaggagcacgtgactacattgttccatcacgtgtttaccccggtcatttctatgctttaccacaatcaccacaattatttaagcaattgttaatggcagccggagttgataagtactatcaattagcacgttgtttccgggatgaagaccttcgtggtgaccgtcaaccagaatttacgcaaatcgatactgaaatgagttttgcaactcctgaagacatccaaacagttacagaaggtttaattaagcgggtaatgaaggaaatcgtgggggtagatgttaagactccattcccacggatggaatggcaagaagccatggacaagtacggttccgataagccggatactcgttttgggatgttgattcatgatctttctgatattgtaaaagacagttcatttaaggtttttgctaatactgttgctgatggtaactatgttcgtgcaattcgcgttcctggtggagcagataagtattcccggaaagatatttctaagtatgaagaatacattaagcgttttggtgcaaagggacttgcatgggttaaggtaactgctgatggttacaatggtccagttgctaagttcttaaatgatcaagttgcccaaatcaatgaagaaatggatgccaaagaaggggacttaatcctctttgttgctggtagtttccacgttgtatcagattcacttggctaccttcgtcgtacaatcgctgaagagctagatatgattaagcctgaccaatggaactacttatgggttgttaattggccaatgtttgaatatgatgaaggctttggaaagtggattgccgctcaccacccatttacaatgctaaatgaagaagacttacattatcttgaagatggggaagatcctcataaagctcatgctcaaagttacgatattatcttgaatggtaacgagatcggtgggggatcaattcgtatccacgatccaaagattcaagaaaaagttctcaaagctcttggatatacaaaggaacgtgcagaggctcgctttggattcttacttaaggccttaacaatgggaatgccacctgagggaggacttgcctttggtttggaccgatgggttatgttactagctcaagctgatagtattcgggatgttattccattccctaagaactcgaaggcagttgaaccattaacggcagctccaggcaaagttagtgaacaacaacttgatgatcttaaaattgaatttgatgaaaaaattgattacaagctcgatcaagatccagatgagcaataaataaaacaaaaataatcctcgtgaaaaggtacttgaagtgtactgttcacgaggattattttatttcaaaatcttcttcaaaaagtcttgtgcccgggggctagtagggtgggcaaaaaattcctctggatctccagtttcctgaatatacccatctgccatgaaccagatttggtctgctacttcacgagcaaaccccatctcatgagtaacaaccaccattgtcattcccgattcagctaaatcgcgcattacttttagtacctcatcaaccatttcaggatcaagggcactcgttggttcgtcaaagagcattactgctggactcatcgcaagggcccgggcaattgcaacccgttgtttttgccctcctgatagttgatccggatattgttgagccttatcgcttaaaccaactttttctagtagttccattgcagttttagttgcttctttttcattgatatttttaactttaactggtgcaattgtgatatttttaaggactgtcatattaggaaaaagattgaagctttgaaaaaccattcccatcttttctcgcaattggtcgagttttttatcacttaagccaatcagattctgtccttcaaaaagaacttgtccgcttgttggttgttcgagtgcatttaagcagcggagaaaagtacttttacctgctcctgaagggccaatcacacaaattacttggcccttatcaacatgttcggaaatatcttttaagacaatattatttttgaattttttctgtaaatttttaatttcaatcattttagtgggcatgtttcattctcccttcaaagtaaagcaaaatcctggatagtgtaaatgtgaggataaagtagatgatcattgtgatgaataaaggtaaaactcctttataagttgctgattgaactaattgtgtttgatacatcaattcggaaacaccaatcacagaaactaatgaactatcttttaataaagtaataagctcatttcctaatgctggccaaatatttttaagtgcttggggcataatcacatatctgaatgtttcgcttttactcatccccaagcttcgagcagcttctgtttgtccaagtggaatggattggatcccagaacgaataatttcagcaacgtaggcaccggaatttagtgaaacggcaataatcccagcgaggagagccggaagtgattgaataattgcgccaatcccaaagtaaacaaacattatttgaaccatcattggcgtaccccgaagaaattcaatgtagcaaacagcaattgaatgtaagaatttgttctttgaaagccgcattagtgcaaagagagttcctaataggaaaccaaaaataacagagacaactgtaatgattaatgtatatttaatccctttagcaaagtaacgccaatagctaagaacagtattttgttttttatagctcttcatatactgtgaggcttcaggaatccattttttattaattagttgttctttattaacttttttaattgtctggttggcggcattgactaacgaggtatcacctttaggaaaggccatggcaattccgccagcagtatttggcaatttcgaattaaaggcataaagatttgaattattggcagcgtaggctttagcagttgcagcatccattaaaatcccatcgtatttatgagattgaagcccaatgactaaggaagaaagtttagcaagccctttgccgtttgctttaggcatttcctttgaaattagggttgattggagcgtaccgttttgtgctcccacatttttcccattaaaacttttgacattaactagcttatctttatctcctttattaattaaaaagtaactatcaccggaataatatgtatttgagaagtcaacgctcttttttcgttcagccgtaacgttcattcccgaaataatagcatcaattttacctgtttctagcgcaactagaagtgagtcaaagtccatgtttttaataactagttttactcctaagtctttagcaaattgtttagcaagggaaacttcaaaaccgacatatttagtttttccattttctttggttgtgaattcgtagggtggataatcagcactcattcccacaaccaatgttcctttttgtttaatcttttgcactgaatcattgctagcgacttgcgatggattattggttgatgaagagctagttgaactgctctcgttagcagctaatgcagtaataggtgtacataatatcggaaacgcaattaccattagcagtaataaatgtttaaaacctttcatagttaataactcctttgagaatagtaagattaaattgttactaaatatacacttaaatgtttatttatgcaatagaaaatctatgaaaagaataaatattcatatatttgtataataattaaaagcggttacttagtttatggagtagtcaaagaataggtggataagaaatttaaatttttatttaaaagtaatgttgacagggtaggccatgttgggtaaaataatttttgtagtgaaaaggaagcagtatgcctgctacctcgatacgtaactttaagctcggagggagggatcaacatgtcaaaaacagtcgttcgtaagaatgaatctttagacgacgctcttcgacgctttaaacgttcagtttcacgtaacggaacattgcaagaatatcgtaaacgtgaattttacgaaaagccaagtgtaaaacgcaagttgaaatctgaagcggcacggaagcgtaagaataagcgcggtcgtcgttactaaaaatgtgtgctctcacctgttgcctggtgagagcttttttatatgaaagaaggataaataatgagcttactacaacaattaacgtcagacatggtatcagcaatgaagaatcgtgataaggaaacattaaacgttgtccggatgcttaaagcagcagttcaaaatgaacaaattgaacttggccacgatttgagcgctaatgaagaaattgcggtaatagcacgtgaatataaacagcgtaaagaatcgcttgaagaatttgaaaaagctggacgagaagatctgatcaaccaagctaaaaatgaattagcaattgttgaaaagtatatgccaaagcagttatcaaaagatgaagttactaagattgttaaggaagtaattgatgagcttaatgcttctagtatgaagaacttcggacaagtaatggggtcagttatgcccaaagttcaaggtcaagcagatggaaaattagttaaccaggttgtaaaagaacaattgagtaagtaatattagctgtaaaacaacctaagattagttcaggacaaaaataattattgtcctggacttttttgttattctgaagatagagctaagatcgatcatgctcccagggacttcgagtccgtattataaaatgatctccgctatctttgatttgatattttgcttttaggttgtggaactacgagttcgagtatttaggaaatgaagtacaaatctaggatagcggttatatctagctctatttataaaaaggaagtctttttatgtctgatatatttgccttggatgtttcaatgaggaaaagctactgtgtctggtatcgagggaaacactgtttaaaggagttttctttagtacacacgaaagcggggtttaatgctctacgagatatgattaaaaaagctcagaagccaattatctactttgaagcgactggaatttattcgcgagtaattggacatttctgtgagactaatggtctccgcttttgccgtcttaatccactagaacttcatttaaagtccgagagtctacgacgagttaagaccgatcagaaagacgctcatcggattgcgctcactgtccaggaaaatgcttttcgattaacagttccttggaaaaaagactatcttcagttacatgagcttagtcggttttataatcagctcaatgctgattggaactatcgtctaaatcatcttcatactgcacttgaacaagtttttccagaacttaagcaattatttgtaaatagaacatctaaattagcgttgaatatcgtggagctttttcctcatccagcactagttaggccttattcgagagttaaattaaagaatattctaatggcctctacagataaacgaatatctaagatgaaagcttataagtatgccgatcgattaatcgatctcgcccaaaaatcatatccggctgtttctggtgataccattcaggttgatgaagttcgctactacgctcgccaattaattgccttaacccgtaaaaaggaagaggtcatcaagcggatggaatctattgcccagcgcttaccagagtatatcctatactgctcttttccgggaattgggaaacaaactgcggctcagttaatgggagaattgggcgacattagtcgctttgacaatgctaatcagcttaatgcctttgttggaattgatattcgtcgttaccaatctggaacctatttaggtcaagatcatattaataagcgtggaaacccgattgcccgtaagctcttatattttactgtaggtaatatgatccgccaacaacacgctaattctaatcatattgttgactattactatcgtttaaaagaaaaacgacctcgtccaaaactgaacaaggtcgccatggtagcttgtatgaataaaactctgaaatgtctcttatccatgattaagcaccataaaaaataccactatcggtatacggactcaatagtccctgtgaaggcataaccacctcacaattttaatataccactaattctcgatttttgaagaagaaccgggttggtttagtatactcttcttttctaaatatttttcttgactaatcgtaggaaagggagcgagacagaagtcacttgtgacttcgtttttcgatgcgaagctagcctctgggagcccccgcaagcaacaataggcctctaacgatcggttttgccggacgttagaggccattgttgtactgcgtatttgctttttatgaaagtaacttaacttatgtcacagtccctttttactgtacatttttactttttaaactagaattaaggcatattcaaaagaaaaggggcatttatatgtgcacatcagtaatttatacagcaggtgattattactttggccgtaaccttgatttggaagttaatcttggtcaagaagtagtgattactccacgtaataagactttagaatttcgggaaatgccaaaccttgaacaccattatgcaattattggaatgtcgattgttcgtgatgattatccattatattttgatggggtaaatgaaaagggtgttggaatggcaggccttaattttgatggtccagctcattatttcccagttcaagaaggaaaagataatattgcatcatttgaattagttccttatattcttgcggctgcttcctcggttgctgaagcgaagaagttactttcaaatgcaaacattgctaatatcaatttttctgataaactccaagctgcaccgctgcactggattattgctgataaaacgggggcttctgtgactgttgaatccaccgcaaaaggattgaatgtttatgataacccagttggtgttttgacaaataatccggagtttcctcgtcaattattaaatcttagtaactatcgtagtgttgcacctgctaatccggctaacgtatttgcacctaatgtcgacctaccagtttatagccggggcttagggacccattttctcccgggaggaatggattctgaaagtcgttttgttaaggctacattcactaagatgcatgccccagttggtaattctgaagttgagaacattaccaactatttccacattcttcaatctgtcgaacaacaaaagggattggatgaagtagcaccggatacttttgaatatacgatttactctgatggttcaaacctaaagaagggtattttttactacaagacttacgaaaacagtcaaattaatgcagttgatatgcataaggaagaccttgaagcatcagaattaattacctatccagttcaaaataaacaaattattaaccaacaaaattaaataattattctatctctaaactctttttatgcatgaacaacttatattttatgcataaaaagatattttttgaaaaaatatgctaaaactattgatttttattcataatactcgtatatttataaacaacgaatttcaaatgagatggaggacgagattatgtcaaaagaaaaaattgttttagcttattctggtggtttagatacttcagttgcaattgcatggctcaaaaataaggggtatgacgtaattgcatgttgtattgatgtgggtgaaggaaaagaccttgaagcgattaaggaaaagggtcttcaagttggtgcgtggaagtcagtagtgattgatgccaagcgggactttgctgaacaatttgtattaccagcccttcaagcccatgcaatgtatgagcaaaagtacccattagtttcagcactttctcgtccattaatcgttcaaaaactagttgcagttgctaatcaatacggtgcgactgctattgcccatggttgtactggaaagggaaatgatcaggttcggtttgaagcaggtattcatgctttagcaccagatatgaagattgaagatccaattcgggattggcactggtcacgggaagaagaaattcaatacgctaaggataatggcattcctgttccaatcacaaaggctagtccttattccattgatgagaacttatggggccgggcaaatgaatgtggaattcttgaagatccatgggctgcggcacctgctgatgcatatgatcggacagtttcaattgaagaagcccctgataccccaaccacaattgaaattgcctttagtgaaggggttcctacagcaattgatggtgaagaaatgccgcttgaccagttaattatgaaactggacaaattagctggtagtcatgggattggtcggattgatcacgttgaaaaccgacttgttggtattaagtcacgggaaatttatgaatgcccagctgcaactgttttattggcagcccataaagacttggaagacctgacccaagaacgggaagtagcgcactttaaacccctaattgaacaaaaaatgagtgaaattatttataatgggctttggtattcaccattaatgaaatctttagttgcttttattgatgaatcacaagcagttgttaatggagtggtaagggttaaattatttaagggaaatgtaatctgtgaaggtcggaaatcaccaaattcactttatgataagaacttggcaacttacacttccgctgatgaatttgaccaagaagctgccactggctttattaaactttgggaattaccagataaggtctatgctcaagtacaaaacaaaaataaaaagaaagtaaaggagaatacaagcgatgcctattaagagaatgtggggtggacggtttgaagaagccggtgaccaactagttaaccaatttaatgcgtcaatcagttttgatcaagaaatggctcaagaagatattgaaggctcattagcccatgtaaaaatgctgaaagaaacacaaattttatcagcagatgatgctgataagattattgctggacttaagaagttacgtgagcgattaactagtgaaggcctcccattttcgattgacaatgaagacattcatatgaatattgaggcattgctgacagaagaaattggccccgttgctggtaagcttcatactgggcggagcagaaatgatcaagttgcaactgaccttcatttatatgtaaagaagcggttgcccattatcattaatgaattgaaaaacttacaggcagaattagtagataaagcagcaaaaaatgttgaaacgattatgccagggtacactcatatgcaacatgctcagccaatttcgtatgggcactatctcatggcttatttccaaatgtttcagcgagatgttgaacgttttgaatttaaccagcagcacacggatttatcacccctaggagcggctgctttagctgggaccactttcccaattgatcgacaattaagtgcaaagtatttaggttttgctgaaccataccataattcactggacgccgtttctgatcgggattttgcccttgaatttttaagtaacgcaagtattttgatgatgcacttgtcacgattatgtgaagaactgatttattggtgtagttatgaatttggctatttagaattggcagattcatattctactggtagttcgattatgccccaaaagaagaaccctgatatggcagaattgattcgtggtaaagttgggcgagtttatggtgatcttttcggcttattaacgacaatgaagggacttccgcttgcttataacaaggatatgcaagaagataaggaaggattattcgacgcggtaaagacgattctcccaagcatcaagatcatgaccgggatgattgccacccttcaagtaaagaaagaagccatggagcatgcaactcatcatgacttttctaatgccactgaattagcagattatctcgctactaaaggaattccgtttagggaagcgcatgagattgtcggtgagctagtactgaagggacttaagacagggacaaatcttgttgatattccattagacgaatataaaaagatttcgcccaaaattgaagaagatgtttatacctgcttacaacctaaagtagcagttgaacggcggaattcttatggtggaactggttttgatcaagtttgtcaacaaattagagatgctaagaaaattttagaaggtaattaatttccacgatatcgtaacaatattcgtaaaaagaggctatcgaaagtgattagcctcaatttttttactcaatagtaacccttatattgaatcgaggtttactattgaatataattaatgcaaaaagaaaggatttacgctgatgattagggaaaagataagtttatcaatttatgaaatgactgtcgttgccatgatgattgcaattattgttattttaggagcagtcccgggaattccggtgggggttattccggtgccaattgttttacaaaatatgggaataataattgctggagaattacttggaccaagattaggaacatttgctgtatggctcttcttgtttttagttgtgcttggattgccactgctttctggtggacgcggtggaatggtgacaatattaggtccaactggcggatatatttttgcttggttatttgtcccattgttgattggttttagtctaaaattaagttggcattatgggatgacacaggggataactgaatttctaattgtttggctatggggtgtaatctttgtggaaggagtcggcgcaatctggttagctaatcaattacataccacgcttatttctgccttggcttccaatgttttatttgtttttggcgatacaatcaaagcgcttattgccgtctcaattactcgccgtttacgacacattaaggttttttgttaagaagatggttagaatggttcattcgacggcacagaaaattttatggcaattactttcagcaccagattcatggatttctggaaatgatttagcaaagcgatttaatattagtcgtgaatctgtttggaaggccatcaacggtttacgaaaaaacggaaataatattgaaagtcgtagaaaccttggataccgttttaccggaaattcaaggttgagtgctgatattattgatttttatactcataatcactttaagaatcgtctttacgttgaaaatcaggttagttcaactcaaagcatcgcgaaagcttttttgagtcaccaccaagttagtgcgccaacggtatttatcgctgatcatcaaactgctggctatggaagacagggacggtccttttactctccggcagcaactggcttgtactttagtatgattctgcctagcccaaccgacagaccactacaagctgggttaatgacaacgacttttgcagttttaattgtggaagttcttaaacaatttttccctgctcaagactttcggtacaaatgggtcaacgatatttatttaaaccataaaaaagtcggtggaattttgaccgaggcagtagtagaccttgaattaagaacaacggcatccttagtggtaggaattggtttgaatataactacaaaagaatttccgctgggccttaaaaataaagcgacaggaatagcaccagcagatcgtaatcttttagtcagccgtcttattgagacgattgctaataattatttagactatgataatccacagtatcttgagcaatatcgccaagactcaatgattttaggacagaaggtggacttggtagtaaatggtgaggttattgctggaactgctaaaaaaatcgaaaatgatggtgcgttaacaattcgcctggcagacggaaaaacgaaaacttttaatagtggggaagtagttaaagttaattttgaaaaataacttagatcccttagaaaagcttgcagtgatgaggttaaaggtgatctatgatataattatcattaaataaaatctgctaaattaaaggagattgtataggtgggagaacaaaaaacgattgaacaaacttttcaaattgaaagtccagaaatagaagttggcttactaggaacacaggataagtttgtgagcctgattgaacaaggaatggatgttgaaatccgaccattcggtgaaaatcttaaagtaagtggacaagaagaagacgttaaacttacgatcgatgtatttcgtgcccttatttcgttgctaaaccaagggatccgcatccacagtacagatattgttagtgcgatgaagatggcgcatcgtggaacactggaatattttgctgacctctacagtgaaacgattattaaagatcgccggggaagagccattcgggtaaaaaattttggtcagcggcagtatgttaacgcaatgaagcataatgatattacgtttgggattggccctgccggaacagggaaaacttacctagcagtcgcaatggccgtggcatccttaaagcgtggcgaagtggaacggattatcttgacgcgaccagcagttgaagctggtgaaagtctaggattcttacccggtgaccttcgtgaaaaagtagatccttatttacgaccaatttatgatgccttaaatgatatttttggggctgatcatacacagcggttaatcgatcgaggaattatcgaaattgcaccccttgcttatatgcgtggacgaactcttgatggagcttttgtaattttagatgaagcccaaaatacgactaatgcccagatgaagatgttccttacccgtttaggatttggctcaaaaatggttattaatggtgatgtttcacaaattgaccttccacatgggactcgcagtggtcttgtaaacgcgcaacgaattttgaataatattaagtcaattaagtttgttaaatttagtgcagaagatgttgttcgtcacccggttgtagcacggattattactgcttatgaggaccaaacatcaaagcgattagcagaaaaagataaagataaagagacaaaagaggaaaaatgatggacttggaaattttcgatcaaacaacagcacagcttccaaatgaacaattggagatggtaagggacttattacagtatgctgctaaagaactttccttatcagaaaatacagaaatgtctttaacgtttgtaaataatccagagataaaaaaattaaatgcccagtatcgtaatgttgaccgggcaactgatgttttaagttttgccgcagaagaagcgggagatgaaacaccaattattatggatccccaaatggccgctgaaatccctgttaatcttggtgacttatttatttccatcgataaggtagcagaacaagcaaagtttttgggccattcagttgatcgagagttaggatttttagctgttcatggttttcttcacttaaatggatatgatcatgaagagccggcagatgaagaaaaaatgtttaaattacaacgggagatactagacggttatggactcacgcgataaacatcaaactgagaaaaatcatcacttaattcaagcaatgtgtcacgcaatcgatggaattatccaagtattacgtgaagagcgtaatatgcggtatcatcttttagctgcctgcttggccattattatgtcggccttattgcagatttcagcaatggaatggttatggattttattagcaatctttgttgtttttacatctgaatttcttaatacggttaccgaagctgttacagatttgattgttgatcaccattatgaattaaatgtaaaaaaagctaaagatgttgctgctggtggcgtactgatttcagcgatattttcggttttggtgggtctaattatttttattccccgtatattagcaattattagataggaagttttaatatggataatcccaattataagtctggctttgtggcaattattgggcgcccaaacgttggaaaatcaactttattgaattatgttgtcgggcaaaaggtagcaattatgagtaatgttgcacagacaacgcgtaataagattcaaggaatttatacaagcccagaagcacagattacttttattgatacgccaggaattcataaaccatctactaaattaggtgatttcatggaaaaatcagcaatgtcagcattagatgaagtggatgctgtcttatttgttgttagtgcgactgagaagcgcggccctggtgatgactttattattgaacgcttaaagaaagttaatcagccaatctttttagttgttaataagatcgatcaaatcaatcccaatgatctgcctgaaattgttgatcagtataaagatacccttccatttaaggggattgtaccaatttcggctttgcagggaaataatgtgaataacttaatcaatgatattattaagattcttcccaatggtccgcaatactacccagccgatcaagtaagtgaccaccctgaacgttttgtgattgcagaaatgatccgtgaaaaggtctttttgctgacgagacaagaagtgccgcattcagtagctgttgatgtaacatcgataaagcgtgaggatgaaaatcatattcatatctcggccaatattattgttgaacgtcctggccaaaagggaattattattggtaaaggtggaaaaatgctgaaaaagattgggacaatggcccggcaagatattgaaaaattacttggtgacaaagtatttcttcaactatgggtaaaagttgttcctgactggcgtgataagtctgcaatgctaaaagactatggttatcggaataaagactattaaaaggatgatggttacatggcacgcgtaaccacacaatttactgggatcattatgtaccgacaggattatcgtgaacgcgacctattagtaaaaatgctcactgataagattgggccggcaatgttttttgtaaaaaatgctaaaaaacgtggctttcggatgactgctgatatcctgccattcacccatggtacatacattggctcgcttgatgaaaatggcttaagttttattaatacagcaagtgatactagccaatacaagaatattgcaagtgacattagcaaaaatgcatatgttacgtatattttggcattagttgacagtgcttttaatgacggtcgaagtattggtggctggtttaatcaagttgctgcagccttagacttaatcgaaaaaggattagatgagcaaataattacaaatattattgaaacacagctgttagttgcttttggtgtagcaccaatttgggatcggtgtgttgtttgtggccgcaatgatctggctttagacttctctgaacaatatggagggatgctttgtcagaatcactggtcacttgatgaacatcgtcttcaccttgaccgtaaaactgtttattatctccaacagtttgccacaattaacttgcagaaattgaattctattcggattaatccagctactaaacgacgtctccaacaagtcttggatactctttatgataacgaggttggactaaacttgaaggcaaaacggttcattagacaaatgattaagtgggaacaaaatatcggaaagttatcaatgaacgattgacatttgtaaaatatttttctattataagagcgtgtttaattgaatattggcaatgacagagattatggataaaccaaatcagcgatcaggggatagtgcaagccttgtagtttatttatccttggcactctaacagccgcttaaactaagctgttttacagagatgtaaaaaagtagggtggaaccgcgattaacttcgtccctacagtatcaattatttgatactgtagggactttttcattgaaaggagaagtaaagtatgacgaaaaaattaaccgtgcaagatattatctttacattggaacaatattgggcagatcaaggctgtatgttgatgcaggcttatgataacgaaaagggtgcggggacaatgagtccttacactttcttgcgggcaattggtcctgaaccatggaatgtggcttatgttgaaccttcacggcggccagctgatggtcgttatggtgaaaacccaaaccggctttaccaacaccaccaattccaggtattaatgaagccttctcctgataatattcaagaattatacttaggaagtttgaaaaagttagggattgatcctttagagcatgatatccggtttgttgaagataactgggaaaacccttcaatgggctgtgccggtgttggttgggaagtttggcttgatggaatggaagttactcaatttacttacttccaagtcgttggagagttgccaatgagcccagtggccgccgaagttacttatggacttgaacggttggctgaatatattcaaaatgttgactcggtttatgacttagagtgggcggatgatgttctgtatggtgatatcttccaagaacctgaatatgaacattctaagtatgcgtttgaagaaagtaaccaagatatgcttctacaagactttaatgattacgaaaaagaagctaaacgtttaattaagcttggattagttcacccagcttatgattatgttttaaagtgtagtcatacctttaacttgttagatgcgcgtggtgctgtttcggttaccgaacgtgctggttaccttcaccgtattcgaattatggcaaaatcaattgcaaaagcctttgttgaagagcggcgtaaacgtggcttcccactgattcatgacgaagcagttcgccaaaagacagttgaagaatatacaaaaaaagcggaaaaagcaaaggaacgggccgcaaagcaagcagctaagaaagcacaaaagggggaaaagtaagatggcaaatacatacttattagaagtcggtgttgaagaaatgcctgctcacgttgtaacaccaagtattaaacagttacacgaacgagtagaaaagtaccttaaagaacaacggattacttttgatgatattcaagaattcgctactccacgacggatggcattactaatccatggcttaagtgataagcaacctgatattgatgaatcagttaagggccctgcaaaaaagattgcgcaagatgctgatggtaattggaccaaagctgcaattggttttacccggggacaaggtgcctctgttgaagatattgaattcaaagaagtaaaaggcgttgaatatgtttttgttgaaaagcatattgctggaaaaactgttgctgaagttcttcaaggattaccagcagttattacttcgatgacattcccaaccttgatgaagtggggctacaataacttgcaatttattcgtccgattcggtggctagtttcattattaaatgatgaagtcgttccatttaatattttggacgttgaagctggtcgagaaacacaaggtcaccggttcttaggccatccagttaaaattgctaaggctgatgattatgaggaaaccttaaataatgatttcgttattgctgatcaaacaaagcgaaagaatttaattaaggatcaaattactaagattattaatgagaacaactggcaagttgattgggatgaggacttactagaagaagttaataacctagttgaatggccaactgcctttgctggatcttttgatgagaagtacttagcattacctgacccggtcctaattacctccatgaaggataaccaacgattcttctgtgtacgggataaagatggtaacctcttatcgcactttatttctgttcgcaacggtaacacagactaccttgataatgttattaaaggaaatgaacgggttcttgttcctcgtcttgaagatgctcaattcttctatcaagaagatcagaagttgacaattgatgaatatgtggaacgacttaagaaagttagcttccatgataagattagttcaatgtatgacaaaatgcagcgggtcgcagtgattgcgaatgttcttggtaagcaactaaatctttcagatgaagaactagtagaccttgatcgagcagcacatatttataaatttgaccttactacgcaaatggtgggtgaattcgcagagttgcaaggaattatgggtgaaatttatgctaagctattcggtgaaaaagatgatgttgccacagctattcgtgaacactacatgccaatctctgcagaaggagaattgccacaaactaagattggcgcggtcttagcaattgccgataaacttgacagtatcatgagcttctttgcagttgatatgattccaagcggttcaaatgacccttatgctttacgtcggcaggcatttggaattgtccggatcatcgccgatcgtggttggaaccttccattattaagtattcaatcagaaattgcccctgcctttgaaaacgctgaaatcaatgtttcttttgatttgaataaaaatagtgatgaagtccgttcgttcttcttggaccggattaagcaattattccatggtcaaaaggttcgtcacgatatcattgatgcagctaccgatactcgtcaaaatgatattgctaatatccttgaagctattcaaactattgatgatcataaggatgatgataactttaaagaagatattgaagctcttacccgggtattacggattgcaaagaaggataaacgtccagttagtgagcttgtagtagatcctaatttatttgagaacccatctgaggctaagatgcatactgctgtttcagaattgattaaggaaaatcaacagacagtaagtgaaaactttgcagccttacggactttaacaccaataattagtgaatattttgatgaaaatatgattatggataagaatgaagatattcgtaataatcgtttggcccaattaagtattttggctaatcaagcatcattaattggtaacttggataacttgattgtaaaataagacgttttaattgtattgctgctaacttgtggtattatagatactagttaaatgtaaaaataggtggaggtcgcattccgttaggttgcgacctttcatttcgttgctgttcgcttactaagtgaggtggatcaatggcaaagataccgcgtaatgtaattgatgaaatacgaaattcagttgatattggtgatgtaattgggcgctatgtccaactgcatcaggctggaaaaaatctaattgggttatgtccctttcatgatgaaaagaccccctctttttcggtgaatgaggaaaaacaatttttctattgttttggatgtcaccggagcggaaatgtatttcaatttttgatggagttaaagcatatcgattttgtcgatgcagttaaggagatcgctaacgatagtaatatcaagattcctgaacaatatgttagcgttccggctaaaccattaaataacgagaatcgacagctgtttgatcttcatgataaagcggctaaactttatcaccatatattggtaaatacaccggctgggcaagttgcacttaattatttaaaaaaacggggaatgagtgaggagctgattgaacaatttggtttaggctatgctcctgatcagcgaatcttgaagcctttcttccaacagcaaaaagttgattaccaattgctaagaaaaagtggactttttagtgaagatcaacaaggagagttgcgagaccggtttattgaacggataatgtatccaataaaaaatggtcaagggcaggtaattgctttttctgggcgattaattgataccagtaaaacaaatttacccaaatatttaaatagtcctgagacaccgattttcaataaacggcgaacattatttaattttgatgttgcacgaaaagcggcacgtaaagatggtcgattatacttatttgagggatttatggatgtaatctcggcctttgctgcagggatcgaaaatggaatcgcttcaatgggaactagttttaccgaagagcaagtagcgattattggtcgagcaactaggcaattagacatttgctacgatggagatcaaccgggacaaaatgcaattgaccgtgcaattagcctcgttaatgatcatcgacctaatcagttgcaggtaaaggttgtccaattgccggctgggatcgatccagatgaatatgttcaaaagtatggaccacagcaattcaatgcctatcttacgaataaggaagaaacaacaacagaattttacctgcactttttaagaaatgggaaaaatttagataatcagaatgaactaatgcaatatcttaaccaagcgctgaaggtaattgctcaggttcaagctcccttagaagaagatatgtacttgcaacggttggcaggtgagttcaagttagatcgacaaaccttaaaaacgcagttagatcaattgcgacaacaactaggaattcataatcagccatggattaagcaacagccttcactagctcgtcatcaacagtttcaacaaactagtgaagaagaacagcaaaaaattaaacttagtaggactgaattagcggaacagatcttattaaggtacatgctatatgatcgtgaagtatggatgcatgtgacagcagatcacaattttcattttgcacatgagaaatatcaaactttgtatttattagcagcaagttatttttctgaaaatggctcgtattcaactgctgactttcttgattatttagatgaaagtagtttacaaggtactcttgggcaaattgagaatttaaatgttgaccaagaagttgatatgcgagcaattgatgattgtatccatatgatcgtagaacaaacaccgttagctgcgcaaattgcagataagcaagcccagttaaaagaagctaattcattgcataatacagaattagctacgcaattaacgattgaactggtaaaattattaaagcagcagcaacgcttaaaaacggaggagactaattaatatggcaaaaagcaaaaaaaaagacattgttatttctaacagcgccaattttgaccaacaagaatatgacaccgcagttggtaagttaattcgtaattacaagaagcaaaagcagattgagtacgatgaattaactactaaaattgctaaaccatttgaattgaacgctgatgggattgacaatttacttcaaaatattgaagatgccggaattagtgttgtcgatgaaaatggggatccagatcctcgtgctttaaaggctactgaaaaattctcacaatctgctatgaaggatacatcagctccaactggagttaaaattaatgatcctgtgcggatgtatttgaaggaaattggtcgtgtaaatcttttgacggctgatgaagaagttcagcttgctttacggattgaaaaaggtgatgaagtagctaaacaagaattagctgaggctaacttacggttagttgtttcaattgcaaagcgttatgttggccgtggaatgcagtttcttgacttaatccaggaaggtaacatgggacttatgaaagccgttgaaaaattcgattaccggcgaggatttaagttctctacttatgctacctggtggattcgtcaggctattacacgggcaattgctgaccaagcacggacaattcggattccggttcatatggttgaaactattaataaattgatccggattcaacggcaattacttcaagatttaggacgtgagccgttacccgaagaaattggtgcagaaatggatatgccaactgaaaaagtacggaatattcttaaaattgcccaagaaccagtttcacttgaaacgcctattggtgaagaggatgattctcatttaggggactttattgaagatcaagatgcaacaagtccagctgaccatgctgcttatgaaatgatgaagaagcaacttgaaaatgtgctggatacgttaaccgatcgtgaagaaaatgttctgcggcttcgttttggtttagatgatggtcggacacggacccttgaagaagtcggaaaagtcttcggggtaacgcgggaacggattcgtcagattgaagctaaggcgcttcggaaattacgtcacccatcacgttctaagcaattaaaagatttcttagaataaaaatattctccatttaatatatatacgtaaaaaagacggatttacactaaaaaaagtagtttaagttaattaattatcttaagctactttttaattttatttaaaataaatgagagaaatcttatttttatattgaaaacatttgattgttcgggtaaaatttttataaagcgttttttaaatctattataaataaaaattgaggagagatcgaacaatgccagaattatctgctgatttatatggaactgttagtcacaagttagatgcattacagccatcaggtatccgtgaattcaataaagaagtttcaaagatcccaggaattattaaattaacattaggagaaccagacatggcaactcctgaacacgttaagcaagcagccattagaagtattgaggaagatgattctcactatgctcctcaaatgggaaagccagaattacttgaagcaatcagtgattatattcagaatactcgtgatgtgcactatgacccgcaaacggaaataattgcgactgtgggagcaaccgaagccctcgatgcaactttatttgcaatccttaatactggagacaaagttgtggttccgaccccgattttctctctatatttcccattaattgaaatgacaggagcaacagttgttcaggttgatacttcagcagataattttgttctaactccagaaaagcttgaagaagttcttgaagaagagggaaaaggcgtcaaagccgttatccttaactacccaagtaacccaactggtcgtgaatatcctcaagaagttctagcaggattagctgaagtaattaagaagcatcatttatatgcgattgctgatgaaatctatagcgaactagtctatggggtagagcactattcaattgctactatgattccagagcggacaatttttatctctggactctcaaaatctcacgcaatgactggttaccgtttaggatatgttgcagctccggctaagatcatggctaatatttcaaagatgcatgccttcttagtcacaaccgtaactaataacgttcaagttgcagcggctgaagcactgacaaatggtttaaatgatccattagaatttcgaaagatttaccagcatcgtcgcgatttacttgttgccggtcttaagaaattaggctttgaaatgttaactcctgaaggggcattttacctttttgctaagattccagctcaatttggaactgacgatgttgcctttgcaaagcagcttgctaaagaagcaaaggttggagtaacaccaggtagtgcatttggtaagggtggcgatggttatgttcgtctgtcatatgcctcctctgatgaaaacctaacagaagctattaaacgaattggtgaatttttagaccatcttgcgtaaattagaaggaagtaggaataggactcctaagtgggtgctatcttgcttcctctttttgttataattaatttattaaatagataaaggaatgatttttgtggatgaaaagcacttatcagcacgtctagcatgtgttgcttcccttgttccagcaggtgcgcgggtggctgatattggttctgaccatgcgtatttaccagccgcattggtgttagatggtaaaattgattttgcaattgctggagaagtagtaaagggtccttatgaaaatgccgttcgtgaaataaaagaccaccaattagaaggccaggttatcccacgtttggcagacggtttagcagcgattgaaccagcagataaagtcgatacaattacgattgccggaatgggcgggagtttgattgcttcgattttagagaaagacaagaataagttaacaggaattaagcgacttgtccttcaaccgaatgtaggggaaagtcagttgcgtgaatggttaatgaataattattaccaaataatgaacgaaaaaataattgaagaagacaatcatatttatgagattatcgttgctgagccatcagttgtcccatttagatacagtaagtatgagcttgattttggaccatttttattggaaaacaaagggcctgtttttaggaaaaaatggcaagaatatcttcaacgtgaagcccatgttattgatcagatgcaaaaggctcaacagccaccagtaaaaaagattaatgagataaacgagtttttatcacaagtaaaggaagcgatcgccgatgacaaccggtaaccaattaattgcgcgttttgaaaaatttgctaatccgcaactagcagaaaaatgggatcatgtcggtctacaaattggcaatccagatctcccgattactcgactaatgaccacccttgatgttcgcccagaagtggttgatgaagcaattgaacaaaatattgactttatttttgctcatcatcccattatgtttcacccagcaaagaatctagatacgcgggatccgcaaaatgcaatgtacgctaaacttttggcgaataatattactgtttatgcagctcatacgaatttggatactgctaatggcggaataaatgactggttagcagatcaacttcacctaactaatactgtgcctttagtgccagcaggaaatgatccaataagcggtgaaccagttggaatggggcgtgttggtgagctgaatgaaccattaacatcgcaaaaatttgcaaattattgtatggatgtttttggcatccgcggattacggttaattgtcaacccgcttgaccaagagagagagattaaacgtgttgcagtacttggtggtgctggtcaagatttttatcaacaagctcttgaaactggagctgatgcttatgtcactggagatgtaagttaccactttgcgcacgatatgattgctaatcaccttgttgttattgatcctggacatcatattgaagtggtagctgcccaccagcttgctaacttaatcacccagtggaagaatgaaaataattggcagtttgaggtgctagagagtagagttaatacagagccgtttacttttattactaaataggttttagataaggagatgctaatcatgagtgaggaaaagtatgaggggttattaccacgttttttgaagtatgttaaaactgaaacaaggtcaaatccagattcaaaaacaattccttctgatcctaaggaaactgcatttttaaatgaattaaaagatgaattgatatctttagggttgagtgatgttcatattaatccacaaagttcatatttggtcgctacaattccaagtaatattgacaaggatgtgccaacggttggcttcattgcccatatcgacactgcagattttaatgctcataatgttaatccacagattgtcaaagattacgatggcaggtcagatattaagcttgataaagatggccaatatgccttaactactactgaatttccatcattggaaaaatatcagggcaatactttaattactactgatgggtctactttgcttggggctgatgacaagtcaggagtagcggagattgttacaatggctgcttacctgatggctcatcctgaaatcaagcacggaacaattaagattggtttaggacctgatgaggaaatcggcaccggggctgatcattttgatgttaaggattttggggccgattttgcctatacggttgatggtggtccacttggcgaattggaatatgaaacatttaatgcagctcaggcagaaattgagattcaaggaaaagatgttcacactggggttgctaagggaacaatgatcaatgctattcaggttgcaattgacttgcaaaatagcttgccagcacatgatcgagctgaacgaacagatggacggcaaggattctatcacttatacaagtttgatggaactgttgatcatgcttcaatgacatatttaattcgtgatcatgataagcaaacgtttattgaacggaagcatttactcgaccgggttgttgctggcctaaatgatgaacttggtgcagacctagtaacgatgaatctttatgaccaatactacaacttaaaagatgcgcttaagaatcacatggaagttgttgaaattgcgaagaaagctatggaaaatctagacattaaaccggatatctatccagttcgtggcgggacggatggttcaacaatttcttataagggcttaccaactcctaatctttttgctggtggagaaaacatgcactcgcgttttgaatatgtatcactgcaaacgatggaacgcgcattggacaccctgcttgagattgtgcggttgactgcggaagaagataaataaattaaaaaggatcgagccattttggactcaatcctttttaattaatcttcatttttgctaggatttgcatctgcggtaattttatccacacaattgataacgactaatcccataattacagaacaccagccgacaagggtgtagtctggtgtcatcgattctagttgacttgtgatgtaagctaggacctcacccagaataagtgcccaaataccagccacgatattctttaataaaaagttcatgttggtcatcccctttgaagtcataccatattctagcatatttattaatgcttttgaaagggttgggttaatttctctatttagtttgatttgatataattttattgagaggtgaaatgaagtggattttacgcccttagatgttaagagtagttatagtttgctaaaaagtcccacccggatttctgacctagttacaacggctaaggaacgagggtataaggcattagcgttaacagacgaaaatgttttatatggggctgtcgaattttataatgcagcaaaaaaagcaggaattaaacccattctcggcttgcggctggtagttgcattaaatgagacggatggtaccaagctagatttagtatttctagctaagaatcaacgagggtatcagcatctgatagacctatcgacgcttcagcaaacacgaaaagataaaaaaatacctttaacgattgcgcaaattagttgtttattgggtgaattgtttataattatccccccacaaagtacagtttttagtatacttgctcagccaacatcaattttaactgagcttgctaatctgggggatgatgatagcgttctgttaggagtcaattcgcggttagatgacgttcaaatagataccttgcaacaattatcaaaacaactatctttgccattagtagggacgtctccagttgattatttaaatgctaatgacctttttgctagtcgggttttacaagcaattgatgccggagttgagttaaaagatccgacaatagaagcgggacgaagaggacaacattatcttcattcgaaagaacagattgtccaagattacaatgcaaagggacttagtgcagccgcgcaaaagacagttgaagtagcagccctctgcaacgttgaacttcaatttagggccccggtccttcctcattttaaaaatcaagcagggataccatctcaacaatatttacgttctctatgtattcaaggattgaaaaaaagacgagtagcaccaggaaaaactattcaacagtaccaagaacgtttagcgatggaattaaaagtaatccatgaaatgggctttgatgattatttcttaattgtatgggacgtaatgaattttgctcaccagcaaaagattacgaccgaccctggacgaggatcagctgcgggatcattagttgcctatgctttagcaattacagaagttgatcctttgcaatacgacttattatttgaacgctttctgaatccagaacgagctcaaatgcccgatattgacttagatattcctgataatcggcgtgatgaagttttgcagtatgtacatcaaaaatatggtcatcaacgcgtagcccaaattattacttttgggacattagccgctaaacaagtcgttcgtgatgtgagtcgggtctttaacttgccccgttacgatatgcaaaggttaatcgatgcattaccacatggccttcacgtgacactcaaagatgcattaaaggagtcacaacaactaaaaaatcttcttgacgataatcctaaatttcgtttgctaattcaagttgcacagcaattagagggattgccgcgtcattattcaattcacgcggcaggcattgtcctttctgagcagccattacatgaaattgtgccgttacaagatggtagtgatggcttattaatgacgcagtttgccaaagacacagtagaagcgctggggctattaaaaatggatttcttgggattgaagaacctttcaatcatggataacatccttcaaatgattcggcaagaagaccctaattttgatttgcaaaaaattaactttaatgatccgttgactcttcaactgttccagcgaggaaaaactgaagggatttttcaatttgaatcaagtgggatcagaaatgtattggtcaatcttcacccaacgaattttgaagatattgtggcagtgaatgcactttatcgtccgggcccaatggaaaatatttctcattttaccgcccgcaaagctagaaaagagaaaattacttatcctgctccttcacttgaaaaaattctgggaccaacttacggtattttggtctatcaagagcaggtaatgcagttggcctcggtaatggctggctttaccttaggagaggcggatcttttacgccgggcaatgagtaagaagaaaaaggccacaatggaggatatgcggacaaaatttattgccggcgcaacagaacacggctattcagcacaagttgctcaccaagtatttgaatatatcgatcgctttgctaattatgggttcaatcgttcgcatgcagttgcctattctatgatggcgtttgagatggcatatttgaaagtttattaccctgcagctttttttacagccctaatgaatgcagaaactaatattgagaaattgaaacggcacgtgggggatgcaaagcaatttggcgtcaaggttagtgggccgcgaatcaatataagtgagagtagttttctattacatgatgggacagtttactttggcttttctgctattaaaggagtacgtcgtgattttgtcgccgcaattcttgaagaacggcaggaaaatggcaagtttacagatcttcgtaattttattgcgcgtattccagaacgttggcaaaagcaagaattaatcgaaccgttaatctatagtggggcctttgataagatggaatataaccgagcggagatgattgacgcccttcctaaattaatttccgggattgagttgtttgctggttttgctaattttgacgatccggctctccaaacggcaattgaccaacgaaatgaattccctctgttgacccgtttaacgaaggagaatgaatacttaggagtgtatctttccggccacccggttacccaatattaccaattaggacagcagctccatgcaactaaaattgctaatttatacccgaattcagaagcgacaataattgtccttacaaatcacgttaagactatttatactaaacgtgaacatcgggaaatggcctttgttaatggaacggatgagaccggagcaattgatattaccgtctttcccaaacaatatcagcagttcaaagagcaactagaaacaaataagattttaattgtcagaggtcgagtagaatatcgtgagggacggggtctacaattagttgctaatcaattgcaggatgttaaaaaagttcaacagaaacgccgcaagcaacgatgggttttacgaatcttaccgtcattagacactgagatggtgcatcgagagttaaataatatttttaatgaataccatggttcaattcctgtcttgttgttttatccagcaaacgataagaagatcctgcttgaccaaaaacgatggttaaaaaattctcagaaagcaaaaaaggcgcttgtcgccgttcttggccaagaaaacgttgtcttacaacagcttaatagtaatcactgaaagctataaaattaaataacagttagaaaaaataactaattttagaatgatagcgcttttttaaaaccttttgcataaaaaataaagacacgttatttgaaaagtgctatcataacagtgtgcaaatgaggcatacaattacagattgtgattgatgctatagatgcaaaaggagagattcatttatgaagaaaaccaagattgtaagtacacttggtcctgcaagtactgatgttgatacgatcgttaagttgatcaatgcgggagctaacattttccgtttcaacttctcacacggtgaccacccagaacacttgggtcggatcgaaaacgtacacaaggctgaagaaattactggcaagcacgttggtcttatgcttgatactaagggtgccgaaattcggactactgttcaaaaagaaggtaagatcaactttgaaattggcgacaaggttcgcatttcaatggatccttcaattgaaggtactcatgacaagattgctgttacctacccaggcttatacgatgatactcatgttggtggccatgttctttttgatgatggtttaattgacatggttattgatgaaaaagacgatgcaaacaaggaacttgtatgtcacgtcttaaaccatggtgttcttggttctcggaagggtgttaacgcccctggtgtatcaatcaacttaccaggtattactgaaaaggacagtagcgatattcgttttggtttggaaaacaagatcaactacattgctgcatccttcgttcgtaaggctcaagatgttcttgacattcgcgaattacttaaggaaaagaacatggaagatgttcaaattttccctaagattgaatctcaagaaggtatcgacaactttgaagaaatcattgctgtttctgacggtttaatggtacctcgtggtgacatgggtgttgaaattcctgcccaaaatgtgccaattgttcaaaagcacatgatcaagcgttgtaacgaattaggtaagccagttattactgctacccaaatgcttgactcaatgcaagaaaacccacgtccaacccgtgccgaagtatcagacgttgctaacgccgtatttgacggtactgatgctactatgctttctggtgaaagtgctaacggtgactacccagttgaatctgttgcaatgatgaacaacattgacatcaaggctgaaaaccacctttgggaattcggtactgaaaagttcgattgggacaagtctgacgtaactgaaactatcggttctgctgttgctaacgcagctaaagacttagacattcacacaattgttgcttacactgcttcaggctacactgctaagatgatttctaagtaccgtcctaatgctgatatcgttgcattaactccaaacgaacgtgtagaacgtggacttatgatcaactggggtgttcaaccatacgttgttgatgaaatgaagaacactgatacaatgttcgacttagctgctaagaaggctgttgaacttggctttgctaagaagggcgacaggatcatcatcgttgctggtgttcctttgggtgtaccaggtgcaactaacatgatgcgtgttaagactatcgactaatattttataatattgtctgcgaaaagatcggtcattagtaaccggtctttttttataccaatgataatcattgatcttactagcaaaataagcctttaccgtgtaaaatcgatatagaataaaaaaggataagtgataaaaatgaattcagcattaggaaaagttgttacagcggtaatgattgatgaaaatgataccgattattttgttcaaccagatcgtaatgggcaaacgtatcgattaccgaaaagcgaaagtcctcaagaattacatattggtggacaggtacgcggctttgtttatgaaaatgaggaccaccaactacagatgacctgtaaacacattccaacgatccaggttgaccattacgattatggtacagtagttaatgttcgtcgtgatttaggggtttttgttgatatcggtcttcccaataaggatattgtcgtctctttagatgatttaccaagcttgaaacacttatggccacaaccaggtgaccgtttattaatgtcccttcaagttgatgataaggaccgtctatggggtaaattagcagatgaccaaatctatcaaactatttcagcagctccagataaacgcttgctcaaccatgatacttatgccacagtttaccgtcttaagatgagtggaacctttgtgattactgatgattatcgtttaggattcatccatccaagtgaacgagaccaagaaccgcgattaggtcaacgagttaaagcgcgggttattggaatttcgtcacatggtagtctcaatctctcccttaagcctcgtgcctaccaagctattggtgaagatgcacaaatgattttgacaatgttagaacatggtataaatcaccgcttgccatacactgataagacggacccatcgatcattcgcgatgtctttggcataagcaaggggcagtttaaacgtgctattgggcatttgcttaaagagaaattagtaaaacaagaaaacggtcaattaatcctagtaaaagagaatcaagattaatgaataatgaagtggctgcgtttttagcttttttaaaagataaacgacaattaagcgataataccttgatgagttatcaacgggacttagaacaaactgtgacttatttagaagatcgaggaattgatgattggcaacaggtggaccactatttgctaattgacctccttaatagtcttcgtcagcagggaaaagctaattcaacaattaaccgtgtgatttcaagtttacggcaattttataaatacatgattcgtcaccataacctaaccattaatccaatggaaatgattgatcaccagtatacctttaaccaaccacctgcaccggtaattttaactgaaaaagaaattgaacaactgttggcagtcccggatgtttcaaccccaattggtcttcgtgatcgagcgttgttagagattatggatgcaacgggaatgagggttagtgaagtaattgccttggatctgacagcacttcatctcgacgttaagcttctacaactaacgggaaagaatgaacgtgagcggatgattcccttaagtcaaccagcagtcaagtggcttaccggttacctaaaccgtggtcgaccacttttgctcagagatgatcacgaaactcgggtgttcttaaatgctcatggttatcctttgacgcggcaaggaatttggaaaaaaatgaaggaatgggtcagtgaggctaaaatcaaaaaagaagttactcctcaaactatgcgttattcttttgctgttcatttaatagaaaatggcgccgatgttcaattaatccaagaaatccttggttataacgcgatgaaggctctccaaccatatttacaggtctcgccgcaacagttatccgctaactatatgaaatatcatcctcgtgcatagaaaggaaaatacgatgttagttcgttatcgaaaagattaccaaaaaatcgccctaggtttattgtccttagtaaaagaccttcgaaaagataatcgttttatggaagagatggactgggcactggctaatgattggccaatctttttgtggaaagacatggatgatagtcactttattggaattgtgatgatagaaataggggattgttacgtgctggttcgccgcttatcgtttacgccaagcgaacgaacggggtataatattttttccttattagatggcgttcacgatcaatatcctcataaacgcctcatgggaaccttagcaacccaaccaataattagcatgtgggagagaagtaatgaataagcaagtgcaaccacaaaatccatttcaaccggtcataaaggttcatgactttgaaggaccactagatttattgctccatttaataaagcaatctgaaatggatatttatgatattcagatttcgcaaattacaagccaataccttgattaccttcaccagatgcaaagccaccaattagaagtcgcgggtgaatattttgtaatggctgcgactctgatggacattaaaagtcagatgctgttaccttcgccgccagtattggatgatgaactagaagtagaggagcttgatccccgacaagaattagtggaacagcttttggaatatcagcgttataaaaaagcggcagatcgactaaaagataaagaaaatctgcgtcaacaggagtatactcgaccagcaatgcaagttccacgtgaaatggtaaaatctcacgtggagccgggcatcaaattaacggatttgcaacaagcttttgcagccgttcttcgccgccaacaattagctactccattagttgaaactgtagcagctgaaaaagtaagcgttggtcaacaaatgaaccacgtgattgaaattattcatgatggtccggttaggtttgaagacttgtttgaagatttacatactcgcgatggcttagttacaacttttttagcaattcttgaactggcaaagcatcaagcgattgttattaaccaaggtggcttgtttgaaccaataattttagcggagggatctaagagtgacgaatacgaaactaaccaaccaagcgcagattgaaggattactttttattagtggggacgaaggaattaccctaggcgatttagcaaaaatttctggttttatgaaaccggctgttctaacaatattacaagagctaaaaaagaagtatgaagatgatcccacatctgcttttatcttgcttgaaagtgatcagacctatcgtttagcaaccaagcctcagttagcagaggtcattaaacattactttgaagtcccgttaacggtaccattgactaaagcattattagaagtattggccattgttgcttatcggcaaccaattacgcggctagaaattgatgatattcggggagtgcaaagttcaggatcattacaaaaattaatggttcgtggtttagttgacactcatggacgtttggatgcaccaggccgtccatttttatattcaacaaccccggctttcttaaactatttcggtttaagcgatttagatgaactcccaccgttacccgatcaagacgaattagaaatgagcaatattaatggagatattttccttgaagcattacaggcgcgagaagaacgaaaggacgataattaatggaacgattacaaaaggcaatggcggaagcgggagtagcttctcgtcgggcatcagaaaaacttatccttcaagggaaagttgcagttaatggcaagattgtgactgaacttggcactaaagttagcgttcacgatgagattgtagtaaatggtgttccaatccatcacgaacagcacgtttactacttgttaaataagccgcggggagttatctcaagtgctcatgatgataaaggccgtcgaacagtggttgatattattcatgatgctgagattgatgaacgcatttatccagttggccgattggactatgatacaactggaattcttcttctaacaaatgatggtgctttggcaaataaactgatgcatcctaaatatgaagttgaaaaaacctatgttgctaaggttgaaggaatcgtcaaaaatgatgagttaaaacaattacgtttaggggtagtcatcgatggtcgaaagacaaaaccggctaaatcgaagctcttgaatgttgaccgtgccaagaagacaagccttgttcaattaacaatccacgaaggacgaaaccaccaagttaagaatatgtttaaggcagtaggacatccggtgactaaacttcatcgtgaaacatatggaccattaaatttatatggtcttcagccgggtgaattccgtgcattaaagcctgaagaagtgcagttattaaagaaaaagtaaaattgaatttgtgaaataatccgaaggcgcactgagggggcagaagatatctggttttacggaaaactacggaatagtacggaaaataagccaagttataaacgttgacatgacagtaaaagcctattagaataggacttgtaaaaatataaaacgtttgtcttcaagacaagatgaaaaacgaaaaagaaacccttgtatgccacgacttacaagggtttctttttcgtgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattttaaattgatttatatagcacaaatatagcagaaatgaaaagttttattgctagtcaaactcatcaattgaatcgatcatatcaataaacttttttgttgtacgtttagtaacatgtaaataaatccgccgggttatttcactgtcagcgtgtccgactcttttttgaattacccgcaaagggattcctaaatcagctaaatttgatacatgggtgtgtctaaaaaagtgagtagtaacttttttatttatctttaattctttgcaagcttttttaagaaagacgtttgctgtatttaatctcagtggtctttctggacgcttaggtgtgagtggctgggttattaaccagtcatctggatttttatccttcatgttgcgtttaacaatagttatggcttttggcgaaagcatgatctgcctaattccggcaatactttttgtacgatctgatttgatctgctttgagtgatcgtcggtaactaccattgttccattgatatcaagataagtatatccactttttttaagcacatctttaacttgtaaggcaatcaattctccaaaacgtaaacctgtaagatactgaagcttaaaagcgtcggcatagtattgtttgtgctttttgagacaatacttgataattttacgatattcagcatgagttaaatatttgttttcaattctatttcgccgtgcatctatttcgttgcgccaattcacttccgtatctttcacaggattaatattcaaatatccataacgattagcaaacttgtaagctaatgatagggctttgcgagtatttctaactgtactatttgatactgggtgctttttatcataaaggcgattatcaaaatatttatttaacattggagttgttatacgttttgctaacgtgtcacctccaagagtattacatgttgtttgtagaacatttttattaattatataagttcgaagagcaactcgatgcttatagtattcgagaaattcatcggtcagttcctgtaacgtaatattggtattgcttgattttatctccctaatacgtttttctatttttttctctagtttattagttgcttctttacgaacttggggcgtatttcgatcatatgatactgaaactgttttattttttcctgtcttaggatctttgtaacgttcaagaaattgataatgtataacttgaacgtttttgccttttattgttttgctagttttatacgaattaatccacatgaaaacgttcctccattcaaataaacataaatgttataatgaaggagttaaaaattaggggatataactgatttttaactcctcaatcaatctccattgcagtgaagattggtgaaattagtcaagcctatttcctattgcagtagggaatgggcttttttatttttcataggacatcacctccttaaaatgcaaacaggtgttcttttaacgtgctttttaaaacggccacggatttgaccgttttaaattcattagttatcgaatacttgtaattgttgatcttttgtatttattaaagcaacaagactattaaaatttaaaaattgaacgttatgatcttttgcattttgaatagatttgtaatgcttattagtaataccatttattaaatattgagtgttgttagtccagcgattttcaatgataccaccgcgtaattttatttgctcaatcatttgatcatgatcgaattctgggaagctaccaattactaagaaatgaataccgtttaatgagagcatcttatcattagcatctttaagaattttaggtaacttatcatctctgagatgcttatagacaagtgcagcagttttactatcagctagagcattatgtgacggctcattaatgccataatattcttttagagtaggtaattttaaatttcctaatactgttcgatctaaatgttttcgtgcgattataaaagtatcttcggcatagaactcgttaattgaaagaccactttcatataagaaaggaatatcaaaagcaaagatattatgaccgatccaaggaagatcacctacgaatttttcaaatgaaccttttatatcattaaaagttggtgcagctttcacgttttgagtagtgataccagttttattaattataaattctgtgagtggcaatttctctttacccggattaacaaaactattaaacgtatcaattagcttatcgtctacatacttaactgcagaaatttggataactttatcaaaagatgcatttagtcctgtagtttctatatctactgacacaaacgaattaagtggttttcttagtttatgaattattaattcgttcctctgatcaattatatgttccttatttttccctttacttgtttgagcaaaaggtgttttttctactgaaatttgaagactgaatgaataaggtttctcaccagtataaatatggtcatcaagattgactgctttatactttccaccagtcatatatccttttaccgtaagctttactaaatctgccctttccttttcaattaatcgtttaatatcttttgagttttctttaggaatgtatccgatcataaaagattgagattcaatgtaaataatgactttaacggcattgctatcatatttattacatagatcgggaattaatttgatttcatttattacatcagtgagatccgtttcatagacaggatcatcatcagtataaaaatcttcacggatctcagatgctgtcatatcatcataccttacaaaaaacaaatcattacttcttgcataaccaacggcattttttaatcgataatagttagtgcctgctacatcaatatatagtgtgttactagtagtttttgtttttttcttcgatttaagcgttatgttgttattaactaatttggcatgctccttaatcaagtcgatctcattatggtgtaaaacatgtttttcaacgttggtaggcaccgaaacttcaacatcggtgttcaagataggagtagtactaacttgattagtgggtggtgtattatttaatttttcgtcttgttcatgtaatttattgctttgtttaagcatatggttatactcactgtcttgataattaaagggtataaaagaacagatagcaattaatgataagcaaatgccaattaataaatttccttcaacaaaacttcctatagcaagatacgcaaatagagtagcatttaagtatagaggaattctaaagtcaatttgattacgataagtgttattaggaatattaatagctctttttttagttgcaagttgtgattggatatcagatgatatccatataatggtcatcaaaataaaaatgaagtttaagagtaaacccgaaatattgagattaacaacaaaaattaaaacaataaagctccaacaatatgctgcttttagtggatgatgcattgcccataagcgtaatttgttattttccatagaataatccccccaatttcttattcggctaaactaataattcccaatcaatgtaccgttcggcccaagaagggatgcgacagtatctcattagttgttcccttgtttcaaaatcatggacgttaactccatcaagcatcatatctaccataaatttgtttgcttcatattcttcaccaaaagtaacaaattttcgattgcttctattaagacattcagtattcccttggtgatgacaaaaatgatgacctaactcatgtccacatgcatatctattttcaaaattgctatttcgtgttgataaaacaatagcaggtactcgtagtattttagtatgataagccataatttctttcccaagatcatgataataataaggaatacccatttcttcacatattttaaaaggattgtgcgttccagttgaatagactatttcgtgagctttatgtttaatccattctttagataacatataagtcacctcattaatccttatcttttcgatattttttaggtgtaaatttttgcttagcaattagtttagactgcctaattacattttcaagcgaggcacttaataactcagcgtcttctgggtcaatttcctcgcctccatttttcaagaacgctaaatcagatttattatttaatcctcttgtaatatcttctaatatcttttgtacatctcgttcatctttccgagtaaattgtggagtatctgtgcgtcctagaagataatcagttgtaacattatagtgatcggcaactgccgccaacttttcagatgatggtgatcgtttatcccactttgtgattgttccgtttcctatacctagctttctttccaattcggcgagtgtctcgtggcgttgtgcggctaggccttgaattctgcttttaatagacattaaagtcactcctaatagaaacaaatctaaaataggggttgaccattaggcacaaatctaatatactgtaattgtgcttgagggagcacatagcaattacgataactgttctgatttaggagccttagtggtttcccttgtttttcttatactctaataatagattttagtctattatttgtcaatactaataggcaaaagaattaggcagttttctcacactagggaggtgaaagtgtgcctctatatacagctatcaaagaggttgcccgtgagcagaacaaatcgatctatcgcatagaacatgatttaaaaatcggaaatggcactatcgggcgctggaatactgcgttgcctcgatatgatttacttcaagccgttgcagattatcttggcgtaacaccacagtatttaatgcacttatctcaagctaaagaaaaggagtgattgtcacgaatgcgattaagcaaattgttactactataccggagataaatcacccaagttttcaaaatactactcacgaattcatgtttggaacgatgtttccaaagctactacggcaagtcacttttggaacagggaagggtggtcttgccaagtggggatcgaagaaatacgtcgccgacttttttgaccctgacactaatacaatttttgaaattgatggtgccagtcacaattctaaatatcggcaggttgcagatgcactaagagacaaattctttgaaaacaaagggatcaaaacaattcgcatatcaaacaggatggttgaacgactatatgtacaacaattaaaggaggatatagctatcaatgggaaaaaataccaacaagcctttaacgagtttttctgatcctagcttagatacttcaacaatagctttcctcaatcaaagtactcaccagctcatgaacgttgtttcggatagtgctactcaaatcggaaaaatcttatatgatgcacagaaaaaattagctagtttccataacaatggagcctttgccaaatggattgagtacatcggctttagtagaacttcagcttacaactacatcaatagatatgttgctgttcaaaatttggacagcagtaaagaaatacaagcgtttgagtctctgcccaagtcattaacttatgatatttcgaagccaagtgctgatccagagttaactaagaaagtccttaacggtgatattaaaactcataaagagtacaaagcactagaagctaaactcaaacaacgcgaacaagaacttgctgatcgtgacgaaacaattgctaatcaacaagctgaattagaggacaatcgtaaagtgcaactggagcttaacaaacgtaattctgaattatctaagcagcaaccagaacaaaaagttattactaagacagtaactaaagaagttccagttaagcccgatgattatgacgaaattaaggctaagattgttgaattgaaagaacagtctgctaaagacaaagaaaatattgagtattacaaacgagaacttaaagccgctgaacgtattaaaaaaaataccaatagttctgacaagttacaggaacaagaattgaaacgaaaaaagcgccaagctgaaattaacggctatagcacttcgttaaaaattaatgattggattcctgaattgcagaaacttagtcaagaagatattgatgagatgggtgaacaagcacaaaagaatctgcaaaagcgtcttgaattattacaacattcgattgatcgacttagttcaatgttaggcggtcgacgagttatagaaggagattatcagtaatgaaagaaacattaacagcaccggtaaaaagtaaagagaaatctagcttgtctgtgcttggaaatttagtaaaagcacaagcactccaagccgagattaacaaaatggtatatgaatcaattgctgaatctacggaacaagcaaagcaagaattaaaagaatataccaatcagagtattgaggagattaagaagtttattcctttaactgatggagaagcaaatcggcttaaacaagcaattacaagtcgagccgcagtgaccactaaatcatggttaaagcataaattcaataacccagaatatggtggtaaagaattcttttctaagaaatatgggcatattgttcgtgcattctattcattaactaagcaccattttggagcaattaaatatacagcaatccttcatagtgactttgaagaagcacttggttatgctaatcagcttaattactacagtcttccacaaaatgctaagcggattactgaatcgcaattagtcacccttaataagtgggaaaaggttcataaattgccattaactaaacctgaggactgattgaatatgagcgagaaaagaaccccacagcaactagcttttattttgattcattattggacacctgtgattgaagaatgtaactgggaaacgcaaaaggcatgggtcttaatgctagacgaaacacttaagcgactaacacctctccaatttgctcaagtatttccaatcaccaaagaatacaaaggacatacttggggaagcaaagattattacactgttacagattggataggggataacgtaggctggaataacaagattcctgatgggattaagttcttattggaatacttgaatatcaacgtacaacttacagcagtaagaattatgaacattttaggtaaatttcatcaacgccaaacgggaagtgatttactaatcgacttcttaaagtcacaaggtgctcatattcggtttacgaatcttgatgaggaggatcagtaatgaaatgtgatgacgtgaaaaccaaagacgaaataatgaaaaagtacgggctagaaaaaagtcaatttagcgatcttgtggctgagtgtgaactcaatgatgaatttagtacggcgattattagaattactggtcggacttactggattcatgaaaatgaatgggtagcctttttagaagacaaggcagcaaagtatcatcaacaaaaatctggacgtttacgaagaggagcataggatgacagaatttattgtttcaatttgtgtgatagcaatgtgtctcatcttaatggcaataattgatactttggttggtaatagtctcaaaatactaaaaccacgttatcgtgggcgacacaatattagaaaaaggagttttaaaaatgtttgaagaaccagaattaaaacaatgcgcagagtgcggaaaagatattgacccagacgatacctattacattgtaggagacaactatctgcaacgtaattattttgatgatcctgatggtaaagataatattttttgctcaaaggattgtctcttaagaagtctatcggtcttagagttcagtggtgatggtgacgattatggatttgaggtgtaaatggtgagagcttttgcatgcacaggaatatgtttcttgatgttcatttgctggcttggcggttggacactatttggagtccttcctttggctgtcttactgattcttatcttgctaggcgaattatttcctaacttattgcaatgaggggaggtgatataaatggaaatttcagaagaagagttaaacagaattattgaacacaaagttaagtatcaagtatatgaagcgctgaacaaaaggaatacgccgaagattactactggctggttgcaactaagaaaacgtatcgacagctattgtcacgatcatatgagttcaaaatggcgtcgaaaaacgtcttacaattctgttcaacaaatgttttatgtaccaatgaaaaagatacttgatctgcaccgtattgatgaaatgagtgaagaccaagtaccaatcgcaaaagaaatatttgagtttctttctgctgagtttgaaaaagtcgataagcaaaaagaaaaagagcttaaaactaccgcaaatagttaaaagctcatatcaaaaaacaatacacaaggtgagtataacacatgacacttaaaaatacgaaacaacaattattaatgtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggaagaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattcataagtatctaaaattattgttagctctgcttgatcatgatgacgaacggctttaattgctcgcatggctaactcgttgtgccggcctaaagtatgttcaattttctgtaaacaatgatagcggtcgagaaagtattcaccatgtgcaccttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtattgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattaattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaacattattaatgcagatgatgacacgtgttgacacgattgctgccatgataacacaagccaatggtggcgaaacgtttggtaaggaagtatatgccttaagcaaattacaaaatgaatgtaatttgctaaaaatcaatgctgacaatctaaatacatggtttgtagaagatattcataaatcaaaggagaaacagaagtaaatgttaaatcgaacaattttaacgggacgtctaacccgtgatccggaattacggtataccacaagtggaacggctgttgtacaagctacgattgccgttgatcgtcaatttaagaaccaacaaggagaacgtgaagctgatttcatcaatcttgttatttggcgaaaggctgcagaaaattttgctaattttactcacaaaggctcacttgttggtatcgatggtcgaattcagactcggacttatgagaataagcaaggacagcgagtttacgtgactgagattaatgtcgatagtttctctctattagagccacgtcaagaaaatagtcaacaatctaataataactattcctcacaggtaccaaataataatgcacacaacgcaacatcaaatagtcctcagcaaaaccagaatgctcagtcaaattacggtaatcagaataatgactttggcaatggtggacaaagtattgatctggctgatgacgaattgccattctaaatggaaagtggaaaagcttactatcgcaataacatgtgggtaattgttccagataaaaatattaatttggaacatatcgcaattttgaatgatggcttgatcaatggagttcctattcaatttgaatttacggatcctcgcaaggttcaccctaagcaacgcactctattcttcgcattgcttaatgatattcatgagtggtcagggatgcctaaagaaaaattaaaggaatatttctataaaagatattcaaaaatgacatctggtaaagagattagtcttgctgataatacagaaaatactgtaagtgacgcaaataagcttattaaggatgttatcaattttatctttgagtttgatgttcctgttagaaatggttataagctgttgccacgtaatgaaagctacttcatttacaagtgcttgctgaaagacaaatgcgttatttgtggcaaaaaggccgactttcaccatgtcgaagggtcagtagttggtatggggaataatcgcaacaaaattgatcattctaaacgggaactttatccgttgtgtcgatttcatcatcaagaaatcgaaagacttaataataaaaggtttgaaacaaaataccacatacatgttaaaggacttaagctgccaccagaaatcttaaagaaactgggggtcaaaggaaaatatggtgattagaaatggcaattattaggcaaaagcgaaaagaccgattttcaattatagacaaccgaattattgaggataaaaggcttagttggggagctagaggtcttctggaatatatgctatcaaaacctgacgattggaaatttcatatgagtgaattaatcacccatagtaacaaagatggcagagataaaacatatagcttcatggacgaactaaaaaaatatggctatgtgactagaaaacagaagcgaaatagtaatggaaaattcggtaatcaagacttagtcgtaacggaccaaccgcttacgggttttccgtatacggctaaaccggatacggattcaccggatacggtaaatccgacactactaaatactgatagtactaatactaataatactaatactgatattaataaacatagtgcatcgccaggcaatgcactgtccgtatctgtccttaaaactagctttgagaaactttggaaagactatccaaataaaaagggtaaaaaagaagcgtttaaccattacaaagcatggcgaaaggaatccactaagaatacggatgattacctggcaaagcaattgaagaagtatttagtttactgtgaacaaaacaatagttggtatcatcctatgaatggatcaacgtggtttaatgggcgatttgatgatgtccttgtaacagatggcattacgcctaatcaatttagattaaatcacggaaaacgtccacctattcgagagaaaatgcctgagtggagtaaaaaagatcaaaaagagttaaacaagaaagcatcccccgaggatattgctaaattaaaggctcggattgcaaatcgaaagaaagtgagcagctagtggaaagagagtatttaacaggaacgcagattatatttcgcaatggttttgagttaatagtaagagaatcaacccgagaaataattaatcaaggtctttctagtgacaggataattgttactcgtccttatcttgggaagatacagcgaattaatgtggaatggaacgatatggcaaaactaattgctataaaaaggagagagaaagaataatgtacatttacgaagtcacgcgctctaagggattatattttgtcagacatattgtgatagctaagaacgaggaaagcgctaaaaaattagttgcagatatgcttaatgtatttcagactgctattttctacaggcctactgattttgaagttagcgatccaattgatcctaataattatagagaggaaacggtgatttactaatgctacataaatacagaaagacagccttaatcgaggctgaacagtttaaggctactaataagcagataagtgattatcatataggattagatagaagtaaaggtcaccaccaccaagtagagtcttattatctacctactaaagagggagagatgttattgcacattggcgattacatcgctactggcatagatgaagagcactgggctattgatcaagatatatttgaacgaacttatgagaggtgcgactagatgaaacatgaagcggaacaagaattactgaaaacacttaatggacaattgagcgagttgccggccgttgctaagacaatggttcaacaatatcaaatgtcagcaatcgttctatcagttttatgcggtgtgctttttattgctgcgttaactggcactatatggctatcaattttcttttttaggaagcatcgtgattatcatgatagctatgattttgtttctgggatgacggcaatgtttggaggaacaataagtgtctgcttattaatggcattatgtttgaatattattcacgcttgtgcaccaattgcttcgattattaaagacttattgaactaaagaacgaggtgaaaatgaaaataatattcaatattgagcccgtcgaacaggcacggcctagagcaactaaaacgtggaaaggaatacgcttgtatgatccgaaaaaggtatcgacctacaagaaacagttggggatgatgtgcaaattccagtacaaggataagccactaactggcccgttaattgttagtcttaaattttatcgacaagttcaatcaagcgtatcgaaaaaagagcgtgaattgcgcctctcaggaatacacagaccgattgtaaaaccggacacggataattacatcaaatctactttggatggcttaaacggtctgctatgggaagatgacaaccagattgtaaagatagttgctgaaaagtactacagtgatcgaccacgtattgaaattgaagtagaaaggttagaacaaaatgaagatgaaagaggcggaacaggcgctaaagaataacactttagttctttatcaagatactttgtgctcagtagttagtgttgattatgatcacagccgagtaatgattagtgaggacgaacgggaaaagttcggtgaatttgtaagtcggtatgttgatccagaacaacttgaacaagtagtcaggagtaactatgactgattaccttactaaaaatgactttctaactcacttacggaatttagaagataagtacggtaaacgattaaatgactatgatttcaatttagatgatttagttcaaagcgatcacgaagactaccaagcgattttagaatttcgagagttagtaaaagatagacggagagcgaaaataaatcaccgagatttaatcgaactgctaaatacagaacttactctaaaacaaatagcagaaaaacttaattgctctacgccaaagcttcgaagaacaatcgaagctaatcctaaacttagaagtaagtatgaagggttgatagataagcgaaaagagatgtcctttgatagtttgaaactacggcatgctcgtcaaaaagaacatattggcaaagagattctaaagttaagaatgaacatgaatctaacgcaagatgaggttgccgataagataaataaaattttaggtacgactacgtgttcaacagggacagttagtaactgggaaagaggagtctcaatgccaagcaagaaaaggctcgaggtaattgctaacttatgcaacacgacagtaaaagaattgatggagagagaatattgaaaattaatgaattcaaaaagaaattatctaggtatggtttcagtgtagctgaaagtattgatggtttgctcacaatttatttaggtaaatacccactgcttacctttgatcgatgttcaagcatgtttaacactgttaaattaaatttaaatactgtaccagtgattgatatatacgggcttttcaatcttttggaaatcacaaaggaatatgtcgatacacctattaaagaacgttttcctgaaaagaaatatgttttatctgcaatgcgatgtgctgagggaccagtgcctgttaagcaatatgttgatgcaatgaatataagcgctaataatgttgagttccattttggatttgctaatgaaaaagctgatgctatggaatttacgcaaaagaaactagatagtctttcagatttctttcctaaagatgcaattgatgcaatgaaagaacctgtggaggacaagaatgaataaacgtattgaagatatagatattacgcaagaaaatgtggataacttttttaaatcgccagaaatgaagcaattttttaaaaatttcaaatatatgcttcatggatataagccgatcaagcgcactcgtaagcgtcagattgctaaggctaagcatatgatggcttggcacgatcacacgagttatgagtggtcacaatggtggcacaagaaagctagaaagcctaagaggtggaagtaatgaagcaattaccgttatgtgtggggattgtttgtgtaacggcaattattatcacaatgattatctgcaaggttagccttgaaacaatatttagtctgattattggattgatgattattgctttcgtagttgccaacttaattgatttatgaggagtttgaagaaatgaatgaatttggtgaaaccattgtcctaaaagttaataaagataaatgcttagctggcttttatgctctgggttttgaacctaaagagattatgggagttctatatcaagcgattaccgtgttatgtaaggaacagggagtagatccggcagttcaattaatgcagttgatgatagcaacggaggaaggaaagaatgatggaagagagagtttttgaagacgaacacggtagaaaattaattgtgcgggtgaataggtctaatattcaaatccacacagaaagaaaagatcttctagattatcggttctatttagataacattgatttacttaaattcttaaaggaacaagcagaaaaagtctggaagacgtttactcccaaagaagctaattcttttggggcagattattgggaattttatgataaaaatactgataacaacggatatttagaagttagtaaagaagctcttgtgtttcgaagtcccagcgatgaaacaactttgctatatcaatttaacaaacgaaagatggaaagctttatctacgatatggaaagctggtttattctatgaaaattcttgatgtgtgctgtggcagtcgcatgttctggtacgacaaagaggaaccacatacaacctacatggatatccgcagagctgtctacacagcaatggatcgtggtaatgagcgaaagattgaaatttatccagatgtgcaggctgattggaagagcattccattcgctgatgaaactttcgatttagttgtatttgatccgccacatttggtccgtgcgggtaagacatcatggcttgctaagaagtacggaaccattgatttaatgacttggccacatgattttcattgtgcctttcaagaaataatgcgagtgcttaaaccaactggaataatgctattcaaatggaacgaagatcagataccgattaaaaaaatattcgaagcgtttggccagcaaccaatattaggcgatatgaagagcaagacgaaatggagcgtctttattaaaaatggcagaaataattaaagaagatttttcaaagcaaaaatgcggtgtgtgccataaacgctttgctactaaatggtgcgattacgtgattcaatatcccgagtcaccaacatttatttgcggaagaacgagctttcaagattttttgtcagcacaacggcaaataacttgtgattgtgctttgtgtgatgagtgtgctaaaaatcacggcttaattgatttttgcccttaccacgaaaaaattgtgaaacacgagaaaatagatacgcctgattatgtagtaaagtcacgtgtggaaacatggaggagagaaaatgagtaaacaacgaaaagtacatcatgaggtagcgtcacgacaacatacgtatcatgtagcaaggaatttagcacataaatttggctacaggcataaaccacgttggagaaaaagctgtcgagaaaccaataaaagcgctagacaaatgacttatgccatgtttggccctgaatatatgggagtagaaaggaaaagctaatgaaactaactgaaaagcaaaagaattgtccgtactgtcacgttccatataagccatttatttcaactggtattgaaaacgatttggatttgggtagcggtaatggaccagtgtatgagggtataagcaatgtacttggtaaaggacctatcatggaaacaacattagggataatcaatgtattaaaagttccgaattgcccattttgcaagcgaccactaaacaaggaggaagagtaatgaaatttatggataaattagttaatgcatttgcagttacaacatttgttatgctaggcggaatggtttggggatcgtggtatgcaattgtttggttttcttcaccagtattttttcaatggtgcttaggattaattccgctaatagcgcttgctataatattgattttctttatatatcgaggtaacaaagatgaaactaaataatgacgaacaagtactctatgacttcttcgttacttttggcaagggtgttggattaatcggttatccaatcgcaatattagcaacttggacaagcggagacgaagaaaatgacattgtagtgtacccacataagcaagaagtaataaatgcctactgtagcttagatgggttggataaaccattgtatgaagcaatcaaagagattaagggatggaagtaatgaacaaggatatttttaaaaatcatattgccttttatcatcactatgggccttatgaatttctaatctggaagagtagaggttatgaatttaaagatcgtattgattacttttttaatcgaatgacttctactctaagtatttcaggagatttaggcagtgctgtgcttagttggaatacaacgggaaatactcttgataatattgtcgattacagcaagagcttaggttactttgtcggcaagatggaaacgtctgatgataagtacgaatatgactcagatactttagaaaaagaattaagcgattatttaggattggacgatgaagaagaatattcactgagcctagaagatcgtcaagaaatgaaacaagatttaattgaatgttttgatgaatttactggcgagtatgaccttgcttctgatttacgcgataagctaattgattttgatcccgattggtgggaaggcattcctaatggtcgccggattagcgatcgtgcaagattatgggcgcttggattacaacaagcaatggcgcaaattaagcaacatgaaaacaatgttagaacttttgcagatacgcagttagccgatatgtatagtatgatttgtgacttgtctgtaagtgcagaattgtataaggcgaaaacagaaaaagcatttcaagctgtgagagctctaaatgttgccttaaacgatgtagatgataaattcgaacgattaaacgaaattgtagaagaagatcaaaataaggggatagattaatgaaaattgaaaacgaagcattatttaatgtgaagaaaggtgaaggtggatcaattagctgtagtcctaaaactggtaaatttatcattactgcaaaaaagtttaagcaatatttaactgatgatggggttgaagaaaagaaaacccaagttaatcttgaatatacccgagatgggtttgctgcactagttggttcaatgatggcgcaactcagaatctatgatgaggaagcaaacaaatgaaatatataagtgattacattccccaattatgcataactgctgttttaattgctgaaatagcatttaaagcaagttcggaagtagttgctggtactattgctttatttgcgctctctttttggttcagtgattaagaaagtgaattgatgtaatgcaagaacaggaagtaattaaatattgtcagaatgaaacaccagtgatttatcacaaacacaattactatattgttggcatcaataaactcaatcaaactgttgatttgcaaaaagcttcggcaattggattgacattagacgaacgaacaattactaatgtttcttttggtgatttagaaatataaggttacaaacaacgggtaacgaatgtggggtgtcaagttggaattaaaagttgctcgccaaatgtatgaactagcagtaagacgtgaagaaaaccggctcactgctaaggataaagaaattctaggaatgattgaaattcctaatagtcaaaccctaaagataatttatcgcgtttcattagaacgaagcgatgcacttaatacacttaacgattttatcgctggaagaaatcttccttggattgaatcggcaatgcattttttagaaatgtattatgatcaaaaagaaaatgggatgacacatgaaatagaaattgctatgtgtgaatgggctcggagtaaaaatgttcctattaaagctgttagattaattactcgccacaattgggagtggagtgttgaaaacttaaaccccaagaaagcgagaataaattatggatgagaaacagccaaaaattaacagcgttgccattgagaaaattctgaatatgtatcgtgatgtctgtatcgccgagaacgcatttattaatgattgcaatcactacaacgataactatgagcaacggcgaattgctttcgaacaggtgctagaattagccgatttaaaagacgatgcattattacgagcgtggcaaattagaaaagagattaaacgtcagaaatggcatttaactcttgatgaacatggcgtgaataaatatgtacgtttagacaataatgaaagtaggggttgattataattattacaattagtggtgtgataggtagtggtaagagttcaataaccgaaattctatcgcaagaattagggacaaaggcgttctatgaaccagtacaaaacaacccgattttacctatgttttatcacggaaataaaatggttgaagaaggcaaatgggaaacaaatccgtatgcctttgaattacaaatttattatgtaagtaaacgcttcgatatgcttaaacaagccgtacaagaggataataatatcctggatcgctcaatctatgaagacgaaatttttatgaggatgaatgttgagcagggacacgcaacagaggaagagtggaaagtatataaggatttactgaacaccatgatggaagaatatcctaacttttctccttataaaaaagcaccagatttgatggtgctaataaaggttgactatgacacgatggtttctaggattaaaaaacgtggtagggcgtttgaacaaatagattatgatcctagtttagtacagtactatcatgatttaatcgaacactatgagaagtgggaaaaataatatgatgcaagtccattgttagtcattgatggaacaaagtatgatttcattgagtcgattcaagatagaaatattgttttggatactattgaagaaaaattagtagacctagggagcttgtcctcaaagaaagtggaactcctaaaacagaggcgacatcaatgaaaagtacagtgatggcatttacatcttggctaattatgatggtggtaattgcattgtttctagtattagttattggaatacatattatgtgttttaggggactaatgatctttttagaaaaaattttgcaaatcgcgtgtctaaaattgccttaatttttaaaaagagtatcttaataattgtattcaattcgattattggtaactacgatgttggatatccgactgaaatcgtttgtttgaattgtcttttccgttttgcaagtcggttcgctggttcgactccagccgtagttataggcgtaatgccgaaataaaattcaactctgtattctcgttgcctatggaaggtcggagtattagtcaccgcttgctccgttagcaactgcgtatgataggttcgaatcctgtccgagaatgttagtctaggcttgacggaagcactaaaccgccgaagaggataaagtacatgtcctggtcaaggaggccacttgaataaacgtagagataaggggaagcctaaaggactctatctaaatataagcctagcaaaaaattcaccgcgaaagccttaaaaagagggagctaagcctcgggttataaaatgaagacacaagctctgcttaaggaaattgtaacttagcatacaatgaagattaagtaacttgtctaactactgtcgtgcgttttctgggtagttattttgttgatttagctcagaaggtagagcactaccttgaagcggtaggttgcggtggttcaattccatcaatcagcatagtcctcttgggaaaaatcatcactaccacagatgctggtatgttagctaataatctctaatagaggagcctatgacgataggcacatcaagagttaagtataggagatcaaagaggcctcgcttagcttacgatgttattacggagtagccaagttggtaaggcaacggtttttggtaccgtgattcactggttcgagtccagtccccgtaattactgatgaatctccagcatcagttatagtagtttacatttacgggtcagctactattgttaacgttctctggtgagagcttatgtgtcttgcaaccacaacacatatgcatgaagctggttcgattccagctcttaacattgctgctatttagtggcactcccaatataaaaactttggtttggtgttgctcaagtggtgagcgtcaattctggttcaagtccggacaccaaaattggtcatgaaattgactactatataagagatcttcgaggtgaagttgtgcgtaaatcagtacaacatatgctagaagacatactgcgtgattatcccaaacttcccagttacattaagcaacgagaagatgaattgaaatatcctacgcctgaacaagacgataatgttggcggtggtcgagctctgaataaactgagtgatccagttggtcgagaagtaataactattaatgatgatcggtggcttcaacaattaaagaaggaacgtcaagcaattgatgaatgcttagatgaatccggtgtggttactgaaaagattattcaagaaacttacttcaaaggcaatgtcgggttacggatggttgatttatgtgatcgacaaattatcccagttagcactacgaaagcgtacgaattgcgtaatagttttctagttgaattaggaaagaagctaaacgttgatgtaatgtaactagcaaattcgctagtttttatggcggtgagagctttggaagctagactgtctcataagcagttttgttaaggttcgattccttacaccgcaattgggagttaatcccaaatgagctttgtacatccctaatttaggtacatatttagactaattggcaagtcgtcaccatcccccgtgtgaaaacctcagttcgattccgagaatatgtattctgaatacagaaaacagttcctatagcttagtctgttaaactaaatacttatttactgttcgtattcaataattgatacagaagacggttcctatttgaaacaagacttcaaatcttttgtgaattaccgtccgtatctataaacacaacgcagaaaaacgttcctattaatttatacagcaaatataagacatgtttacgtttcgcgttgtcatatataaactaaggtgactttatttaaggtcgccttttttattttctgaaaggagaccgaacatgagaaaagaagaagcaactattaaattattcaaagcagttgtagaagataagtttagcaatctgcaagcaacagaacccagtttattattggatgcgttaaagaaaggtgtctttattaatccacatgtattagatggtcgtactcaagaacaacaaaagactgttgtgaaatcagcagtatgggaatacggagttgatgcagagaaagtaaattcaaccttctataaacgattttctgatgtcgaaggtcgtagtgaattgcaattgcggtttgaacaattagcccattatatgagtacgtatggacgtggaattgatcgtgatgatattgaaatctatgagccagaatttctaaatggtttgcacatcgatattaatgatgaacttgtttatattgatgcaattacggaagcagaattagcaaagaaagttaagaatatgctaactagcggaattgcattaagtaacgaagatcaagtcttaatttctgaaattatcgatggctatcatttaacaattgattatgtagaccaaatcaagaatcgtgaatatatgtgtcatgtgtgtgaagaattaatgctcttaccaaagaatttcgatgaatttactcgttatctaatttaccttgcaactgatagtacgttgctaattaaatctcgtgacatgatcaatcgtctaggacatctaagtaattcttggagtagtgaccagaattatatggtattggaaaaaacatttgaacgatatgttaagagttttggaatagaagaagccgctaaacatattactcgttatcgcaaactctatttagtgttacggaaacattttgaggataagaccttaatcaatcgagctattcacttatcaaagcgaatgtatgaaccccgtaagcaatcaccgttagaacacgtaatggattatgatgtggagtttagtgatattgaacgtgcaatgtttaaggctcccatttataagctcattaaattagataatgcattactgcgtatgtatggaacacaaaaagctcgttacttcaaaattcgtaacggaaaaacctatttaaaagttatgaataacaaagatagtgtaaatgagctaaggcgaaccttgcgtagcgaaaaattacacaacatggttctagatgtattaaaacatcgatatggcaattggcgtaataaagtattttatattccagaaggtgttgagtatgccgtaccaacaactgcgaaggactttatcggcgagttgccatacatgactacctatgattttgaaggtaaaaatgtatcgctaggaattgcatgggacgaacctcaagctgatcttgatttacatatgatgtcattgggtggtcatcattatggatggaatggtagttatcagggagaagtaacttactctggtgatatgacgcacttaaatcaatatggtcatgcagcagaattctataaagtttctgcaaacacaattaaagatccacttgttgtaactgttaatgattattacagttcgtccgaagttaaatttgatgtatttgtgaccggtgcaaatgttgatacgcatgcaaaacaaggagtagcaacccagattggtgacaaatccgttctattccatagcaaagtatcaaatgacgataaatcaaagacactaatgctagtaattccgactaaaagcggctttaaggttgcattcactggtgatagttatggaaatcaacaagtacctggagttgataattccacaaaactactacttgaaatcttaaagaaccaagtagaacaacaatttacggtgaatgatctgattaagctcttaggcggaaagatcatttcaagccaaaatgatttggaaatgttaaaagaagatattactaagtccgcaaaggttgaaggtacatttactggtgcgaacaaacagctatataccaaggttagtgtaacgacgcctgaaattattaatttgagtccaagtaaagtaaccgcttcaacatttatcgatttgttgaaagaaccagaggaggataagtaatgggaacaatgatgctggtgtacatgattgcaccaatgattttgtttttagtaaatatcatttatggtcgaagaaataacagttggcttatattaaacggattgttattactgctatttgcaggtgtgacctttttacgggtatatattaatttaccgtcgcgtaatcttttgagtatcttaattagtaatggtttctggggaattatttatgaattaattgctctatcagcttgggatgaattctcaaacggtgataagaaagggtcgaagcttttattagggtgcatatccgtctgtgcaggtgtctttattattgggtgcatcggtgaggttcattctaagctgtcagttaaaccaacatggcaatcaatctcgaaacaatatagtaagtctagtgaagcaccaacattcaagcgtaatgaaacccctgtcgctttagcacctaatacagtgcttaatcgtgtacggaagtctatgtcggatattccaaacagtcagtacttcgatactccagatacagttcaagctcaatattataagggcaaacctgtttatattattccattgaaatataacggattcttcgcaatgcgcagagcaaaagaaatccctggatatttcatagtagatgcaactaatcaaaatgctgaaccaaaattcattaaaaaaccttataagtatgcaacaagcgcttactttaaccatgatgtagatcgccaaatttatcgcaataaccctgagtggcttacgatgagcaaaccgcagcttgaaattgatgatgatggcacgccttattgggtacaaacggtctacaagtcagaaacgtttagccaccgagttaattatcaacaattacatgtagtagtgatgaatgcacagactggttcacaaaagacttattcaataaagaacttgcctaagtttattgatgaagggatcacaagtgactcggcagcccaaatgaacaaagtctttggtaaatataagcatggtttctggaactttagtcgtacagatgttattaaaccaactaataacggaccggaagatggagtaacctcaatctttaatcgtgatggttcaattagttactttactgattttactaacccaaatagcaaagcggactcggcaatggggtattcaatgattaatgctcgaacgggtaaattaaccttctattctgcaaatggaatcatggatagtactggtgcaaaggaaaatgctaaccagaactataaagcacaacaatggaaggcaaagatgccagttctttataacgttaacggacgaccaacatgggtaatgactattctagatagttcgcatgcaattcgtggatattattaccttgatgcacaagatcagtctatttatggcagtggaaataatcctaccagtgcattagacgcatttcgtcaagccttagttaataatggtgcgacagctagaaatacgccaggcaccaagcaaaagaatatccagggtactgtcgatcgttcggttgtagtatcagataaaaataaagttatgtttacactgcaaggaagcaacattgtttatacagttaacactaatgattacgtaaaggctaacttaattcgtccaggagataagctgaaatttaaggcaagcgtagttaaaggacaaagtgtgggaaatgttgaagattttacaaatgaaagcttgagatgatgacaatgaatagtgcgttagaccttatgacgacagcagatgaagcaagagcgttatctaatacgaaaaagatggtaaatcaagctattaaaaatactgataaggctgttgaagaagctgctcgaatgggtaaaaagaatacttacttttatatgaataataatggggatgttaattatcgggcgcttgtagaagtagtggtttcattatacaaactcggctatggagtcaaagttttacttcttatcaatcctgaaattaaactttgctgggaagatgaagcaatagacatgccgattattgtaaatgaagaattgagtgaagaaaaaacaatgttaattgctgaaatggttgacgaagcaattaagcaactagattaaaggtgattattgatgaagaaaacattattaattcttggaacggtgttagtaggattttatgtgggatataaccaagctgaaccagtaaatgcgattgcggcacatggagttgctcatgctactgcgcatccggcagcacatccagctacacatgcagaagctactcatccgacagcaacacatacaactactgaaggtgaacacacaacaaccataactaacgataatcattcagaaactccaaacgctactcaccatacgttttcaacttggatgtatggtgtaacgcatcctggtggacatcgcggagatcaatatactaaaggctacaacgatggatacaagaatggctctgttgataagagaacaaagtcacacaagcattcaaagccacaaggaaaggtatcaaaatcttactataaaggctatgttcacggttataacgatgggatggaataggtgagaatatgattgttcaagataaagaagaaaacgtaagatattttggagcaattcagtttcgtgaagaaatagctaaaaagtcactagccttatatccgatggtagccgaaaacgaagaaattattgaaacgactaatatctttcctgaaagatatgcttactatacatgcgacgaccgtttagtaactgatggagattggatattaactaactcaaagggagagtgtcaagtggttactaacaaaaaattccttgaacgctttaagaaagtcgaggtcaattaatggatatcgtaaaagagaaagttcgaaaatataatgccgttcaatttgatcaagactttgtaaataaatacggtcttattaaatatccaatggttcatgaggctataagacctgtacaggtgttttctgaagccaaaaagggactgtttgggagaaaacatgaagtaatgcaagacgtgccagtatatgaaataactaaaaattattacatagacaatgtatttaaaagaaattctgttaacaatcgtacagaaaaatgttgggtaacaagtggtgattggattgttacagatgagtatggaaactctaaagtttattcgtcgaaagaattcaaggagaaatttgaaaaaacagataatcaggagggattttaatggctagttacagcgaattaaataaattaagtgaaatggtaaaatcacaaaaagaagcgttggcaaaacaaatgactgttgaagaggttatctccactattcaatccccgacgtcatcagttgaattcgaagtagcgatgcaggctttacaaatgattgacagcgtaaagacacaagtgccaagccgtgataaagtggctgaatcaaaaggatggtataaagaaccattaacaagttatcgtggagttgactttcaaattgatacgagcattttggataaattgtgggacgaagtaaatgaaaaataaacctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccaaatgaaaaataaaaggaaacatccccgttatccaaagcagaagggatcgcactacggaacacgtcctggaatatatttaatcgataaaactggtcataaggttaggctaaatgttacttgttttagcacagaagtattaagtaaccatttagtacttggcgatattgaatttcaagtaactgagacaatgttatctacaattcaaaataggagagagttgttctatgaataaacgaaagcgttacatgaagcggagattaactaaagcccacaaaaggggaacattgatcaactatcgattggattcaatcattacgccttcatatcaagttataaatcgctcggaaattattcaattgcaaaaacagattaattcattgcaaaaggtaattaagaatctttctcgtcgtaataattaaattagctgaggggatgcaggatgaataagaaaaagcgtaaggctaagcgtgaactaactaaggcgtacaaagagagaatgaaccgtcaacaaacgcacaacttacttgtagaagtgttttccgatccggtttttcaaaaaggaatcgaggcaatggttaacaattgttctcaaaactttagagaacttgcaaaaatttttgaaaaatgacgtgtctaaacgtgcaataaaatacagagttgatataattaatcatggttgaaggcagtgcataagaaagtgacatttcgcctgtacagaatgaacgtaagaccaataagccgaatatgttcgataggatatattttgcaaaagagctaattaatacctagtgaagtcgatgaaagaaagtcgattggttgtttgttctagaaaccaacattgaaattcattgcacaacccgttaggcgatcgtaatattaaacccacagtaaatcatggctggttaccatgagaaccaaagtgggaagccaagaagatcgtagcttgtgaagtctggcaaccagaatataactaacgaggttggtacgagtagcccaagagcattttcttacagctataaggaaaaatataatattagctcatgtcgagtgaaagttaaacggtaatagatccgtgttcaggtcttgtaaaccatacggagctatcggagttgtctgccggtagtgagcccgtatgaacctgtggcagaacagaatccaatgaaggtgaactacccaaaccaatgggcaaccatacatagaagcggatagcggtgtaaaaactgctacccgcttttttgatgtctaggaggtaacactagtgggaataataaagagtttttattacctaatgcaaaacaaattagacatttttcgtttggaggaaagctattagattgtcgtgaatcattgaaagaagccataaacaacaggtcagacgattatttgccgatccaatggtacacatctgatccgtataatgcggggcaagcggttactttgttggaattgtctaactatagttttcatatgtaccaccaaggtgagggaacaggctattcatttaccatcctaacttcattacgagaggaaatgcactatatcgatattgatactattgaaacaaaaacatttagaattcaatttgaacaaggaaaatatgatgcgttattggagctgctagaggctaataaagaaagaaattagagaacatgaaagaaaaaattcaatttgaagatcaaaaaattgatagtttggttaatatattaaggtcaatcgctttaggtaaaagtgatcttgatgacggtgaaattatcaaaagaactgttacttcacttaataattacgctgacttaatcatagctgacactgataaactcccaatcagtgatgaacaggtgagtatattaaagaacacaataaaagaagttgtcccgataatacggagaagttatttaactattaaagagcggtgcaataaagcggataagaataaggcgctagctacagaatttgcaatgaatttctgggaatgccataactatcgtgcttgtgtaaatcttttaggtatttttaatgattaccaagtatataaatacgctgatacaaaatacttaaaaattagtggtataggtgtacgtggagcattaactatggaaccttctaaaatatcaaatgctggtgaaaaattaattagtgatggtgtcttttcaatatcattaaagccacacgataatcatttgtatttagctaccgaatgggaagttgttactcgcgatattccgttctttaagaaatctgttacttttaatcgaatagataagataacttctaacgttataagcaaaatgactctaggagattataaagaagcaatgaagtggcttttatgtgcatgtgctaaggcgttaatagtcgttaaagatactagggaaccgttgttcattgaaccaaatccagtgaacttccgtaaatatattgtgatatcagaggcccgctaacgtgaatatcataagagctaaacaccagtccaacaataaaaaaggagaatgaaataaatggaacaaacaacaaataagcaaaactattttaagtggttacttggtcaattaaaggggtggcctcttcaaaattatttgttattctggtttagttttggttttcaattggctttattaatccaatcaaagattacaagtgttacgctgattacttttatagggacaacacttggcgtgctatgcgtactagccatcaatgccgctaaagctctaaacgggattcttgggattcttagcgctgcttgttttatttatgcaggcctgtctgcaaagaactacctatcaatctttgaacaagtagcttatgtattaacactggacttgccggtcattttagccgtacgttcgtggaatgatgatactaaaaatcatcttcgtaaatttggcggtaagcaatggttaattgcaattgttggaacattgcttgtatatgtaatttctggatatttgattggtaagttaactaatgacccacgcccttggattgacgctattagttttgcgattagtttaacagcaggaattatgtgtttcatgcgctacaacaaccaatatttctggtggttagcttctggaattttccaattaattctttggggtattacttatgcgcagggggatgcaacactagcgatggctattaatagttctatttatgtaatcaatgatattctcgcatttacggtaagcccttggtttaacggaggacgtaagaagttaggcttgaatgatattcaataaaataggaaacggtgatgcacaaatgaaagatatcctcactcatgatgaaatgaaagaaaaaattggaaaatgtcgaaattccagatgaaatcattgatctagtaaacgaaactttagaatatggaattgctactggagccaaatttgttggaattgaaataggatcaaaagaaaggcagataaaggataaatatctaattgccttgactagaagattaggtgagaaaaattataagtcagatattggaagtggtcatttttatattacgctggatagcgcagataactctcaataagaattgattatagaagcaatccaaacaacccacaaaaagcacaaatggttttgaggtgaagatatggaacaattcaaatttatttttacatctataattcttcgcaagtataggcggggcgatacgtatttatttgtacctaactttaatgactatttaggtattccagatagtgagtatgaaaattttgctaggtacttgaaagaaaaacatatttatatgacgagtaagtcaaaaagaaagttagagggtaattatgtaaaggcagaacactatgatgttttaatcgactggaatcacgacctaaaggcaaaaaagtgcttagaagaattggagatgaaactaaatggatgagtggctaaaaatgcatacgtatattgtgtgttcgactaaatcgatggcaaaagcaaaaatgattgatgattggaatagttttcctcgtattcaactatgtaaatcattatggaatattcactattctcaatataagattgacaatctatggcgggtatacaaatatgtcagtttgtatcaagttttacactattttgatgggatagataatgttgatgagtttagaatagatgaatcagcaagtttttatagtttgagtgatacaaaaaaggctgttgaaatattgggtaatgcaggaaaaaagcgtgatatccgaagtaaacaatgggctgaatggtgcaggaaaaatgactgtaaagaatgagagtactaataggtgattaacgatgagccaaaaccagattatacctaaaacggttgtattggataaaatgatgaaggcaaaattatctgaacaccttgtaaacaacataaacaataaaatcttaaaagctcctaagcaagagggacaaggttttagtattcgatacgaggatggattgacacaagaaaacaatatgagtgttgtcaatcaattacgagcagctggatataacgttcaaatattttatgctaacggaaaagttgccgaactttatgtttactaattctaatcattatctaaaagtacaaaatttctataaagagaattagaataaaaaatcttttgctttaatgcgtattaaggcgtataataaggctgttaattacgagaggggaaaataaagcaaatgaaagtgaaagagcttttgcgaatgttagcccaagaagaatttaacgaaaaatatagactaggttctcatcactattttgagagcaggaatggtaaacatcttgttatttgttataacaatacaaatgatattattctttctggaacctataagtctattgttaagttcttaaaatgatctattgctttattatttctaaaataaaaagagactggtttttcagtctctttttattttgtgtggatttaatgcgcattataggcgtataataataaagcctgctcctttgtcttaatagaatcgaggtgattgattattgtcgaggtaaaggcaaaaaaagtaattaaactattgcgtgataacggatttaaggaagttagtgttaatggagatcaccataaatttgcaaatgcagaaggaatcgtgactgtagtcccatattcccaaaaaggtgacacaatttacccaggcacactaaacgcaattctaaaacaaacaggtttaaagaataagtagtttaattcatgccagcaagatgaagggatgttagtgccagctagcattccttttttataattaaaattgatttcgaaaataaaatcaatatatccacaaaaattatactatttttagtaataaattgtttgttttaggtaaattttgttgctttaatacgtattgaggcgtattataatcgtgtaaggattgaaaaatttcattttagagaggaattcttgtatgaagagtgaaaaaaggattgtagcataccctgctattttagatgattcagagaatccaaaggggatgtatactgttacattccctgatgttcctggagcaataagccaaggcatgggagtgccagaggctatggcaaatggttcagaagcgcttggattaatgttatataacgaagaaaaattgccaaatgtttcagatataaaagaaatacagaaagaaaatcaaggatcattggttacgatgattttttctgatttagctgaagcaaagaaacatgttaaaacgccaatggtaaaaaagaatacgacaattcctggagatttagcccaaaaagcagaagaagcaggaattaacttttcaaagactttaacagaagcgttagaacagaaattaaatagctactaatatgatataaaggaaatatttagaaagagctgcaactataaggcatttaaatataaaaaagtagataagaggcgcaagacacgcaggggctcacgcctcctttagacattgcctgacgcttgatttcaattattatcaaaaaagtgtgaatggagacatgaagctcacctccttttagtagtcgtaagtcacaacttgctgtgataggctacgttaagaaaggagtgtgagcttcttttttatataaatagcaatgcctaatagttttttggggatgatatagtgatagagtggttgggaacaataccagattggattgcagcagcaatggcattttggggactaaagatagccaatgatcattttaataaacagcctaaggtaagtttaagtatagaatttgactcctatcaggaaggaaataaagaaaaagaatataggttttgggtggttaatgatagtaatataaatgttactgtaaaatggatgggactccgaatggcatcaaataagagtgtacaagaagatgaggcatactattggagatgatgttgattggcatttactagcacctggagaagcaagtaagcctataagtgtaaaaaagagcagaaaaagcttttattgtagaatctttaaggtagaaagaaaattaaacaatatttattattgctagcaagttctaaatatcatcaattcttaagaacgtgtcgcgcaaactggtatacgataattataagctaacgttagcgctacttttttaaaaaggagtgttaaatatgaaaactaagtattccagtgttgaagaatatattcacgatatttatgataatttatatccaagagcaagggcagcagcggatctattaatcgagaaggggactataactaagtttgattttgaggaaaaagggattaacccagcagtaggtccaagagcagtaatggatttaaaagatcatggcattcctattgagaagccaggtcgtgttaatgtaccacaggctaagcgtgcggttgctcaatataagcttggcaaggttgctaatttacgtcctaaggaaaaatacggtcgtttggtacctcccacaaacttaaagcgtagattaattgaggttagtggatcttactgtgtatattgtgggcaaaggttccctgaaaagtcattacaaattgaccataagttacctgttaaatattttggagagctaccatcagaagagattgctaacttagataattatcagcttgtgtgtggacattgtaatcgaataaaagctgaagcaattaaccgagaatgtacaaaaacatgcttcaaaacccatgatatgaacattataaaaagttgttattggtatgatcctacaaattatacccacgtttgtggaaaacaagaaagacgactctctttaatgtttgttggggaggaaacaaaactgtatgataagttagtaaaagttgcacgaaaagaaaataagacggcacaagaagtgataaaagagttaattacaaagtaaaagacgtgaaaaagcatgctttaagtaagtgaaaaaagcatgctttaagaactagagagtgcagaaaaagcatgcttttcggatctagtaaaaagcatgcttttttgaaggcttattttccaagtataaaatcataattttgcctcaaaaatcgccttatttattttcttatccggttttaatgttctactggataaaatatccggctacttttaaccggctttcgttatctttatagcacggctagcgcgtcacgttcttaataaatagaacatgatttctatttattatatagtagaaaagttttttattctttttaattttattagttgacaacttataaaataatgatattatataagtgtaagctaattactagcttaagcagtcccaactttcaaattctagatatgaaaggagtttcggggctatgcttacagtagtaagcgcccttttaggaatagccggcgcctatcggttagcctgtaaaggctataaagattattggcaagggcaacgtctaaaagaaaaagccttaaaaaagcgggctaaacgcttaaaaaaggctaacaaataaataaaacttataaattgggaatcgtggcgcggttcccttttacatatataattatactatggaactagaaaaatagaaaggttttagaaatgctgaaaattctatttaatatagtaattctgttagttgggctatatgttagctatcgattagttaaatctggatgtaatgacttaaaagaagcccaaaaattgaggcaacaagcaaaagggttaaaaagaaggcgataaaatgccaaaagtaaagaaatattctaaagaagaagcacaccagcgacaaataaaccgcgtaaatgaatacaaccgcacacataaaaaagaagcctaccgcaatcaaaagaagtcaagagcgcgcaactttattaaaaaggacgctacacgggaagaattggaagaattacgcgggcttattgatgaaagactgaaagagctataaaagtgcttatatatgtttgaactcactaacacgttgttatatacttctattaaatgctaaagaggtgaaatatatggcaaaagcgagccaagcacaactagaagccaacgcacgatggagagcaagaaataaagaattcaatgactataagaggtcgttaagagaagttcacaaatggataaatccagaccccaaaaaagccccagcagtttataaagctgtcaatagtacagatgataggatagattatattggcgatttgaaagatacaaaacgcgcaatagataagcgattaaaagaacttgaataaaaaagttgaaaaaatttcaatttttttattgcaatatataacacgatgttatattataaagatgtcgaaaggaacaagaaaagaaatgagatgataaaaaactggacgaataaataaaattttaatcgtttatataacacgatgttagaaaaggggtttatttaagatttgagataaaaatctagtatgttcaaaattttttaatttcactatataacacgatgttataaaagaaaggaagaataacaatgacaaaagaacaacaaaccatactaaacaaagctaaaaagatattcgatcaagtagaaggatattcaaacgaatacgagttaaagaaggatggtgcaacagtcgcaagaatgaagctagatgacgaacaaacaacgctatacgacagtaagcaaattaaaagctttcttatttggtggaatgatgacttgagcggatttagtgaaacactagaagaaatttacaacggctagaaaaggagatcttaaaaatgaagtgtaaatattgcaacgaaaaactaaacaacggttttaatgtaacggggtatgaaatgacatccccaaagcaggcggaaggtctaaagttcgattctctttattgtatgaatgaatacgcaaaagaacataatttcagcgactacaattatatttcttgtgatttgtaaaaggggatgtaagcaatgcgaaaagtagaaaagtatatcaagttgtatcaagaaaataaaatcactgtacatcaggcctataagcaactaggcgggcgaaaatatcgcgagttttggaacaaactatataaattatcagtaaaagaaaactaaccaataatgaggtagatactatggaaatcaaaattaacagcgaacaagaagaattttttaactatctagaaagtgatagaacaatccaagaagtagcctgtttatatgattggagcattaccgccgacagatacgcgcttttaggtttggtctatatgcaaaacaaaaacaatcgattagggaaaagaattcttgagtatttatgtgagtgtaattttcacacgtcacatgaagcactagaaaatacagatggaacagacttacacgactatttaaaagcatattaaagaaaaacaactaacgaaagaggtaatcactatgaataagaattcaattattaaagtattaggcattttattaattattgcagttgctaactggtacgttgacagccaaaagcttcacgacgcacagaaccaaattagaacagaacaaacggccaagagtaaggcaaccgcacaagtagaagacctcagtgcaactaatgacgatttaacagaccaaaacaaggaattaaaggactcacagacccatattaaggacggccaacaaattaaaaatgataaatttacaatcgactatgaagacgatggcgacggtgattatactctaacagtttacccgaacaagaagaatgaaaaaatgatcgcacagcaaggggacggcgcgcaagggttagaaattgtaaatgttccaaaaacggacaagcgcacaactacagccaactagaagggaagttataaaaggggttgaacatgatggatattacaaagttaagttactcagatttaacaattaaagcattaacgctattagatacagatgataaagtaagactttacttgatggaagccacgcgaattatgagggctttatatgaaagtgacgccgtatatacacacgagcgccgagcattcaggcggaactattggcggtttgttctttgctgtaatttaacgccgtcaataaacagaataacagcaacaaagatatacgcccgttttgttggtggttactgtgaagggttagaacctaaaacagttcaaataatggggatactatttgaagaactagctcaaagcattcacaacggcgaaaacaagcaagcacaacaagcaatacttaacaacgcaattaattacctactaaagtactaaggggatgcatacaatgaactataaaacatattatcggactgttaagagtcacgctttgaagtttgttgatcctggagatgactacaagcgccgttactttgcaagccgtgacgattataaaagtgtactgatgaagttgttagcttcaaccgttgaccgtttgaacgggctgggagttaatataaaaatagttgtcggggatgacaacaacaagcacacagaaacaaaagaagccgcctaatcgggcgacttttttatttgaactaatttattaaaatgtatttactttctatgtatatgttatataatatagttgttgagtggtacggagcaacggccaattaacacagatctgatattgggaaaagtagaaagcgttgcggaattctaggcgggtgaaactaatggccaatagttcacttgctgaagtcctaatttcaggagggcgggcgccgtgagctccggcgactggatcgcatatctgaaattgatactagatgaatgtttagtattatatcagatataccgtgaccaacaaaaaaggcgttaacctttacggctaacacctaataaaacggcttcctgatattgggtcagcaaaaggggtgggcggtgcaacgcttgccctttttgaatacatatatattatatattatttgcgggaggttgtgcaagtatggcaattacaaaagcacaagcaaaggcaacggccaaatataaagcaaagcacccggaagcagcaaaagcatatcaagcgcgatcatatgcacggcgatatattaaacagtatgcagataatgaaggacttgacgaactggagaagcttatacatatcagacgagaagaactaaacaagcaatagaatactattatttatatatgccatctatctattaattaggtaggtggcttttttgttttaaatcctcgcggaaaaaatgcggaaaaataaaggggcttttagtgttatattgatattgtcgaaagaaacgaattaataaggtgttacctcaaacggtagcgcctttttattttggcttgctttatattgcgatgtgatgacgtataaggcaatacagtagcaagttaacagaaaagattaataacttaattaaagcgttagaaggggagtagatggaacacaaatataaagataattacaacgcattttatcattcgaaagaatggcaagcagtaagacaacaagtgttacagcgtgataattatttgtgtcaggtgtgcaagcgagcggggcgaataacaccagctacaacagtacaccatattaaagcggtaagggttgactatagcaaacggctagaccctaacaacttagagactatctgcaaagcttgccacaatgccgaacacaacgaacgtacaaagtcgctacacgataagcagaccaaactaaaagccgaaaagaacagtgatatttttacattcaaagccaatccggagctttaacccaaaagcgcacatgcctataaacgccgtcacagcaacgattaaagcggtctgaaagtaaaaataaataattttcgtgtgcaaaaagtgcaaaaacaagccccccacccctaaaaaatagaaaattttaaaatcactggagcgatgccatgccttacttcgtaaaaaactcgtttttcaaaattttttgcacacaaaaaagcggacacccatcaccggatgtccgttaattttgaccactcatatttcaactaaatcataacataactaaaaatagcgtcaagcgctaaatttcggtgaaaggaggaagttttgatatgccacaaacagctaaaaatgttcttcaattagttgcaaatggtaactacaatcataagccaaaagatgagttagaacggcgtgcgaaaaatgagcaaaaattaaaagtttctgctgaacatatggatccaccatcttatcttgatcctggagccaaaaaacagttccgagcaattattaagctattcaaggatactgatttgatgaacgaggctgatattgacgaaattgcacgttattgtgacttaacgaaagaatacaaatcgtgtaatgcacggctaaaacgaaatggtcgattcgtagaaggcaaacctaatccagatttacgactgaaactgcaaatttcggcagaactggataagctagcgaagaacctcggacttaatcctgcggcccgagcatcattagctattaacatgacagataatcaaaatgaagaagatgacgatgagttctaatattctaaaagaaaatccgctaggccttaattattctggtgttgttgaatggtcaaaagagtacgttcaacacgaaaaggacctgggacacgtattggaacaaccagcccctattcttttaaccactatctatgctgaattagtggtaaatggcgatatcactaccggaaagtgggtaaaattagcctgtgaacgtcatctaaaagacttaaaacgttcgcaagaagatcctgactatccttgggctttcgatgaagaaaaagcgtggcgcccaatccgattcattgaaaagaaatgtaagccatcaaaaggtgattacaagcgattagttttgcaaccttggcagcatttctttgtcggctcaatctttggttgggttgataaaaacactggcttgcgaagataccgtgaagccctagttttccttggtcggaagaatgggaaaaccactttggaatcaggaattgcagactacatggctggttttgaccatgaaaacggtgcgaatgtttactttttagctaactcacaaaaacaagcaagtattttgtacgaagaagcccgtaacatgattactgcatcgccttggttatcgaaaaaatttgttcctaatcgctctgaaattcgctttcctgaaactaacagtaagattgttgcaatgtcagctgaaaagaataacaaagatggggaaaatcttcattttggggtgtttgatgaaattcatgaatatgaagattattctttaattaacgtcatgaaacggtcacgtggtacccggaagcaaccgttaatcgtctatattacgacagctgggtatgttttagatggcccattagtggatatgattgatcagggccacgatacccttaaaaattatgattcagacattgatgagcgaacattttattatctcgcatcgctagacgagaaagaagaaatgaatgatccttcgctatgggtcaaggcaaatcccaacatctgtatgatggatattgctggactaatcactgatttcaaaaagaatcggcgagtccctaacgaattagctgattggattactaaacaattcaatattttctcggaagttgatgagttaagcttcataactcctgaaatactacaaaaaaataagcgtcaccttgatttgaaggaacttttaggtcgtgaatgcgtaggtggatatgatctatcagatactgaggacttcacctccgcatgcttagaatttcctttagatgatggtggcgtttttatattggaacattcgtggattccacatgctcggtatgaacgtgataagaatccagaacgaattaggaagtgggaacaagatggggatattacaattattcctggagactatgtcgattattcatacgtgcttgattggttcaaggaacaatcggaaaaatacaacatcgtaataattcgatacgattatgctaaggctattcggcttaataaagaactgattgaagctggttttaatacagaggtagctcgacaaggctttaaaactttgggaggaccgctccagaatttcaaagaacttcttttagacgggaaggtcgtatttaatgaacaatcgatgtttaagtggtacctaaataatgtccatctccgccaagatcgtaatgataattggttgcctacaaaaacatcacaatcacgaaaaattgatggatttgcggcagcactagatgcgcatgtatcagtgattgatatgttagtagaaccaacttatgacggtccggtctcaacgtttatttcattcaagtaggtgaagaaatgaaattattagtatggtttgccgttgctttaacggcttttttatttagtgcaaagttagctgggctagtcacttgctcatggttagtgatttttacacctttgattattgttcttggactatggtttttatttttgctaatggtatttgcaattattggtatttatgccttagttgcaatgatgagggaaaagtaagttaactgaattagcggaaaggaggtgcaaatatgggattttggaataacgtaaaacatttattttcgactgatccacagcaaaaggcaagttctggtgattgggaagggcaaggctttcattttagtaactgggctaacagtaacttttttggaactcataacaatatattgcgcaataatgaagaagtctttggagttattagtcgtttagctaacacgttatcaagtttgccgatccatgaatacaaggaatacgaccaaatcaacactcctgcatctgatttattgcatggtgaagctaatccttcgatgtcagcattccaactcattaatcaattagaagtatcgcggaatacggacgggaatgcttatgcatggattgaacgtgacgataatggtgccccaattaatttgtggccaattgatccgggtgcaattactgttaaacgaaatgttgatgacaattctatttggtatgacgttaacagcacagagtaccatttcttagtctttaataccgatattattcacgtcaaacacattaccccattaacggggacacttggtatttcgccattggatgtgttaaaaggaccattaaagttcaaaaaagcagttgaagacttctcgttaaacgaaatggataaaaaagatgcatatatcattcaatatgatcgttcggttagtcctgataatcgacaagcgttaattaatgattttagacgaatgattacagaaaacggtggggcagtcgtccaagaaaaagggtttgagatcaatcgttttgatagtaacttccaaccaagtgatctatcaacaacgaactcaatcactcgttcaagggtagcgactgcctttaatgtacccttatcatttttgaatgaatcactggagagtggcaacggaaagtcaaatgaacaagtcatgctgcaatttgttgaaatgacgttaattccaattgtgacgcaatacgaatcggagtttaaccgtaaattgcttagtaatatggaacgatctcaaggaatctatttcaagttcaatattaacggtttgcttcgtggtgatacctcttcacggacagcgttctaccaaacgctgatccggaatgggatcgcatctgctaacgatttacgaaaattggaagaattaccaccatcagacgctaaaaatgcggataaattatggattactggtgatttatacccaattgatacggatattgcagatcgtaacagcaaaaaaagtactttgaaaggaggtgacaatgatgccacagacaacagtgattcccaaatatctgacagtaaagcaggaaagcaagcagaaaacagcgtcaatgtatatcgacggcgaaatcgtaactgacgaatattacgacactgatacctctgcggcaggttttcgggatgcattaaaagatctgggtgatgtaaagacaattaatttacatattaattcgccaggtggttctgtttttgaaggaatcgctatttataacatgttgaaacagaataaagcgcacataaacgtctatgtagatggtttagcggcgtcaatagcaagcgttatcgcaatgagcggtgacgctatttttatgccctcaaattcaatgttaatgattcataacccttggacgatggcagtcggaaacgcttctgaattacgcaagcaagcagatgatctcgacaagatcactgaatcaagtattcaaacgtatctcgatacagcaggtgacaagctcgatgaagccactttacgtcaattaatggatgatgagacgtggttaacagctaaagaagccgttgaatacgggcttgcaaccgaagttattgagcctaataaggctgctgcttcgattagcaaaaattttgctcaacgttatcggcacgtccctgaacagcttattcaagcttcggttcaaaaacaacaagcaaaggttcaagaagacgatgaagtatttcgtaagcaacttcttgaacgataccagaacaacttaaaggcaattaataacgaattgcaaacaatgaaggaggaacaaatacatgaatttttaccaaattaagaaaaacgccatggatatgggggatgaagttcgccaagccaatgaaaaattaaacgaaatgcttgctaacccgcaaactccaacggaagatattaaggctcaacaaaaggtcgttgattctgcccaagaacgttatgaggttgctcgtaagcaaatggaaaaggcagaagcagaggctaagaagaagttaaaacctaatagtgaaccaagtcaattatctgaaaaggaaaagcgtgcgaaggcatttgctcaattggttcgtaatactatggcaaagcaagctgtaccagcatctgtgtaccaagctttaggtgatgatgattcaactggtggtaataagttcttacctaagactgtttcaaccgatattattacgggaccacaagaacataatccattacgtgatatttcaaccgttactcaaattactaatctagaaattcctcgtctctcattcactttagatgatgatggatttattgcagatggtgacaccgctaaggaaattcaagctaagggtgacactgttcaatttacccgtaacaagttcaaagttaaggttggactttctgaaactgtattacttggctcagacgctaacttaacagcttacgtagaacaagaacttactaatggtgtaactcggaaggaacgtaacgtagcctttgctgttaacccaattaaagctaatgaaaagcacatgtcattctacgatgacactgttggtatcaagaaggtaactggttctgatctttacgatgcgattactaatgcggttgctgatcttcacgaagattaccgtgaaaatgcaactattgtgatggcatacaaagattacttgaagatcattaagactcttgctaacggttctaacactttatacggtgcacaaccatcagctgttttgggtaagccagtagtatttactgatgcagctactaagccagttgtaggtgacttctcatactcacaatacaactacgatatcaatactatctatgaccaagacaaggacgttgacactggtattgaaaagtttgtcttaactgcatggatggatcaccaaattaagctttcaagcgcattccgtattgctgacgtacaagcgtcaaaatagcttccccatccggtgatgatgggaagaacacaaccccatcaacgccgaaaacaggtggggacacaaatgagagtcaaaacaaacctgcatctagtgctgtagcaagttcagctccatcaagctcgactacaagcgatagttcttcaactgataagtcagctgcttccgcacaaccggcagtagctgatactttcaatcctaatggggatgtaaaaccaactgaaaatcaaactattccagaaattaaggcctacttagatgcacataagattagttatgcgtcatctgcaagtaagcctgacttattagcattggttaataagtagcaataaaaggtggtgatatatatgtcaatcgaattattaaagaatacagtaagcgatgatgatctgggccaagttaaaacttctcttcgactagaacctgatatggaaagcgataatgtgctgttaaaaatgcttattaaggcagctcgacgggatattatcggccaagtaggtgaacgtattgatgatttttttgatgataacgaggtatttaatgccgctgttattcttgaagtttctcatctttataaccatcgaagtgctactagtgaacagcaaacttttgaggttccaatggctctgtattcattaattaattcaatgaaagatgattatcgctaccaaatcgctaaaaaagacggatggttagatgactatacttctggtatcgcagacgccgagagtagtaatgaaacagcggcagattccgaccgggacagcaatctaacacaagaggatgatcacaatggttaaaaacgtaaatgttgccagaatgcgttaccgtttggaatttggtattgacgaacccaccggaaaaaagaatccaaatacggggaaatcaatcaaaggtttcaacccacactttagtagatatgccgggttatggacgttaagtgccaaccaagcaataacactagcaggggcacatatcaaagaggctgttgtgttcttcgttcgtcatgacttaaaaatcacaagtaattataaaatccgtaaaggggacgaaatctttgttattgataacatttcttatgatgacggtctgagcactgacggatttgatttaattacttgtcatcgggaggttcttgaccatggctagtggtttaattaacgataattttgataaatttttggaaagagtagatcaaggttttactcttagcgaacgaaagaaagtaaataaggttggagataaggtttacgaagacgctatggatgcgtttttgaaacaacacaaacgagacgttgtgtataaaaacggtacacagcatttggcggatacactaacacatgaaattaaagaagacgggcattatgagattggcttctctaagaaagggaagaaagcttatatcgctcgttttttgaatgatggttggaagccacgaaaccaatacggtggtccttacggtacggcaccaaagactaaatatagtgagtggcacgactttattgctcgcattggtaaggaacgtgaccatgaaatgggtaaacgtatggctgaacgagcaaaagaaatcatggatgaaaaggtaggcaagtaaaatgactcctaccgctcgaatagtgggcttgttaagtgataatgctgacggcttggaagatatccttgtcgacaatatttgtgcctacatgattgacgaagaaaacgttgataatacacatccaattttggttgtttcagaagataatgacggtcaacgtgacgtgggaaatgacacaattctttcgactataaagcgaatatcaattatgttttactacccgattaactatgtcggagatatggactcaattgaaaaatcagttgagtcctttttgtatgctcacaaaatccgtcgttatctcaacactggtcacgttttgactccagatacaaaaaacataacgaatacgttgaaattcaactacacacaaaacgaacttacagaggaggacaactaatggctaatatcggtcttaaaatgctctacgttgcattgaagaacgaagatggaaccaccattgtagatgcaactaaaggcctttctgaagctggtgtttacgcaattgataccaataagtcacaccttaacttaggtgcgcaaactgctaatatttcagcgctttctggaacaccaacaaagattaacggtaacaatgaagtggtagatatttctaatccaccttcttcaccaactgttgcaattacagctaacttaattaatccggaagttaagcaaaaactgcttggtcgccaacaactttccagtggtatttgggtcgactctgataagcctacctatgcgggattgatgattgtttctcaagttccggtaacattggaagatgtttattacagttttggaatgggtatctttactgaaacgacgcaaaacgttcaaaccaacacagatacagctgaaactcgtgaaagtgataccttaacgttcacttccatggggtactcttactttaatggaaagaactacggctttgatcgtgccggacgagatggttttgataagcaaaagcttttcgatactgtcttccctggacaaacctttgtgacggcaagtaaggatggtactcttgatcctttattacatggaggtcaagtagttgatgtccgaactgatggtgagaaggcagctggcgtgggaaaatagcaaccccacaaccgagtggggcgcccactgaagtaattaatccagacggtagctcaactaccgcttaaaaagaaataacagagacgagtaatagtgagacgtaactaatacatagacttaaatatagaaggagttttaacaatggcaaaaacagtaacattaaaggcaactaacgtacttggtaaagatttcacaattatggactcaatgggaaacatcaagaaaatcaatgagggaattaagcaaatttacaagcgaattgatgctcttgaccaaaagaaagaaacagtcctttttgctgaatataacgaagtaattactgatgaagtaattaagcaagttgctaagttattagaccttagcaaggatgacgcaaagaagctagaagatatgtcatacaacgacttatttactttctattcaactgctgttaacgaatttactggtatgactactccaagtgttcgtgaaatgcaaaagcgtcaagaacaagcaatgcaagctttaagtgctgaagacccaaaacaaaattccgaagattagttcttgatttagacaatctcaccgaagatatcgactttatggcccaagaagccatgagtaacggtattcttcctagtgatttttataaatcatcatttagcgatgtgatggcagcacaaaatgctaaatcaagaaaggatcgtccgcaagatccattaactttggttggctcagatgcctttacattctaaaaaattttgaggaaaggaggaaaatagatgtctgtaattgaagggtatacatttgccgttgatatgcaagatcgtggtgttgtagctagtttgcgccaaatgcgaagtgccgcaagtgcaatgaaagctgaaatgcgtgccggatttgaaacaattcgacaaggtgaaggttcaatttctgcatataattttaagattgaacaatctgagcgacagattgaaaattataaaaatatacagaaagaacttcgtggagaactagaaaaactttctaaagcacgtgaaaagcaaattgaagagacgaaaaagtatgctgatgctaattcggaagaagcccaaaaagttcaacgtgcttttgacgaaactgaaaagaagtatgctagtaccgctcgtcagattgaaaatgctcaacatcaaattaacaaattaactcaagggattgaagagtctcgaaagtccattctccaatttaatactggtctagctcgtacacgtacagaagcgcaaagtgttaaatcagtaatggatggttatgttagatcagttaatagtcaaggaaatgcttttcgtacagctaaagctcaagtagaatcctacaagttacagcatggagcattaattaaccaatttcgagcagaagtcagtgaaacaaatcgcctacagtctaaagtaaatggactacgtaatagctattctcagcaacaagcaaaagttaatcaaactgtacgtgaacatggaaaagcatctagtgaatatagaaaagaagcagctgctttagttgggctcagtgaaaagattactaatgcaaattcagaatatgcaaagcaaattactcaagcattgaaggtacgaacttcaatcaacgaaatttcacgagcagaactaagcgtcactgatagcggaatttctcgtctaagccgtgcaatgaataatcttgataccaatgcgcgtcgagctacttcacatacgagagaatgggctcaatcattacgtggtggaattatgactgcatcaatggcgcttgttccatttggtgctgctgttggtaaatcagtacaaatgtccgctaatttacaacaatcgtgggttactactggaaatttacttaaatttggtgctaaatcagcaagtgaagctgcgagtgaagttagaaaagtaggcacaatgcaacgtgatgctgctaaattctctaaagaatatggttactcacaaaaagatattgcagatcagtacacagagcttgtaaaacgtggttattctgcgggacagtcaattggttcaatgaaatctatgttagaggcagctcgtgcatctggagatgattatggggatgttgtacaaaatgtttctaatgtattagatgcgtttaatctacggcaaggtaaaacatctgaacaagttattcaaaattcaaagcgagtaactaatgctatggcctatgcagctgatatgacggctacagactttaagaatatgggagaggctatgcattatgtatcagcttctgcaagccaatctggtcagtccattgaaactactacagctgctttaggtgaattgagtaatgcaggattagaaggatcaatcgctggtactggattacgaaaagtgcttaacagtttactatcgcctactgctggcgcaacagaggctcttaaaaagtatggtatgacgatggatgactttaagacaaagaaaggtgctttaaagcagcttcctgatattatgaaagttatcaataagcatactgaaaatctcagtaaagccgatcgtggagcattttttaaagctgtgtttggaacaacgggacaaaatgctgcaatgattttatctcaaagtgctaatgcgatggatgatcttattcaaaaggaagaaaaggctgaaaagaccaattatgttcatcagttggcacaaagaaacatgcaatctactaaaatgcagatgcaacagcttaagatgaatattcaagatattgcaattaatcttggcaataagcttcttccagctgttaatgatgtagcaaaggctatgagtaattgggttggctcaaaagatggtcaaagagcgattggtgactttagtaaaagtgtttctaattttgcacgtgttattagtcataattctaaatcaatcttttcatttactggtggctttgttgaaggctttactgcagtctttaagattagtggaattgttgtccatgcaattggagcagttggagaagcaattggtctgcttacaaaaaatgtagaaaaagcacttggaataaggcaacgaaacataaactttcctaaatacttaggagaagtaaccggtggagtaattggtctagttacagcctttaagattcttaaaggaacagttaatggtttaagtgctctgaaacaagactttttaagtttgttccggattaataaggaaaacgataaaattaagcttgaaaatcatgagcttgaacgaaatgttgcactttggaaagaacataacttggtttctggtggagattcagctattggcaacgctatagaaataccttctaaagaaaaaggcgctgcaagtaaaattgaaaaggctgaaagagatgttcagatcagaccgtaccttgacgaaacaagatcatcgagaatttctaggtggttttctaatgttctttccgattttggtaaaaagggtggagaaaaagctggtgctaaagcttcaacaggatttttaagtaaatttaaatcgttaccaaacttaataaaaaaagcgggtatttttgggtcaattatagactttggcatggtagcattaaccgccttagatttatccaagaatatttattctggtttaacaaattcaaaagcgaaaagtcgttataaggatgctggtaagtcaatggcagaagggatcggttggtatttggcgggaccatttggtggtcagctagcatcattaggaacggattgggcttacaaaactactgattcatttaagaaggggtggaatggttataccaaaaactataaacctcgtggatttgtggctactgttggctgggattttaaggatgctacgcgaaaatataataattggattgcagcaattgaaaagaaacacccagttatagcaggttatttccgatgggaacgtggaacatttaatacagcatttgctacattaaagttctttgctagaaatgtccatgctggcttaaaggaaatgtgggataccattgctgatttaggcacattgaatgtgaaacgctggaaatctgatatgggtagagatgctcgttcagtgattaaaggagttaaagatgattggcgtggattcttcgattggtttgggaaaaatcgtcagaaagaaacaattcacaagccaactcgcaaacaatcagtttcttctaccactgacactcataagtcgacgtcagaaaataaagttaagtctttaggaaacactcgctactctaagtctgacgtacaaaacttaaaagctatgacggctcaaataggttcatatgaaaaaacgttgaaagggttaaagggtgttattaaaactaatgatccaacttctgaacttcgtcatatgaactctgaattaaaaggtgcttcaagtaattgggggaaggttgctaaaccgattaaggaaattggggatgcttttaaataccttagtcggtttactaactcaatggctaaaaaggatgcttttgcagcatttaatgatgacttacctaaactagatgggactgttaaaaagtacggtaaaagccttataaaaaacattgatagtctgggtaagagcttaaagaataattctttggagaaaccccttaaaaagattagtagtgaaataaaagattctacaaaaaagtggaaagaatttgcttcacctgttaagtcattatcaaaatcttttaagacgctacaaaatgcaactaaaacattagttggaaagaatggacttgaagctaccaagaaaggatttacagatctaaataatgctcttaagaaacaaaaaataggtgcttacattaagaagttagctggagatctaaaaaaatcaaaagttactacttatttaactagaatggataagagtgttaaaaactcggcgaaatattggcgttcattagcaaaaccgcttaaatctttagcaggttcatttaatacattgcaaaaatccgtaagagggttaaatggaaagaagacaggttttactgcgctaaattctgatattcgtaatctttaccgtaccattcgtaagaatccatttggccgacttattgctcaacaggctaatattgctaacaaggcgatgagcggtaagaagtctggctttgttaatgaatttaatcgtcaaacacgttcaatggatcgtgcattacgttcatttaagcgtgaatttgatcgcgattggagaagtacctggtctggattagatcgtccagtaagtcgaaatttaggatctgctagtcgttctgtagataggtatcttgatgatattcaaagtactcgttctaagtttagtagttcatttcttaaaggctgggatagttggattgatgatgttgtaagtaatttccgtaaaggatttgataaactccctggatatgctcaatcatcaatgaaagatattattagtcgcttgaacaaagggattagcggtatcaactcaactatcagcaactttggtggtgacaagaaattatctactatttcttatgctaacggtactaacggcggacatccgggtggtcatatgcttgtcaatgattcagttcgtcctcattggaaagaacttgtactattccctaatggtcaagcgttacttccccagcatcgaaataccctcattccaaacgctccacgcggtacacaagtattgagcggtgaaagtacttataaatttatgaattcaattggggttcataaatatgctaatgggacattatccgaatcagaaatggataagttatctgagcaatttgaaaaacatccagaggaagctgctaaaacattgatccttaaaatgactaactggaattcaagagttccacttgtagccgacctaggaccagcttctgctattgcatttgcaaaagctatttctaatgttttgaaagatcaaatggcgtctgaggctaatccgggtggtgctggcgtagcacgttggcgtccatatattattcgtgctttccatgcattaggctatgatgcagctgaatggaaagttaataagttgttgaaacaaattgagactgaatcaggtggtaacccaacgattccacagcaagtacatgataaaaactctggtggaaacgaatcactaggtcttttgcaatttgctttaagcacctggaatgctgatgcgttgcctggacataaaaatcgtgcgagcggatatgatcaaattctagcagctattaatgttcttgaacatggcggtgaaggaggttggggcaacgtcggtatgggtcatggatgggcaactggcggttttgccactaaacatggactatatgaagttgccgaagaaggactcccagaagccatcattccgctagatgttaataaacgtccgcgtgctttatctttgattgatcatactcttgataagatggaacaagatagcggcggaactggtggtttacgtagtcggcgagtgcaaagtcaatctaatgatgaaactactgcttatcttaaacaagctgttactttcttagcgcagattgttggcctaaataaacaacaaatcgatgctattttggctaatggtagcgataatataagtgcacggcgtaaacgagcacaattttatagtagttatggtaaagatcagaagttaaatgattatatgagctattaggaggtggattatctggtgcaaaatcctcaattatatctaaaaattggtgatggaaatgaatttaatattgctgataaggttcaaggcctaagatatctaggagataattcaactccagtaattaataattcatttcttgatattgctggagtagatggaagtcaatttcaatattcaacattttctcgataccagattgttgcaaatttctttttgagattttctgattggcaagacttcaaacttgctaaacatcaattttatcgaatcttcgggcaacgtaaattaattagaatgagaacggacgtggaatcttccattgtccgttttgtttaccccaatttacccgaaataaagcctagtcaagattatgctcatgatgcgttaattacaatgaactttgacaatccatcaggatatcgctattcgttatatcgtagcaactctttatatgacttttcttcgggctctgttcaatttggagaattggggttagaccatgctcctgtttatcactttactaccagtagttttcaagtttttaatccaagtgatattgcaattgatccgtatggacaaaagcatgacttacaagtcgtttgtcactttaatggaaattcgatgaaaattacaaattcaactaacggaagtgagtgggaatatcaaaaatcctcaaatggatcagaaacaataattcttaatggaattaacacaacacttaatggacaaccagcaagtgctaatactgattacggaaaccttattttagatactggctggaataatattgctgttaccggtgccaacagcatagatattactttcagttttccttttatttatctatgagacctggaattactcaaaaaataacagtaagaggacaaggacgcaccgaaattgaacctcttaattgtgttgatccagatagcttttacattacatgggaagttaattcaacttggagtttacaatttactgcttatcaagacggctccttggcctattcaatgttggatagtcaagcgtccgtcttttttgatggtcaagaatatatcatcaaacaagcagaaccagacgctaactctggacaaaactcgttagatgtggtagctactcatgtttattttgaagttggacgaattcgcaagtataagacttatgtggacccacaagataatgataagcaaacagatgtaagagttaacggtggaacacaagtagataatggcaatgacgatagcagtgatgatagtgattctaatgcacaaaaaacttcatctcaatcaaaaaatggcgatactaccaccacaacgactgttaccaagaccgatgaaaccaaagatgactctgacgaaaatcaaatttcttacaaaatcgatgatgttttgaaatattggctagacggcaacaatcttgggttttcatatcaagttattggtgattttccatcgtcacgtatagagcaacttagtgatggtagtgggtcggatatgctaagcaaaattactgatcactggcctaatgcgattatttacccagacaataaaaacattcgggtttacacccaagatcagttcaataaagattacggaaatcgacttgattatctttataacactaccgagtttaagtggacgtttgattctactagcttaacgaatgaagttatgtgtattggtggtaagtattcaattgaaaccgaagttgatactgatacagacagtgacggtgatcaaccagcggcaaacgttactaaaagtgcacaaggtgttattgatgacgcgcgttcttacttgggtgttccatacgtgtatggtggtgcaggtggtgcacgaggaggtaatccacgtaatggaatggattgttcttcttatatatcacaggtttatcaagattttggtattcatgtgcctgctcagactgtcgctatggaaccatattttcatgaagtgagttctccgcaaactggagatgttggtttttatggcgctcatggaagttcttaccatatttccttgtttttagatgcaaatactattatcttcgaaccacaacctggtgaagtttgtaaggaagaacctgctagttggttttatccaagctgggttgcccgcaatgatcaaatggcgaccattgttggtagcggtggctcggcaggagatagtagtaaccaaagtagcagtacttcatcatccattgagtattattactttgcgccatttatgtatcgtgatgaagaatcaattaaaaagtatggagagtttccagcagagccgattgaagacggtcgttttagtgataaaaatgccatgattgaatatgcaaaaacaaaaattcaacctaatccggcattatctgttgacgtaactacttatacaaatttcaagccaatagctggcgatatgattcacataatagtaagagaccaacaaatttccactaatgaagcagttgttggttttaactggtatccgtttagtgtaagtaatccaacctcagttacattgaactcaaatacacaaaacattttagattatcaaaatgcccgtaataagagtttgatgaaggctattgattcgattaaacaagcaccatcttatccggatcagtcaacaaatattctaactattacaagggaggaggcagaccgaattgagcaatacgtcgagcaacaaaacaagcaaaaccaaccaacaaacagttaaagttattgttggagaaattggacgagatacaaaaactggcatcttaggacgtggatactcatatgataatggagcaacctttcatgtaacagacacaatgtttgggcgattatatgataaagacgatggtgaaagaatgtggcctaatatggctcataaagtagcagatgaaatcaaatctgctacggccgacttaccaaacgtccgcaaacaagccgatgaggctgtgaaatttgctgaatccgccatcgctgcaagtaaggtcaatagtgatgcgattgttgcacagagttcagcggtggttgaagcaaagtccgcaatggatagtgctacggcggaaattcagcaattgaaagctaatgcagctagcgatgttgcacaaattagagcagacgttgcgcaagtccaaaatgaagttgatacggcaaaggctgctaactcggctagtgtagataagcttaaaagtgatattggtttagcgcaaaaggacctagataatgttcatgatagcttaactaaagcacagtccgctgttgagcagaatcaaaagctaattaatgacagtgttactaagattaatagtgatattgcccaaagtcgtcaagacattgtaactgctcaacaggctaatgacgatcttgctaaacaattagatacctattccaaagaagcccaagaacagggcaaaacgattaaaaccatccaagataatcaggatggtttttctattacaattgctgatgttaagggcgacgttacaaaggtatctgatacagtagatggcttgtcggctgggctaaaagatgcgcagggcaatattgcaagcgtaaaagcacaagctgatcaattgaacgctactttgactgatcatagtaaggatattgcacaactaaccgcaacagcaaaggaactcagctctacactggaagatgcaaacggacgactaagtaaggttgaacaaaccgcttctgaacagtcgactactttatctgatctgcaaggcaacttaacacaggttaaacagactgctgataatcttgttactacgttgaaagacgctcagggaaatattgaccagatcaagcaagatgccaaagggacactagaacaattatctaacgcccaaggtgatattgctgctctgcaaaaagatgttagtggcatcaaattgacaattgctgatcatgacaagaatatccataccttgcaagctgacagtaaaacgttgaaagatgacatggcagacgccaaggggaatatttccagtctgcaaaaaacatctacttcgttagttagtgagtttaaagatcacgatggtcgattaagcaaagttgagcaaaccgctactgaacataccagcgaattgactgatacaaaaggcaatattgataaggtcacgcaaaaggcagattctttgcaattattactcagtgacgctcaaaagaatattcaaaatattcagattgacgctaaaggcattcatgatacgttgactggtcaaggtaatcaattagctactcttaacattacggtaaataacttcgatagtaagtattccggtataactggcgacttaaaaactaagcaagcttctttgagtaccgagcagctgcaaactaaagatatgttgttgcgtaaagctgacaagtccgaagtagataatgtaaagggaactgttagcaaagtcagcgccgaacaaaaggtaatggctgatcagattagtcaaaaggtgtcatctgttgagtaccagacgttgaaggataaggttaatgggttaaggattggtggacgaaatttaataccaaatagcggaacagatattgttattgagtctaaaacaacggatgcgcggccggcatggtgtaatcgggtgatttatcgggatttaactcctggtgaaacatatactttttctgtttctgctacaaataccaatggggtcaaagaagcctcaatacggatttggaactcagctcttgataaagaagcacctggtagtttagtcttcccagcagatggtcgacgacactcaacaacatttacgattcctaaagatggagtgagctatagcgtttggttgtacgccggacatatgggaaatatagaaggaaaaaactttactacaacttaccatcatccgcaattagagttagggaatattgaatctgattattcccccaatcctgatgatgctatcgcttcaattaagaaaaactcaaccgccattgaccagaccaacaagcagattagcttaaaagccgaccagactgaagttgacaaggttaagggtacggcttcacagaacagctcacggattgatgtcatggctaacgagatcaagcagaaggttgatggcactaccgttaacaacatcttggatagtaagggctatgcaacgatgtcgtatgcccagacgctggttaagcagaccaaggatcagtggaatgtcactgctaccgatcttgacactaagatcaagagcaataacggtggcggtatcaacctgctaaaagctacagatttcagcagcactgatctaactaaacttaaagatgtgtgggggtcaaactttactcttcgtgatggaaaagcaatgcagttagaccagctgaaggggaacggtgacttagacgctacgcagtttcttcccgtagaaccagatactgactatacgctctcttttgaaacttattacaacacggtagcaagcggtggcagctacaataatatctatactttcattgtggaatacaaggatcaaaataatacgacacctcactatcttgaccatatgcgagtagttgctaataccgatgataggtcgaaaaacactcagacgattcatacacagaaagattgccattatgtacaagtgttcttcagagcttcagccaaaacgctattttcattctggcgtcctaagttggagcgtggttccgttgcaactccgtggtcaccggctccgtctgatttagcaaccgttactcaaatcagcaatcttcaagtaagcatcgacggtattcaaggcaacgttactaatctaaaaagcgatacgtcgagtaagcttacccagctttcaaacaccttccaaagtaagataggcgatgcccagattgcaattaatgacttgaaggacaagactttatggaagagcacggatagcgtcgatttgaacaatgtcgttacccagcagaagattttcgtcaaaggcggatcaaatctgccacccggtggttattggtggtatgtgcaggttgaacccggctatgacagccgaatcgtccagtacgccgtgtctgaccgtgacaatctgcattacagtcgtcagtacgacggaagtaaatggtccgcatggtcgcagggtgcaaccgagagtgagatcacccagcttcgtgacgacatcaacctgcgggtcaagagcggtgacttgttatctcaaattaatttgactgctggcaatacgttgattcagtcaaataagctataccttgatgcttcatcagtcgtattttccggtcgtgcttttattccgagtgccgctatttcagaacttgatgctgataagctgacgttctatggaaatggctcacgtgcgactattggcgccggtattgctcaatatgatcaggacaagataaagagcactatcaatcttcaataccaaggtggttttgagattcattcttctaaccagctggggtcaattctaacaatgcacgatgatactgttcggctggctgtaaagtcaaatggtatggcgaaccctaatagtccaacagatcagtattctggattttatgcttctactagttacagtttgatgaactcgtatcttaaagacgggacaacaagtggtatatcaatcggttctgcagatagtggagtgaataaagactatcgaattcatgtttatgatggttcaaatgcctctaacaatctatctaaaggtatttcaattagcactagcagccgatttgatgtttatgcgggtaactcacaattatttttaggacctgataaggcagaattacgtggaaacgattatgctacggttcacggtaatgatcacactttcattgaaggtggtaatcaacagatttatatgcataacggtgaagttaatatcggtaatcctaatgatactggtaatgcaactggggttcacctccgagtctttgggtgggcaagtttcaatggatacgttgaaggcatgggatggaccacaaaatcgactctttccagtaaaacaagaattgaaaagcttgatactaaggatgctctaaacaagatcatggaaactgatctagaaacttaccaatataaggcagaagtagccggaggcatgactaaacgccatgctggtccaattattgatgatgtgcatgatgttgcacagtacagtacacctgatgaatttattaatgagcgtaggacaggccgatctgatgctgatgttattggttacttgatgggcgcagtacaagaattaaagaaacaattagatgaaataaaaaaagaggtacaaattaatggataatttaactgcaaacgcaaatgatgttattgatgtattgcttgatcgttcaaagaatcaagaacgagatattgcaattttacaggttaatttagcaaatgagattaagaaaaataagagtctgcaatcacaactggacgaagcaaaagcaaaacttgctcaaaatgatcaagatttaaaaacagaacaagacccacaagctaataagtaagctgtgggcctttttaatacaaaaatttaggaggaattaatcatgaatgaattacaagtaaacaacttcacttacaactttgataatggacaaatcacttcagcacaaattggcttatatggaaatgaagttacatcaggcgaatatattaatgcctcaattcgggttaactctagcgatttaccagaaggaaagacatttatgcaagtagcaatgggtgacatggtaacaattgctcggcgaaagttagcaaaagatactgcaattaaggaaacgacaactactgataccgaacaaaagtaggtgaattagatggctaagttactatgcttaggtgattcaattatgtggggagtgacaggatacggtgatgctcatccaagagcagatccaactattcctgacaaaattggtgagttaattggtgctcaagtagataatcgagctgttagtgccacatcagttaatgatggcgataaatcgatggtttctttgctctcaacagttaatttagcagactatgactatattctattgggctatggagctaatgattggggacttaaccgtgaaagcttagatgctcttaaggctggattatcaatgttcagttccatgttctcagtttcaggcagtaaagcttatgtattagttgatctgatgattgaatcattcattaataatgcaacaaatcttgacagtcctaaccagttaggaattacacaaaaccaagttatggacgtattcaagagttgggcaactgagaacggctaccattattacgactggcgagaagatccaattgttacaccacagaattataaaacggtgttaggcgatggctgtttgcatccgaacttcgatactcaaatgcagatggctcaacgattagctgattatattaaatcaactgctaaagatataccaactgagccaagcaagcctgatgacaagccaactaatcctacaacccctactaatccagacaaacctaatcagccagacaacaaaccggatcaacccgttgttccagataagccagttataaaattaatcgatcaaattaaaattgatcgccttaatgatttatttggaattggcactaacgtgagtaacggggcaaacaacgttattggtaaggttaatgagctttatagcaatcttgaaacgattatgggaactgatccgcaaaaaactcaaatatcgttagtaatgccaggcaatgcattaacaagaagcttacgtaattatgtgttggcgtcttttcaacaattagaaagtgttgtcaatgatgtgattaaggtttgcaatgctaattggattgttgatccacaaacaggcgattctacaccgactctgaacttacagagagtagatcagttagcaactaacgatgtctacaagaaagcggtcaatgataattggggacaaattgaaactaccctcaataatttaattcagtatcttaatcaagtactaaaaggagagtgaaagaatggcaacaacaatcgatgaagcttatcgcaatggccgagtggttcttgatgtaaccatgtcttctgataaagtcacccgaattgatgaaatgaatggtcatcagggcgacaatgggcgagtagttaagtttgtgatggtcggacaacaaggtcatccgttcaatatggaaaatcgtagtcttgacttggtgggagttgactccgctggaaagactaagattagcggtaatactatgacgatggttaacccgtcattagggacgttagactttacaattccaggcgctttctatcagcgggtcggtgactatgatcgtgcctatttccgcattaaagacaacaacgatcaagttatttcgaccattaatgttatgtttagcgttattcaaggtgtgggctatctgacacaaggtgattcacaaatctatgacggcaacgttgataaccaactagctcagattgagcaaaaagttgcgtcttttacaagtcaacttcaaaatatgctgagcgggacaaccgatgcggcaaaaattgcaagacaatctctgaacgccgtcttatcatccattcaaactaatcaagttgctacattgggtggtaataatacatttacggggcagaatacctttcatgggactactcaaattgataaattaagtggcaatgccttacagcctgcttatgactatgctaacaatgcaatcaatgcggcaaaggctagtttggccgatgatgaatcaggtaagcaatacgatttcaaagcatggggagttaacggttgccgtgctcatgatgatgttaaatgtacgcttatcaaattcaataagtatgtcggttattgcaagcttgaaggaacgtttgattttccaccaatgaagccttacgaagggctggaagttattaatgttgataaagcggcaatgaatggtggtatctatgctttcccacgtttgacagcccagaatgaaaataatgttttaatgtttgattacaacactggtgatagtggtcaaatctggatgcaccaccaatcaaatagttacgatgcaactaagcctgatccagaatatattcaaatcggttggctctgctcctggcggtaaggaaggtggaaataatggcaaatcttttagcatttttgtgttcctacgttgtcggatatgcaattgccatcgctatctatgaactgggcaagaaactacgtagaaaatagaaaggagagataagatgcgagatctaaccattgatgaaaagtggggcgactggaagttcggtgacactgatgcagtaatgactttcactgcattggacgatgaccaagtgcccgactttaccaatcggacattaacgttcaagattgccagtaccttaaacaatgacttagaacaccctaaggacttcgccgctacggctaccgggtatattcaagataagaatgtcattcttaaaacagaagacgttaaacaattaacccctggcaactatattgttgaattgtgggcgatgagcaacgacacgcagaaagatgctgtctatccctcaaaaggatttgctcaatttacgattgaagaaaactcaatgaaggtatcagatgtaactaacattccatcaatgacaattaatgccttttggaatgcggttatgcaaaaagtgggaactttgactaaaggtgctaagggtgatcctggaaagaccccgaagattgtgattggctcggtaaccaagttgtcaccagatgctcaaccatcagcaaccttagtcccattacaaagcgatccaaatacctatactctgaacttacaattgccacaaggaatgcaaggagaacaaggtattcaaggacttccgggaactcctggtggtccaggccttaacgggaatgacggtttaacgccttcaattgatccaaagacgaagcactggatgattggtaatactgataccggagttattgcagaaggacaagcagggaaggacgctgatgcatctaaatttgtcactgttgaacaatttaatgctcttcgacaaactgccagcgataactcaactgaattaaaggctttacaggattctgctaacaagaattcagaagatcttagcaacttgaaagatcaagttaacaccttgcaaaattcaacgaatttagatgagattaaatcacaaattactgctttacaaactgcggttaaagaacttcaagaggctggcaaacctacgactcctgctaagagcaatacaccagcaagtaataagccagcaacaagcgagcctactaagtcggatactccaacctctgctgacccagctactagcgcaagttcagcaagtacctctgatacgtcggcaagtagcgccgctcaataatggaggtgagtaaatgcactgggtagcaattcactatattttcggctactcgctagaggattgggtagccattctaaccatcattgggataatcattaccggatttaaatggctaagcaaacgttcaaagaaagccattgataatattgagaaaaatattcttggcccaatttatgatgagttaagtaaactcaacaagaatatggaagtctctaatcgtcaatatgaaagagccaatgaacgcctgcaagcaggagacaagaagttcattcatcacgacgagcaattgaaagatcacgagcgtcgaattacaaacttggaaagaggtagtcataaatgaatttaaaacaaatgcttaaaaagaagttttttaatccagacggtacgatcaataaaacggttgtagcgtcttttattacgctgttaattgtgctcattcaacaagtcatgatggcttttggctttacgtatggccactgggaccaagtagcggcgatcattaacacgatcctaaccattctggggctttgtggttttgttgaaggcaacggggaagtaaccaccagtactgttgaaattggagttgatggtgtaaagacaactatttctaacggttccattaaattgaatacagacaagactatctttagtggcaagagttttattcctaatcaatctaccaaggagggtaaaaaataatgaaaaataaatcacttaagaaagctaagaacttagcactggcaaccattgctagtgcttttttagtgggtgcaactactaccgtagaggctaatagtgctaatgacgctggctcaacggtaacttggaaaaatgctgatggtcatcaattgaaagataattggttgtataagtacggtaatctttattacttcaataaagacggttaccgattaactaataaagcacaaaagattgatggtaacacttattactttggtaaaggtggagaaatggtccgcaatggtttcgatacccggaacggagcgacttactactacgatgccaatggtaatcaagtaagcaactatttctataacaactggggtaatacctactatttcggtaaagatggcaagcgttataccaatcagttttatactaactggggacgaacttactactttggttctgacggtgctcgctggaataatcgcttctataacaattggggtcatacttattattttggcgctgatggagcgcgatatactaaccagttctaccaaaactggggtaacacctattacttcggaagcgatggtgccttagtaactaatcaagatattacggttaacggcgtgaagtatcacgctgatagtcaaggtgttttgacttctgaaaatactaatgcctttacaccatcacaaatcaatcatacctacgacctcgccagctgggagggaagtagtcaatcagctatcaacgactacatcatcatgcacgatgtcggcgctgaatcaggtgccgctgccaatgctaactatcttcacaacaactgggaatcagcttatacccaatttgttgtcggcgatggtggtcaagtctttgaagtcggtgaaccgggttatgtttcttggggtgctttaaatgctaatccatacagtccgtgtcagattgaattagggcgaacatacaaccgtagccaattcattaaggattacactgcttacatcaatgttgctcgttactacgctaagcaatatggtattccgctaactcttgatgctggtggtgcaggaactcccggtgttaagacccataactgggtaaccgaaaatattggtggctcacatgttgatccatacggatacttagcaagttggggtattagctataaccaatttgctaatgacattgctaatggcgtcaatcagcaacaactcaattcagttgtttactcacaacgtcaataataatttagccctagagattgttaccattttttttgtaatgatccctagggcttattttgttataattgttttttataatgagtgcttaacagggcgctttttgtttaattaagtaaaatataacgcataataggagaaaaaaggatggagacgggaaatctagcggattggtttagcgcaataggcacagtcttttcagcgattgtagcattgtatcttggacttcgtaaaaaacaaattaacgtatcatatgttattaactataatattgttttaaaaaagtggacaataacggtatgcaacgcaagtctaactcctctaaattatgatggttggattgttgatgcgcagggtatgaaacataggactggttgtggagtagaagctagaaaaccatataacggtatatgcccaggaggagaaatagaacttctaaaaaatgctccgtcaatgcatttgaatttatttttaaatgaaagaataagcttaagtaaagttaaattacagtttgttaagaaaaacaaaacagaatatttatatcgtgtttattttagtttaatgggccggaaaattctatatagaaaaattgatgaacaaaaaataaatcttgataatttatcaaaatttattaattaatttcttttaaaagggttttggtatatagtttatttttagatactatataatagtagaaactaacatctaaaataaagttcgattggatgttctgagaaccccaaaattttttgctatatatagcaaaaatatagcaaaaaatatgaaaagtcatggaagactgcggaataacatggaaaaagatccaagctataaacgttgacatgacagtaaaagcctattagaataggacttgtaaaaatataaaacgtttgtcttcaaggcgtggtgaaattcccgaccggcggtgacagcccgcaacccattgttaatggttgatctggtgtaattccagagccgacagtacagtctggtataaagaagatttctgtattaaataatctttaaatagtttatttgcgttgctgacaaacaaatggtaagtcggcaacgcttttttaatacaggatgccaaatggagacaatctcagatggaggttgttattaatgacagtaacgcatcaacgtattcaacgattggtaggcatagcctgtttaggtgccttagcatttattttaatgttttttgagtttccggttttgccgatggcgccctatcttaaactggacttttctgatgtccctgttttgctagggggctatatctatgggccagttggcggaattattatcgctgcaattaaatgcttaattcacggaatgattcatggcttttcgccagctgaattaatcggggttaccagcgactttatttcatccctcgctcttctgcttccgttctgctgggtatggcgtcatcataactggagtaataaaagacaagctattatcggaattgctttaggaaccgtaacgttgactgttttaatgtctctgcttaatttgtggatccttacccctttatatatggcagtttggaactggaagtcaactttgcccgtatctcaattagtagcgatcggtgtgttgccttttaaccttattaagggtttggttgttacaattgtatatgtaattatcgcgggtcggttgagtccatggctagaccagcatagaatgatttaaaaagatagattaagaggctgagatttttcttggccttttatttttatggtagaatttttaaataaattacgtatataaatatataggggggtgaaatccgtgaataaattattgcgcttttttagctatcaccagccacggcgaattcgtgtaattgaaaacactctgcgaagtcggcgaacagtcgcaactctcttttgggctcgacagtatggaatcttagagtggttaggggcagatcgaacactgaatcgacaagaatatgatcagcttattaatcaacttgttgctgataaactattagcgattgatgatcaatcccaagcaattcttacagaagagggcgcgaaagttttaaaaaacgaagaagaaactttctacatcccatcgttttacgactggtactggttaaccaatacgcaacgaataatccaacgactttttttagctattcaagtcgtatcagaattctcttatcatcaaagaaagtatgttccattggcgatttcatatggtgaaatggttgcggtgaagcagtggtttcgacaaaattatcatcacgatctggttaaaaatctctatactgatctccatcggtttggcagcgctttggaaagtgaagatccacgaatgacaacggacctttttaatatcatgattggttatcagcgatcaggatggacaattaatcaagcagctcaagaattgaaaataaaaatcgatgatatccagtacttacgtcatgacgagatgttagcggttagcgcttatgctcgtaattttcctggtccactgcaacaattgctccttccgctgatcaatgagagtccactaaaccggagtgcccaagtaacgtttgacttatatacccagggagagccaattgaactgattgctcaagagcgacggttgaaagaaaatacaattagggagcatctcttggaagcggcaatccttattcctgacaagctagattgggatatccttttgccagagagtaagcgtgacgaacttagtcgattctataagggcgaaccgaccgcatggaaatttgacgagcaaattgccagtttttatgaataccgcctatatcaaatatttcaaggaataacaaatgaaaaataagcaagaaattctagatgttttacaaaatcattttggctttgaggattttcgtccaggccaagaagagacaattaacgccttactggaagggaaagacactttatcgattcttcccactggtgccgggaaatcccttttatatcaattgccagcttatttattgtcaggaacgatcctcattgtttcaccgttgatttcactaatgcaggatcaggttgaccgtcttcatcggcagggagaaaaacgagtcattatgttaagcggccagcttgtcggaaaagagcgagcaagcgtcctccacaatttgaaatcatttaaatttatatttacttctccggaaatgcttgataaccagcaagttttaaccgcgcttaagaaaaataagattgcgttaatggttattgatgaggcccattgtatctcacagtggggccctgattttcgtcctgaatatttattactaaaggaagtgcggcagcaattaggatcgccgacaacattgctgttaacggcaactgctactcctcgtattcgacaggacattttgaaaaaaatggggatgacgactgcctaccaggtaattaaatctgttgaccgtcctaacatttttttagctgttaagtccatcgctactcaaaaggaaaaggatggtgaacttctgaaactagttcaaaaattcactggtcccgggattatttactttgcaagtcgtaagctggcttctcagatggcagaatggcttgaaaaccaaactgatttaaatgtggcggcttatcatgctggcgttgctccaattgaacgatttcgaattcaaaatcaatttatgaataatgaattacaggtaatttgtgcaacgagtgcgtttgggatgggaattgacaaaaatgatattcgttacgttattcattatcatttgccaagtaatttagagaattatttacaggaaatcggtcgagctgggcgtgatggtaagcagagtttggcagttcttctatatgcaaatggcgatgaaatgattcaacgacaattaacaagcgttgatcttccgccagttacaattttagagcagattaagaatggcaagttgtcagcaagtgttttgggggagcaagcgtctttatttgcgttttatcttgaacattcttttacgccgcagcaaataattacgatgtttgagcggcgcaaaattcaaacagaaaaagaattgcaagaaatggttgcttatatcaaagaggacggttgtaaaagagaatatcttttaacatattttggtgagcaatttgccggttcgaatgaattttgttgtgattatgagctttcagattgggcaactaaactgattttgccggtcagtcagccactttctgaaaacaataaagtaggatgggaagaccgcttaaagggcctgttaaatattactgaaaattaaagtttcgtgttgttgctagacaatcatcaaaagtttgcgatacaatcagaatgttaattctcaaaataaggaggcatgattactttgagtgaggaacggaaagagagccgacgagctaatgatgaattatgggataaaaagtttacagataacgaagaccttgatagtgatggccatttatcacgaacagaacaccgtaagcaacgatcacataattcaatgattactacgatcttaatcgtattaattatcgttctcgccgctacaccacttatttattggattaataataaacagtcctttaatcatccggtgagaactgaacaagtagttgctagttctgaaaatagtaaaaaaaaagaatctcacagttcgagtacctctagtgagcattcaaagaaggaatctagtgtaagcagtagtgaatcctcttcttcaagtattgaggaatcaagttcgacacaaaccagccaaagttatagtgctccgcaaagcagtagtagttattatcgatatagtagtagttatcgttatggtaatgggtatcaaaaccggactactcctaatcgctacagtagttatcagcagcgttataacaataaccaaacctataatcgctacaataataatacagaaaatacaaaccgttatcgttaaaaatagagtattagcagcaattttttgatagagtagtgtattggattgaaaatagaggagtgaataactaataatgtgtaagggattgcaagtagcaattgatggtccggcctcagcaggaaagagtacggtcgctaaattagtagcaaaaaagtttaattatgtctattgtgataccggcgcaatgtaccgagctgttacattagcagcattaaaccagggcattgatccaaaagatgataaaaaggttgctgaaattgctcggcaaataaaaatagattttgaacctggtgaaactgaacaaagagttttcttggatggcaaagaggtgactcatgatattcggttgccgaaagtagcagcaaatgtatctgctgtggcggcagttccagctgttcgcgaagagatgactaagcaacagcggcaaattgctgaaaatggtggaattgtaatggatggacgggatattggtacaactgttttaccacaagcacccgtaaagatattcatggtagcgagtgcctatgaacgggcgcgacggcgatacgctgaaaaccaagcaaaagggattaatacaacatcgcttgaagaattacaaaaagcaattgaattaagggataaaaaagactcaacgcgaaaagtttcacctcttacacaagcacctgatgcaatcaaattggatacaacaaatatgacaattgatgaagttgtgagtgaaatcagtaaaataataaaaaaaacacaagatgaattagcctaaatactggaaatgtgaaacaaattttagtaaaatatcttttagagttgattgttgcaaggaggattttttttaatggctgaaaacaacgaaaataaaaacgatatgttagaagcgcttgatagcattgaacaagttaaggtgggcgatgttgtcaagggtgaagttttggcaatcgatgacgatcgtcaagctatcgttggtattaaagatgcaggggttgaaggtgtcgtccctgctaaggaattatcaaccaagccagttgaagacatcaatgatgctgtaaaagtaggtgacgaattagacttagttgtcatttctaagatcggtaacgataaggaaaatggtagctaccttctttctcaccgtcgtcttgaagcccgtaaggtatgggatgacattcaaaagaaatttgatgaaggtgaacacattaccgccaaggtcactcaagctgttaagggtggattagtcgttgatgctggagttcgtggcttcgtccctgcttcaatgattactgatcactatgttgaagaccttaatcaatttaagggtcaagaacttgaattcaagattgttgaaatcgaaccaagcgaaaaccgtttgattctttcacacaaggaaatcattcaagctcaacacgaaaaggctgctgaaaaggtatttgctgaattacaaccaggcgatgttgttgaaggtaaagttgcacggatgactaacttcggtgcatttattgaccttggcggcgttgatggattggttcacgtttctgaaatttcatacgatcacgttgacaagccttctgatgtattgactgctggtcaagatgttaaggttaaggtattaagcgttgaccctgaacgtgaacggatttcattatccattaagcaaactttaccaggaccatgggatgatattgaagaaaaggctccagtagacagcgtattaactggtactgttaagcgtttgactagctttggtgctttcgttgaagtattccctggtgttgaaggtttagttcacatttcacaaatctcacacaagcacattgctacacctgcagatgttcttaagccaggtcaagaagttcaagttaaggtaatcaatgttgatcctgaacaccaacgtcttggtttatcaatgaaggctcttgaagaacgtccaaaggaagacgaaaacaacaataacaacggtgaaaactaccgtggtcgtcgtcgttcacgtcgtaacaataacaaccggagcttcatgaacaacgctccagaagaagaaagtggcttctcaatgggtgacttaattggtgacaagcttaaggacctacggaactagtttcttaaattaattatcttttaaggggaggctgggaattaactcagtctctttactttttttaaaggtatttatacagtagcgcagtagctggctggattccgaacgttgataaatcaacgtccggaatgcctagccatcctcgcgagggtgggaaaacgaagtcgcaagcgacttctttcccactccctctttaatcatttaaaataaaatgaaagaaggtggaaagattggcaaatccaatcgtagcagttgttggtcgtccaaacgttggaaaatcaacattattcaatcgtattgcgggagaacggatttcaattgttgaagatactcctggagttactcgagatcgtatttatgctcatgctgaatggttagggaaacattttagcatgattgatactggcgggatcgaaatatcagatcaaccattattgacacagattcgccaacaagcagaagttgctattgatgaagcggatgtaataatcttcgttgccgatgtagaaaatggtgtaactgatgctgatgaacaagtagcacgaattttatatcgctccaataaaccagtggtcttagctgttaataaagtcgataatccagaacggcggagtgatatttatgattactattcccttggtctgggtgaaccgtatgcagtttcaagtgttcacggtattggaatgggtgatcttttggatgctgttattaaagagtttcctgataacgcagctaatgatgaagatgactccattcactttagctttatcgggcgtcctaatgtggggaaatcatcactggttaatgcaattctaggtgagaaccgggtaattgtatctaacgttgccggaactacccgtgatgccattaatactcaatttgaaacagcagatggacaaaaattcacaatggttgatactgctggaatccgcaaaaaaggaaaaatttatgagaacactgagcgttattcattgatgcggtccatgcgagcaattgatgatagtgatgttgtacttgttgtcctaaatgcagaagaaggtattcgtgaattagataagcacattgctggatatgctcatgaagcaggatgtggggttattatcgtcgttaataagtgggatacattaaaagaaaaagaccaccgaacgatgacagattttactaatctgattcggcaagaattccagtacctcagttatgcaccaattattttcgtttcggcgaagacaaagcaacggttaaatcaattaccgggattgatcgaggaagtatatcaacatcaccgtcaacggatccaatcggcagtcttaaatgatgttttaatggatgcaattgttgccaatccgactccaacacaaaatggtcggcgtttgcgagtatactatgggacacaggttgcaaccgaaccaccaacatttgttatctttgttaatgatccagagttaatgcacttctcctatgagcgttatttggaaaatcaaattcggaaggcatttgacttttctggtacaccgatccatttaatcaagcgtcaacggcagtaaaagttaaagaattcattgtaaaatgaaaaaacattaaaaatgcggctagaagttgagaaaaccgcttgtcagcaggctttcactatgctaatcttaacaatgaaatgatacgaacttctcgtagttatttcgttaattttggaccactcaaaattaacattcacagacgtgagtttaacactctcgttatttgtgggaggtgaaacaacatggcaaacaaagcagaattagtaagcaatgttgctactgcaactggcttaaccaagaaggatgctactgcagctgtagatgctgttttcagttcaattcaagcatctttagctaagggtgaaaaggttcaattgatcggcttcggtaacttcgaagtacgtcaacgtgctgcacgtaagggccgcaacccacaaactggagaagaaatcaacattcctgcaagcaaggtaccagcattcaagcctggtaaagctttaaaggacgctgttaagtaattaacagttaaatgttaaaaagagactaggaaagaatttactcttcccagtctcttttctttttaaagacttgttcaatgcttaaaatcatcgattgtgatatatttaaaagtgatagtaaaaggagggcataatatgacctactcagaacaaatgcttgatcaattagaagcaggaaaattaaaagaagcccaaaactcatttaaactcgcactaattaatgatgatgatgatatgttatttagccttgcggaggaattgtacgcattgggctttcttcaacaggcacgaacgatttacttaaaattattagattgttatccagatgaagatgaattaaagactaatttagcgacgattgcaattgatgaaggacataatgacgaagctttatcatacttagcccagattaaaccagactcgccagcttatgttcaatcattactggttgccgcggacttatatcaaaccgaagaagaatttgaagtgacggaggaaaagttaaaagaagcttacgcgttggctcccgatgaaccagctgttgaatttgcgcttggtgaattttactttatggttggccaatattctgaagcaatccaatattacttccaactaattaaaaatgggtatactgactttgcaaaagttgatatcgctggacgtctagggatttgttacgctcagagcggtcagtttaagaaggctttagggtacttcaatcaggttaaaccggaataccagactagtgatattcgtttccaaaaggggttgacccgacttcaattaggagatactgaaaaggcaataaaaaccttagaggatcttatcaatgatgataaccaatatgcgtctgcttatcctgaactagcaaaggcatatgaaaaggaaaataagtatcagcaggcattacgagttatccaagaagggctcagtgttgatcaatacaatgaatacctttattcattagcagctgaaattaccagctaccttggtgaccaaaagttaatgaagaaatacttggtaaaagcgcatgaacttgctccagagaatatgacgattactttacaatatagtaatttcttgcttcaccaacacgatgatgaggcaaacattaagctcctgagtccattggtaaaagaagatgaaacagatccacaattatattggaacctagcgcggtcatatcaacgaactgatcagcttgaattagccggaaaatattatgaagctgctttgccggcatacagtgaaaatccaacattcttaaaagaattaattaattactaccgcgaaactggtgaaactgataagttaatggatgaattggaacactatctctggttagtcccaacagacactgaaatgcaagatctttatgaccaatatgaagattacaaataatttttaatttaaatgagacaggaaacgttaacgcttttagccgttctttacgcttcctgtctctttttagtagtaacttaatttgttataatcaactttgattatcaaaatgaggacatgattaaatgaaaataaaaaaattaccagctatatttgaaccagcacgccctgttttacaaaaaatagaggaggccggctacgaagcatattttgttggcggttgtgtccgtgacactattttgcatgatgagattcatgatatagatatagcgacgagtgcttaccctagtgaaataaaggcgatttttaaccatactgtcgataccggaattgaacatggtacagttatgattctcgaccatggaacgggatatgaaacaactacttttagaaccgagtcaggttaccaagactaccgccgtcctgataaagtgacttttgttcgttcattaagtgaagatctccagcgtcgagacttcacaattaatgccctcgccttacgggaagatggggaagttattgatctatttgacggactagaagatttgcaaaaacatcttattaaagcagttggcaaccctaatgaacgttttcatgaagatgctttacggatgatgcgggccgtgcgttttgcaagtaagcttgattttgtcattgatactgcaacattaaaagggattaaagaaaatgcaccattattagaaaaaattgcagttgaacgaatccgggttgaactagaaaaactattgctgggtcaaaatccagtagcgggtttaaaagattttattgcgactggattgtaccaatattgtccagggttggaaaatgcgcaagctgctttatcggctttattaatccttaaccaatggcatttggaaaatgaggcccaattgtggtcagttttgagcttacagctccagcttgatcaaaaagaaattggtaaattcttaaagaagtggaagacagcaaatgatttaattgcgcaggtcaaaaaagtagttccagcagtccaagcaattcgtcaacgtacgcttacgccaacactaatgtttaataccggtgaaacagccctccatgatgctaaccaagtagctaagttatatggatgggcaattaatgatgaggaattacaaaaagcttatcaaaaattaccaattaaaaacgctaaagaattagcaattgatggtcgaatattaattactaaagcgggggtaaaaccgggaccattgatggggaagattcttcagcaattaacgttggcagtagtaaatggcgaaatagctaacgatgcaacaaccttattagaaaaagtagaagagataacgaaagagggataatatgcaaacaatgcgtgcagagggcctaaccagcacatacggtgaaaagaccttatttgatgatatttcgtttattatcaatgaaaatgatcgaattggactgattggtgttaatggaagcgggaaaacaagtcttcttaacgtaattagtggggaagtaaacccagaaggtggcggtcagatcactaaacccaatgattatacgatcggttatttaaagcagcaaccagagcttgatgaaaataaaacaatcatggaagctgtttttgaaggtaaacaaccagtgtttgaaacgattcgccaatatgagctggcgcttgaacgctttacgaagcacccggaagatccacaagcaatcgaccgttacacaaaaatgcaggcacgaatggatcaagaagatgcatgggaagcagatagtcgggtgaagacgattctgacccagttaaagataaaagatgtaagtcaaaagattgctcaactttctggaggacaaaagaaacgggttgggctagcacaagtcttaattcaacagccagatctcttattactggatgaaccgactaaccacttagacctcgattcggtagtttggctccaagattttcttcgtagttataagggtgccgtccttgttgttacccacgatcggtacttccttgatcaaattacaaatcatatctgggaactatcttttggtaaactttatcactacgagggaaattatcaggactttgtagcaaaaaaggcggaacgagtagaattagctaaagatactgagaaaaagaatcaacagctgtataaaaaagaattagcctggatgcggacaggtgcaaaagcccgttccacaaaacaaaaggggcgaatcaatcggttccacgaattagaaggaaaaataggtaatcttaaaaccgatgaagatattgctattaatcttggatcacaacgtctagggaaagatgttattcaatttaaggatgctaacttaaaatttgataatcatcaaatcctccatgacttcaattggcttgttcaggcaggtgatcgaattggaattactggtgaaaacggggcaggtaagacgagtttattaaacgtaattgcccaacgtgtccctctagatagtggtgtccttaagattggtgaaaccgttaagttaggatattatacccagcaaacagaaggaattgacaatgataagcggatgattagtttcttgtctgaaattgcagataatgttactgataaagatggtaataagcttagcgttacccaattattagaacgtttcctattccctcgctttatgcatggtactttgatccgaaagctttctgggggtgaaaagcgacgattatacctcttaaaaatcttaatgcagcagcctaacgtcttattactagatgaaccaactaacgaccttgatattggaacactgacagttcttgaagattacctagataattttgcgggaactgttattacggtttctcatgatcgttatttcttagataaagtggccgacaatttgctagtcttcaatggaaatggtgatattgagcgttatacgggacgctttactgattatttaactgctaaaaaagaagaagcagataaggataaagagcttaaaaatgatcaaaaagcccttgctaaaaagcaggcaagtaagcaagaaccagccaaaaaagaaaaaacaaaacttacttatgctgaacaactcgagtgggatcatattgatgaagaattagacgcccttgatcaacagcatcagcaattagaaaatgaaatggctgaagcagcaagcgattatacgaaaattgctaagttacagaagcagctaaatgaaatacaagaaaaaattgatgaaaagacagctcgttgggagtatttaagcacatacgttgacgagtaaaggaagggaacataaggatggcaacaaatataaatgaagagcaatacttagacttaattcgttatgttttgacgaatggacatcaaaagggtgatcggacaggaactggtactaagtctgttttcggatatcagatgcggtttgacttaagcaaaggttttcctattttaactaccaagaaagtcccatttggcttgattaagagtgaattactatggtttttacgaggtgacactaacattcgcttcttacttcaacacaagaatcatatttgggatgaatgggcatttaagaagtgggtggaaagtgctgaatatcaaggctcagatatgacagactttggtcaccgctggcttaaagatccagagtttaagcaggtctatctccaagaaaagaaggcattttgtcagcgaattcttgaagatgatgattttgcccaaaagtatggcgatttagggcttgtttatggaagtcagtggcgaaaatggaagacgagtcaaggcgacacaattgatcaaattgctaatgttatccagcagattaaaactactccagattcacgacggatgattgtttcagcttggaatccagaagatgttccttccatggctctccctccatgtcacacaatgttccaattttatgttaatgatggaaagcttagttgtcagctctatcaacggagcgccgatatctttttaggagttccattcaatatcgctagttatgcattattgacgcatatgattgctcatcaatgtggtctagaacctggcgagtttgttcatacattaggggatgctcacatttatctgaaccaccttgatcaagttaaagaacagctgacaagaacacctcatgaagctcctaaattgattttacctgctgaaccaaaaccaatcgatcaatatgaaatgactgatattaaattagaaggctatacttatgagccggcaatcaaggctcccgtagcagtttaaaaggagtggttcaaaatgagtgaactgaatttaatctgggcggaagatttgaatggttggattggcaaagataatacaattccgtggcatgtttctgctgatatgaagcattttaagacaaaaactactggtcacccaattataatggggcgaaaaacttttgcttctcttggcaataaaccgttgcctaagcgagaaaatattgtgcttaccagtcagaacatagatgctgaaggagtgaaagtcgttcattctttagctgcccttaaagaatatcttaaagcaaatccaaacgaatattttgtaatcggtggggcaacgatctatcagcaattactcccaatggcgacaaagctaacacgaacggtgataaataagcaaattgttggagatacaaaaatgccaacgatcgattatgaccgttggcacttagtaaaccacaataattatgaaaaagatgaccagctaatttgtcgttttgaagaatgggaactaaacgtataaaagaattgaaaagtacattaatatcgtgccgatgaggacaaaaatatgccaaatcaaatgggtatatgccgttggccggctgtaaaagagggcgccaagagtaaaggaaagtcctcctagtaaaagcaatccgaagccaactggaccaagcgcataccagagaggcatgaaggcaactagacatagccagcccattagaatgtaaataatggttgaatatttacttttatgttttaaccaaatacatttatacacgattccaataacagataagccccaaatcacgccgaaaattgtccagcctaaccagccgcggatactaactaaacaatagggggtataagtcgcggcaataagcacaaagatcattgaatggtcgagaatttgaaagacccgtttagctcgtgtaaagatcaaggcatgaaataaggttgacgaaaggtaaaaaagaattaaagcacttccgtaaatagtaaaggtaacaattcgcatgggactaccagtatgaacagctctgataattaacaagatcaagccagcaatcgatagtcctgctccaatcccatgagtaaccgcattacctatttctatcagcaaagtacgccgatctcttgtctctttttgtctatccatcaaaaaacctctttccaaagaccaatgaatttttaaaatatttttgttatactaaataaatagtaattgatcctacaaaattagataaaattgagtataatagtacttgaaataaattatctagttctcaatactagataattatagcacaaattgttcaggaagagtggtaagtttcatggcaaagataaaaattgtttgtgactcatcagcaggattaactgatgaagaaattaaaaaatatgacattacaattataccattaagtgtaatgattgatgggacggtatacgttgagcgtgaaacaattacaaacgaacagttccctgaaatgatgaagaatgctaagtcactaccaaagacttctcagccaccaattgggaagtttgtagatgcctttgataagctaggtgaagatggtagcgaagtattatgcgttacaatgatggaatcaattagtgggaccgtccatgcggctgaacaagcggctggaatgacaaagacaaaagttacagtctacgattcccagtcaaccgaccaagtaatgggcttcgaaataattgaagcagcccaagtgattgaagctggtggtagcgttgaagatgcaattgctaagatgaaagaagtacttagtaaatctgaactttacttggcaattgataaccttgataatttagttgctggtggccgaattagtaaatttgctggtgctatttctaacctattaaacattaaggttatgctccatgtgtatgacggtcagattcatattgaatcaaaaggccgtggcattaaatcaatgcataaggaatgggataagattttagatgaaatggcacggggaccaaaagttaagcgaattggaatttctcatgtcgatgctggcaaagaagtagaacgcttattagcaaaaataaaagaattttatccagaaatcgaggttactgttcgagagacagtgccaattattgcaactcacactggaatgggtgcttgttgtttgctatactatacagaataatctttgataaaaataagtggaggctgagaaaaatggaaatttttcccagcctctatcttcttaaaattttaaaataaaggactatagaatagatgaaaaagtggactaaatggctattattatcgcttttggctattatgattattggtgggggatggtatactgttaaccactttacaaatttaactagtaatagttcaaaagttgttacaccaaagtatgttgaaaagaaaaatgtaaagctggttgcactaggcgattcccttactcacggtcaaggggatgagagtaataatggtggatacgttggggtaattaaggaaaaaatcgaacaccgttaccaccaaactaaggtgacaacagtcaattacggggtaacaggggaccgatccgaccagattcttgaccgcttaaatcagcaatctcaattacgtagtgacttacagagcgcggatgtgattacgatgactgttggtgggaacgacttgatgcagatcttggaaaaaaacgtaatgggctctgaacggcaagttaccagtagtgttgaaagtggcgaaaagacttatcaaaaaaaattaattaagctatttgatgcagttcgaaaggaaaatcctaaggctcctatttttgtgatgagtatttataatcccttctatatctatttcccagatgtaacaattattaacaagtcaattaatcaatggaaccaaactacgcaagatacaatgaataattataagtcaatgtattttgtgaacattaataagttgatgtcatacggtcaatatcagactaagagtcagcaacaacagctggtcaaggaagaagaaaaggctaatcaagggcaagtcagtcaaaagcgggtcattgaaattatgaatcataaggataagaaccttaataaatatatttcaacagaagataatttccatcctaatcatacgggatacgtcaaaattgctgaccaattatttaaggtaatgcaaaaacatgatagctgggaattcacacggaggtaaaaatgaaaaattctgaagaaaaaaagactaattggtggaaatggggcttttttttcttagtagccttgattgtaattagctgtggggttgtgttaaacaaggtgactgcaccgactcctgctactacaactagcaaagcagtaaagccaagcgattcatcagtaacggttgaattgaataaaaaacaggtgaatgctttagctgctaattacctgaatcagtttttaaaagggcaaaagatccgttatgattttattgttggcgatcagtatgctaccttgacaggaaatactaagtttctaggggctaaggtgcgatttgccattaactttattcctgaacgactaagtaacggaaatgtcttgttgcgggctaagggactttcagttggacggttaaatatcccgatcaaatttgtgatgggttacattgcaaagaattataatattcctaaatgggtaacaattaacccacaaaagaagacagttttattagaccttaaccgttatagcaagcaccgttctcttaagtactcggctcaggaaattaacatgcaagaaggacggtttaagtttttaatcacggtcccaacaagtaatgaataaatattggaggaaatcaaaatgagaatgagtttttatcagtttttaatgactcaacgaaatccgaatagtgcagatgaagttcaacaatttgcaaacaacgcttttttggatactacttttcctaagcattcagaggattttgatgaaatttcgcattatttggaagaaaatgctgactatttgccatcaatgacaatttttgatgaagcttggcaacggtatattgatgcaatgaattagaaaagaagggagaaagtcaaatggcaacaattcaatggttcccaggacacatggcaaaagcattacgccaaattcgtgaacaaatgccactagtagatattttgtttgagctagtagatgctcgtgtcccctattcgtcacaaaatccagaagtggcactagctgcaggagaaaagcccaaacttttaattatgacaaaaacggacctagcagaccagaaacgattaaatgaatggattaaatactttgagcaacataatcaaccagttcttgctctcgattcacgccaaaataacgtggcaaaagttgtaacggctaaaagtaaagagatattaaaagatagattggcagaagaaaaagccaagggaatgaaaaagaggccaattcgggcaatgtgtgttggtgttcccaatgtagggaaatcaactcttttaaatcacctggtaaaaaagaacgttgcggctactggaaaccgtcccggagtcactactggacagcaatggttgcggtcatcagcagaattggaattacttgatactcctggtgtcctttggcataaatttgctactcctaagcaggggataatgcttgctttaacaggagcaattaaagatagcttatatgcaaaggatgatgtagcgttgtttgcccttgattacttgcggcaacatcagccagagatgttaaagcaacgttaccacttaactgatgcagatctggacgaatcggttgccaatccagatttactattaacgattactgctaaaatgggctttcgtgatgattatgaccgggctagtgaacgcttgatttttgacttgcgaaagggaaaattaggaccaatcactttggaagtacctgctgacctaaatgaggatggactaaatgaataaggaaaccattagtcaaattaaggcccgtttacaaactatcacagatacaactgatccttacttgcaaactattcgtgatgattcgcgaaaaggtgttcaagcagcaattcagcaatttgaacggcggcttgcacggcagaaggaagctgaagaggcgttcaataaccggtttaaatatgaaaagtactactgggaaaagggatatcagtatgttgcaggaatggatgaagtaggaagaggaccattggctgggccggtggttacttgtgtagtaattttaaatgcagattttgacctgataggggtaacagattccaaacagttaactaggcatgaacgagaaaatttgtatttacggattgttgatgaggcggttgaagttagcattgcggtaaatgatgcgccagtgattgatcaaatgaatatttatgctgctactcaggatgcaatgattcgggcagttaatcaccttcaccatcgaccagatcatctgattgttgatgctgtcccgttagcaattgatattcctcagacgactttgatcaagggggatcaaaagagtattagcgttgctgcagccagtattgtcgcaaaagaataccgtgatcacctaatgcgggactatgattatgtttatccagggtatggttttgcacaaaatatgggttatggaaccaaagaacatttagccggcttagaaaaaatgggggcaactcctattcatcggcgttcttttaatcccgttccaaaatatttaaattaaaaaatgcattttcaaaaagctttcgtatataaatatagggaggcttttttatgttacaagtaaacgattttctattacggttaagtttatgtcgcggaattggcttagtttcaaagtatcgtctatgggagtgtgctcaacaggcgcgctgctttaataatattgactatttgattgaccatgcaaatgttagcttacgaagtgcgtcgtcattgaaaaataattggacaagtccagagcttgatcaagcagtggccttaaacagtcaggaaaaatttattacaattgcggatccgttatacccgatcaccttgaaagaaacgtactgtccgcccttggtattgttttatcgtggtaatctgagcttgctccatcagccttcaattggtgttgttggcactaggcagataactaattatggacagagcgctttacgaggattgctgccaccagtaattaagcggcagatagtagtaatcagtggtttagctcaaggagtagatggttttagccatgaactggcgttaaaacatggtggccttactatcggagtgattgggacgggtttagatcaagcttacccccgaagtcaccaagtccttcaagatgaggttgccagacagggattagtaatttctgagtatgggcggggtgaatcacctgtggcttatcacttcccagaaaggaaccgaattattgcaggtttaagcgaagtggttttggttgtcgaggcaaagaaaaggagtgggagtttaatcacggctaatatcggtttagatgaaaatcggtctgtatgcgctattcctggaaggattgatgctcccttatcagtaggatgtaacagtttaatcgcagctggcgcgaaaccaattctcagcgcccaagatctgctagatgagtttcggctgtacgattcaagggcttgatttctggtgagaagttgattaaaatattttgttcaattagagattatatttgacagatggtagtcaaatggattaataatattattgaatgaaatattaaaaatgttaggagcctaccagaatggcaaccaaaacaaccaaatcaacggcgaaaaagacaactcgtcgccgttcaaaaattaaaaaaaatctggtgatcgtggagtcaccatcaaaggcaaaaacaatcggtaaatttttaggccggtcctataaggttgtggctagtttaggtcatattcgggacttgccaaaaagccggatgggggtagatattgaaaatgactacacccctgattacatttcaattcgggggaagggtgatgtaattaaggaactacggaaggacgttaaaaatgcaaaagccgtatatcttgcatctgacccggatcgtgaaggggaagcaattgcctggcacgtttcaaatattttaaagcttgacgatgatcaaaagaaccgggttacctttaatgaaattactaaagatgctgttaaagaagcttttaaggaaccccgagagattaatatggatctcgtggatgcccagcaggcacgacgggtattagatcgattagttggatattcaattagcccaattttatggaagaaagtcaaaaagggcttaagtgctggtcgtgttcaatcagttgccctttatctgattattcaacgtgaaaatgaaattaaaaacttcaaaccagaggaatactggacaattgatgctgatttcaagaagggcaaagaagaattcaaggctagtttttacggtgaaaatggtaagaaggtttccttgaagaataatgatgatgttcaggcagtcctttctaaaatcgataaaaagaaagatttcgatattactaaggtgactaaaaaagaacgtcggcggcaaccacagccaccatatacgacctcgaccatgcaacaggatgctaatcgtcgtttgaacttccgaacacgaaagacaatgatggcagcacaaatgttatatgaagggatcgacattaaagaaggagcaccggttgggttaattacctatatgcggacggactcgactcgggtggcgtcaattgctaagcatgaagcgtctaactatattcatgaaaactatggagcagaatatgcggcaataaagccggttaagggaaaattacctgaaggggcccaggatgctcacgaagctattcggccaacttcagtctatcggacaccagctaaaatgaagcaatatttaacctccgaccagtataaactttataatttgatttggtcgcggtttgtggctagtcaaattactgcggaagtaattgatacgatgagcgttaacctccagcaaaatggggtcgatttccgtgcaaatggatcaaaagttaagttccctgggtttacgaaagtatataagcgaggaactgaaaaagataacttgttgccagaattaactgaaggtgacaaggcaaaaatgataaaggacgatccagctcagcactttacccagccacctgctcgttatacagaagcggctcttattaaaaccttggaagaaaatggcgtcggtcggccatcaacctatgcgccaacccttgatacgattcaacgacggtactatgttcgccttgtatcacgccactttgagccaactgaattgggtgaaattgtcaaccgaattatcgaaaagcaattccctgatattgtcaatgtccaatttactgccgatattgaaggcaaacttgatgagattgaagagggtaagcagaactggattaatgttgttgataaattctatcaaccattctcaaaagaagttgatgcagctgaagaagaggttgataagattgagatgaaagatgagcttgctggcacagattgtgaaatttgcggggccccaatggttattaaaatgggtcgttatggtaagttctatgcatgttctcgtttcccaaattgtcggaataccaaggcgattgtaaaagataccggaattacatgtccaaagtgtgggcaaggaacggttgttgaacgaaaatcaaagaagaaccgaactttctatggttgttcccgttatccagattgtgacttcgtttcatgggataaaccgattggacgtaattgtcctaaggatgggcacttccttgttgaaaagaaagtcaagggtggtaaacaggttgtctgtccaaatggagactaccaagaagaagttcagaagtaaaaactctacttcatttttactgagttttacttaaacatttattgaaaagggttccaaaatctgctattgtgcgtttggaaccttttttatatacttaatgttaaacgattatcaattgaagggatcgataacaatgattactttacaaaaccaacaattaaccgtaaaaattgatgaattaggtgctcaactacatagtattaaacggcaggataacggaatcgaatacttatggcagggggaccccgcttcatggaatcgccaagcaccaatcctctttccgttcgttggccgcttaaaagatgatcaatatcaatatggcaaccaaacttatcatcaaacacaacatggttttgcacgtgatcgaaaattccaagttattgagcaaacaccatcgatggttgtgatggaacagcatgatgatagtgaaactaagaaggcattccctttttcatttagtcttcaagtaaaatttgaattagttattgataaagttgaaattagctatgtggtgaagaacccgagcggagatgaaaccttaatctatgccattggagcacatcctggttttaatatgccgttaactagtactgggagttttgaacaaacagaattaagcgttaaaccggcaacagaatattcacggatcattttagatggcgcctataacgattcagctcatccacaattgattaatatgcaggattcattatcacttaatcatgatctttttaataaggatgctattattttcaaaacagatggcggccattttacagccaaattaacggatactgttgctaatcacggggtcgtagttgatacttttaatacagaatacgtgggagtttggtcgcaatatccaagtacagctccatttgtatgtgtggaaccatggtggggaatagcagataatgtcaaggctgatgggctcctcctccataagcaagggatgcaccgtctagcaccaaatgaaacagataattatcattttagtattaagccattttaacgaaaaaataggagactgtgaaactttccatttccagtctcctatttatttagcttcttttctcgtaaataatagccaaggccaaaacttaccattgattcttttcctgataaaattcggtgaatgtttgatcggtggcggtaaaagaccactcctgttaatattcctgccacgattgctaaaatccaagcatgaatgaagagggcaataatgaaaattgcactaatccctaccatactggcggtactaaccatacttgtcaagcataagacaaagataaaaatcaaacaggcaacaacaaagaggagggggttataagctaagagaatccccgcgctagttgccactgctttcccgccatgaaaattatcgaatattgatacagtgtgaccaagactaccaaagagtccgatcaatagggggttaacggttccagatatccctaaaaagtatggctgactggcagcgagtgttccctttagaatatcgataaccaaaacaacgacgcccgccttaaatcccaatgttcgaaaggtatttgttgttccgatattaccgctacctaacttgcgaatatctttatgataaatatacttaccgatccagaggccagttgggattgaacctaagaggtaagcaataataatcatcccaataatttcaaaaatcatataaatagctccttaataatagcttatacagcttttaagcatagcatgaatatttaattttaaccactaggaagacacaattgtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggaagaactgttaattgttctaggattatatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcatctgcttgtttttccgttaggttttgtgattcataagtatctaaaattattgttagctctgcttgatcatgatgacgaacggctttaattgctcgcatggctaattcgttgtgccggcctaaagtatgttcaattttctgcaaacaatgatagcggtcgagaaagtattcaccatgtgcactttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattaattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaacgacacaatttgccaatctactaagttttcagtatcattttaattatgaattgaaattgtggccggtttagctttacaattagcaaatgtaaatggtaaaataattttccgaacatacgtttaggtataatattggcaatgggaggtcattttgtggccaaagaagaagtaaaatatgatgcctcatccatacaagtattaaaagggcttgaggcagtacgaaaaagaccagggatgtatattgggtctactgactcacgtggattgcaccacctggtatatgaaatagtagataatgccgttgatgaagcattatccggttatggtgatgagattaacgtcaccattgaagcagacaatgcgattacagttcaagatcatggtcgggggatgccggttgggatgcatgcttccggtaagccgacacctgaagttattatgacggttctccatgctggaggaaaatttggtcagtcagatggttataaaacttcaggagggcttcatggtgttggagcttccgtagtaaatgccttatcatcacatttgacgctgacaattgtccgtgatcacgtccgttaccaagaaatttttaaggatggcggtcaaccagttggaacgttgaaaaaattaggaaaaactaaagctgagaacggaacgaccgtctcattcaagccggacccgaagattttttcaactactgtttatgactacaataccttagctaatcggctccgtgagtcggcctttttattgaaagggattaagattatccttaccgataagcgagctggtcaagaaaaacaagatgtattccaatttgacaatggaattcaagaattcgtttcttatcttaacgagggtaaggacgttttaggaaagacgctctactttgacggaaagcaagatggggtcgaagttgaagtagcggctcaatataatgatggttactctgagagcttgttatcatttgtcaataatgtccgaactccagatggtggtactcatgaagccggattccggagtgcctggacgaaaactttcaatgaatacgcaaaaaaggttgggctgttaaaggctaatgataaaaatctagaaggtagtgatgttcgggaagggttaacagccgttatttctgtccggattcctgaacgtctacttcaatttgagggtcagacaaaggataaactgggaactcctgaagcacggaagattgttgatgcgattgtcagtgagcagcttaactatgccctaatggaaaatggcgactttgctcagatgttaattcgtaaggcattaaaggcgcgtgaagctcgagaagctgcccgtaaagcccgtaatcaagctcgtggtggtaaacgaaagggcaaaaaagaacgcaatctttctggaaaattgactccggcccaatcaaaaaatgctaagaaaaatgaattattcctagtcgaaggggattcggccggtggttcagccaagcaggggcgtgaccgtaaattccaagcaattttaccattacgagggaaagtgctaaatacagaaaaggcgaagttagatgatgtattaaaaaacgaagaattgaacacaattatctatactgttggtgctggtgctggttctgaatttaacgttgaagattcaaactacgataagattattattatgactgatgccgatgatgatggtgctcatattcagattcttcttcttacctttttctacaaatatatgcggccaatgatcgaagctggaaagatctatattgctcttccaccactttatcgcttgcaacgcggacgtggagctaagactaatatcacgtatgcgtggactaatgaagaattaacaaaattgactaaaaagatgggcaagggagcacaattacaacggttcaaagggcttggtgaaatgaatgctgatcagttgtgggaaacgacgatgaatccagaaactcggacactaatccaagttcggatcgaggatgctgaattagctgagcgtcgtgtaactaccttaatgggtaataaggtggaaccacggcgagaatggattgaagaaaatgtccaattcacgttagccgatgatcaagaatctgataaattagttgagaataaaggacaattacctcaaactaaagagcctacaattaatacatggaataaatagagaagggaatcaagttttgtgagaaacggaaaaattgaacatatgacgctcgaacagatcatgggtgatcgttttgggcgttattcaaaatcaattattcaagaacgagctttacctgacattcgtgacggattaaaaccggttcagcgccggattttatttgccatgaataaagatggaaatacttatgataaagggtttcgtaagtctgctaaatcagtcgggaacgtaatgggtaacttccacccccacggtgatagttcaatttatgaagcattagttcggctaagtcaggattggaaattacgtgaacccctaattgaaatgcatggtaacaatggatcaatggatggtgatccaccagcggccatgcgttatactgaagcgcggcttagtaaaatagcaggtttaatgcttcaagatatcgacaaagatacagttgaaatggccttaaactttgatgatactgaaaaagaaccgacagttttaccagcacgtattcctaacttactcgttaatggagcaactggaatttctgctggatatgctactgagattccaacacataatttaagcgaagttcttgatgcactgatttatcttatcaagcatccaactgcttctttggataagttaatggaatttattcctggccctgatttcccaactggtggaatcattcaggggattgatggcattcgtaaggcataccagactggtcgcggtcgggttgtagtgcgagcaaaaacggagattgaaaccttgcggggtgatcgtcaacaaattaatgtgacggagattccttatgaagtaaataaggcgcaactagttaagcgaattaacgatctgcgccttgccaaaaaagttgagggaatcgcggaagctcgcgatgaaactgatcgtagtggattacgaattgcaatcgaactaaagcggggagctaatgcgaacggtattcttaattacttattaaagaacactgatttacagattaactataacttcaatatggttgcgattgatgaccagcggccaatgcgtgttggattgaagcgaattttgacttcctatcttgaattccagaaagagattattcgtcgacggacacaatataacctaacgaaggctcaacaacgattgcatattgtcgaagggttaatcaaagcactctcaattttagataaggtcattaaaacgattcgagcaagtaagaatcgtaaggatgcaaaggaaaacttagtaaaagaatacaactttacacctgaacaggccgaagcaattgttaccttgcaactttatcgcttaacaaatacggatgtaactgagctgaaaaaagaacaagaacaattaaattcacggattaatgaatatcagttaatcttgactaacgaaaatgagctagcaaaagttcttactaaggaaattagggccattaagaaggaatttggcaatccacgacggaccaagattgaaaatcttgttgaaaaacttgagattgatactaaagttacggttgccaacgaagatgttgtggtcttagtttcgcatgcgggctatatcaaacgaagcagcattcgttccttcaaggcatcggaggcagaagaaaacggtctccgagaagacgattacccattattgattcaacaaacaaatacattatcgcatttatttatgtttaccaatcttgggcatattatttaccgcccaattcatgaaattgcagatgcccggtggaaagataccggcgaacatatctcacaaacaatcggtttagcggataatgaagagatcattaaagcaatgatttttgataaactagatcagccaggaacaatcatcatgggaactagcgatggtcaagtaaagcaaacggcctttaatgactataagcctggttcacgttacaagagccatgcaagtgtcgcaattaagcttagggataatgcgcaagttgtaaatgttgattactatgaaccaacaaatgagaaccgttcactattgacgattagtcgccaaggatatgcagtgcggtatgatgttgcagatgttcctgtaacaggaatccggacagctggtgtacgggccattaatttgaaagatgatgaccaagtagcagatcaaatcttggttaaggatggtcaagatattgctgtaattactcaacgaggtgcatttaaggaaatgccagttgatgagattgaagttggggcacgagcacggcggggcgaacttgtccttcggcggttgaaatcacatcctcatgaaattgcagacttccttgcttacgaccatgattatcaaggtgcttttgagactattactaaccggccagcattccaagatataatggctactgaccatcatctaagttcgattaagtcaaatggaacttttgtaattgataccgatacgcaaggggaaccaataaaacttcgaatgaaacaaacgaatgttttatccgaagaacctgttagccaaaattaaaagaaggcgaaaagtttggcgtatattaaagaaattcgtgatttagttgggaatcgtcccttaataatgaccagtgcttctggggcactcttaaacaagcagaaggctgttttacttcaagaacgggcggacactggtgattggggtttcccaggcggctacatggaatttggcgaatcttttgagcaaactgtaaagcgggaatttaaagaagatgcgggaattgaagtcgtgcctgtcaaacgactagcaatttttgatcagaatttttacacttatcctaatggtgaccgcgttcaaccagttaatgctttttacttagttgaagaaagtagcgctaagcattatcagcccaaaattacagaaacgacaactactgaatatttttcgttagataaagaaccaccacgtttttttaacagtcagcatgaacaaatgtggcagatcttaaaagattttattcataataggaaagatatttaataattgttctttaatctattaacttccatgatagaatagaaaatgtagattgtttcacctactagaaataactaagattaaagtagtgaacaaacaggaggaatttatatgagcaaagaattagtatttggacaccaaaagcctgatacagatgcgattaccgctgcaatggcattttcatacttccaaaatcaattgggatacgaaactgaagcagttgctttaggtgaaccaaatgatgagactaagtttgcattgaagactttcggtatggaagcaccacgcgtaatcgaaaccgctgcaaacgaagtagataaggtaatgcttgtagaccacaacgaaccacaacaaagtgttaatgatatcgacaaggtcactgtaacgcacttagttgaccaccaccgaattgccggctttgaaacggctcaaccactctgggcaactgttcgtccttacggttgtgtaagtacaatcattacagaattgttccaagaaaagcacattaatattcccgctaacttggctgggatgatgctttctgctatcatttctgataccttgcttttgaagtcaccaactacaactgaccacgatcgtgaagctgttaagtacttagcaaagatcgctggtgttgaagattacgaaaagtacggcattgaaatgcttaaggctggtactaaccttggtgctaagtctgatgctgatatcgttgatggtgatgctaagacctttgaacttggcggcaagaaagttcgtattggtcaagttaacaccgttgatttagatgatgtttttgctcgtcaagctgatcttgaaagtcaaatgcaaagtatgatggatgataacaattatgatttattcttattaatcgctactaacatcttaaacagtgactcagagttattagttattggtgatcctgctgaaaaggttgaagcagcctttggtaagaagcttaacgaaaacaagcggatgaatttaccgggtgttgtatcacggaagaagcaagttgttcctcctttgactgatgcattcgaaggttaataaataaattaatttaaaaaactgagaaagattttgcgatttttctcagtttttttgagctttaaatttcaaagcttattcttaattagttaaaatataagtacagattttaagaaatggggttgatattaatgaatatcacatttactgatcaagctatcgaacgtttacagcgttatgaactgtcatctaagaagatactcctagattttgatgatggggttggtccattttctgccgttgggggttgcagtttagatggtgattatcgactaatccttgtcaaagaggatttagatacccccgattataatgaaaagattacctctaatttaggggatgtttttattaaagaccatacagcagttcaatttgatgatgaaatggaagtaaggtttaacccgcgttactttacaatgccacttgtcagtcctaaacgcgttttaacagataatcttgaagttctggatcttagtaatacagacttaaattctcaaattgatcgagcacacgattgctagcaatataataagggagcgtgatagaagccagatacgacttcatgatcatgctcccttattgtttttaaagaataatcctgaagataaaagtgataataattgcaaaaattccaataatcgttgcataggaaaaatgtttacgttgagctggtttaattaatgcttgtctccccatgaagattgtgaataaagcccataaaaaagtagcaataagtaaaatatacaatttccagttgattgggagatgatggtaaaaatcgccataaaataccattatgccgataaacatcacaatagcataggcatagttatcgcggtgaaagttaaaattaaaaagataagcaaacgcgcaaaataataaaatgctaataatatcgttaaaaatcataccctctacacacttccttatgtagtcattaacaggataaagataaaatattaagaagcaatcgcaaataatatgatatgatgatcttgttagaattaacgaaggcggtgcttacagtgaagaaaaaagctatgcgacgagaaataaaactattaactgaagaaaatcaacaattacggcgatataccttgctagcatcaatcggaattttattaagtatgatgattgggttagttcgaatggttcagaaaaattagttcaggaaattttttagaggaaagtatagtggagttacaataccgcaaagcgacacttgaagatttacccaaaattgttgaaatttataatcaaattattccatcacggttagcgactgcagatctcaccccgataacggttgacgaacgcaaagaatggtttgaagcatttgacgaaaatcatccaatctgggtaattgaacatcaaaatgaggttctcgggtgggtggcccttgaacatttttatggtcgtccagcatataatcatactagtgaaattgctatttaccttgatcaacggttgcggaaacaaggagttggtacaaaaaccatggaattcattattggtcaattgcctaatttagcagttaatacaatcgtggcttatatttttggccataatattccaagcctaaagttatttaaatcgtttggttttactcaatggggccttttaccacaagtagcagagcttgatgggattaaacgtgatttagttattttaggccgccattttaaatgattattatgtaaaagagtgtgataaaagttcagtcacatttcgaaataggcccccaacgcccggtaaagccgaacgctggaggcctatgttgcatataggggcttcatgttgaaaacgaaagtgcccgtgatacttggctcgttcccttattttgtatctttttctacttcttctcttgttttaacatcattgatatgtagctcaaacttaactaaattcaagccagtcattttattgattgcgtgttgtacctcagaacaaactgccttaaaaatttctggagcgcttttgccatattcgatggtagcttccatttttaatgcgacttgcttttcaccaacatcggcattaatacccttggttggattgcttccggaagttactttatctgctaattcactaaacatatttccatcaagggaaaggattccaggaactttgctagcggtgatcccagcgattttttcaattacttgatcatcgaatgttaattgctcatcaattgttttattatttgtagtggttgtcatattaattcctccttgaattagttggcaaatttatctaacatttttatcgcaagtttatttaatgaatagcctcttgcatcaagaacatagccaattccgcctaagatagtgacagctaacagaatgccaatcattgggaaaaagccccacataatccaactaatgctgataagcagtcctaagataacgccaattgtagcaagtttcatatagtacctcctttttagacaatgttgactgattctttgtttgagtagggacttagcttaatgtgtaatttattaagatcaatgtcgaagtcccgtttaaggttttctttaattgtctggagtagtactgtatgaattagttttggattggtcctcttagagagcattccatgaacggtgacgtctgcgttgtgattgttacggtgcatcttgaggttaatcactgggttataaaggtcaaatttggcaattgaagtagttaagctgtgttcaactgcatgctgatcaatttgaactttattagcgccatctctagcgattgtcatttgtttagttgttgtgggacgaaaaacagcaattgctattacggttaaagcaacaatgattaaaaatactgcgactcctgctgaaaaactttgaccgatggggctataaagccaatcattaactggaattgtccaagtttggtcacgataaaaccataatgatacgacaacaattccaacgattacttgaagcatcattacaaatgaaacccaccattttttccatgcggccattagtaccacttcctttctataaataattttttagtacaagctaatagtaacatgtttggaagcgttttacattactttttgaaatgctaaaggtaatattaagaacctgttaacagaatagtcataattaaaaaatcgatctcacatcggaaaatgattgtaagatcgattttttgattctttaattgttttggcgttcttgtagtttagcgatttcagaataagccggagcaagcatatcttcaatttgttggaagagtggagtatagcgttgatatacttttactgcggctggatctggttggtaagaactaaccttaccaatgaacttctgtggtgtatcaagactgtcgatcattcccaggctttgcatagccataactactgacccgaggcagccagattcaaatgagtcaggaacgttaaccggacagtttaagatatcagcaagcatttggcgccatacttttgagcgagcaaagccacctgttgcagtaacgctcgctggttcaccgactaacgctcgtactgcttggaagactgttgcaatgttcatgctaattccttccataactgctcgtagcatatcagcccgtgtatggatatgagaaagcccaaagaaactaccacgcgctttagcattccacaatggtgcccgttcaccgcccaggaagggatgaaagagaagcccatgcgcgcctgctggtactccttcaataacgtgatttgccaaagtataaggatcgacctgttcgtttttaactgcgctactatcgacaaggtgttttactgcccattcatagacatcgccaccgttattaagcggaccaccaacgacccacaatcctttattaatagcatagcagaagaggcggcgttctggatcaataacaggatgatcagttacgactcgtacagctgcggaagtaccgattgtaattgctactgtattttgcttggttgcaccaacaccaatatttgaaagggcaccatcgtaagcaccataaacaaatggcgtatcagctggtactcctagtttttcttgggcttcgggcactaaaccagttgcttgagttgttccatcgacaatttcaggcagttgatctttggttattcctgcaacccgaagagcctggtcatcccaatcacaagttttaaggttcatcaagccagttgaggaagcgattgacatatcaaccttaaattcattaaataaccggtagaaaaggtaagccttaatatcagcaaaatatgctgtgcggttaaataaatcaggttcgtcttcccttaaccaaaggagctttgtcaaggttgacatagggtgaacaggaacccccgtcttcatatataattgttgtccttcagtcatcatcttaaggttgtctgctgcgcgctgagctcgactatctgcccaagtgattaaccgtgaaagaggcttcttatttttatctaataagaggaggctttgatttgcacttgaaattgagactgctagtagtttccccgtactgagatcagctgccgtagccacatcatggatagcttgttcagcagcattgattacttcttctggctcttgttctgccattcccgcggcattgcggtgcaactcgtagccatagttagcttgtgtgatcacctgcgcatcttgaccatataaaacggcctttgtgctagaggttccaacgtcaacaccaattaagtagttcatttattgttctcctttaaaactcaatttaattctctttgtaatattatatgctaaagtgactggtgtgcaatgatttcaactggtaaaagggtagtggaactgatggtactttgttggttaatctgtgttaaaagcttattagctgctaagctacccattaactccatatcttgcttcaacagaaagattccattagcgacatattgcgaccattcccaatcatcaaagctaactaagccaagatcgtcagggaaggaaaggtttagttccttaaaaatcgctaaaagatcaaataaaatgggccccattaatgaaacgacagcagttttgcctttgagttcatttaactgttgcaaaaacattttagcaagccactgccgatcatgtccccgagtttcaatattgtgatagcttagcccattatcagcagcagcaacctttaaaccggcaattcgagggatttgacccgatgcctccgcaaaatgcgcgctgacagttaaaatattctgataaccattttgataaagaatcttaccgaggttataacaagcatcacgattagcagaagtgaccttcccaactgtagaaggctggtcatcaacttcacggtcaacaatcacgaggggaatatcattgtgaatagtaggggcaaattgactaaagtggcgggaattaggctggacaataattccgtcaactcgttgctgatatagacgctgaagagcacgactttcattttcccgcgagttattcgtattcatgaggaggatatcatagcccgcttgttgcaaaacatcatcgatccctttggcaagtaaagatgaaaaggggttagaaatatctccaacgaggattccaacaacgtgactatgagtttggcgaagctgtcgtgcagaagcggttggaacaaattgaaggtctttaattgctttttccacccgtttccgcgttgctgggcgcattttatcataacgaccattaataatacgtgaaacggtagtcgctgaaacaccagctgctttagcaacgtcagcgatagtagtatgttgcgtcatttgtttattcatcatccttaatagttctactattattaagaataccaaaccatacaaaaagcgtcactagctaattcactaggacgcttaaattgacttagacaaataatgaaatggcgtagacggctcccaacccagcgagtgctaagacggaagttaaagttgtccacgaaagtaaagtttcctttaatgaaaggccaaagtattctttgatcatccagaaaccggcatcattaacgtgtccacaaaagacagaaccagcaccgatggaaagaaccatcaatgttgccataattgagttaccgccaaattggtgagccattggaaccacaaggccggcagcggtcatcgcagcaactgttgaggatccaagtgacatccgtaataaagcagtaattaaccaagcagctagaattggtgaaatgttagtttgagcgaataaaccagaaatatattttgaaattccaccatcaacaaggacttgcttgaaggcaccaccaccaccgatgatcaaaagcattacagaaatttgcttgattgagtcggcaagggcggttgaaatttcttccattttcttgtttcgccataatcccattgtaaagattgcgaagattaatgaaagaagcattgcaaggtcaggagcaccaataaattgaatgaattcattaactggattgttcttagggaaaataaatgaacaaatagtagcgacagcaattaagataactggcatcattgcagttaaaacggagataccgaatttaggcgtttcttcaagcttgaattctttatattcgccaagaactgaaatatcaatatttttacggtaaacacgcggataaactttttgtaatacccagttataaactggaccagcaataatgattgttgggattgcagctaaaataccaagcagcaagacgtgtccaaggtttgcaccaagaatgtccgtgatagcagttggagcaggatgtggtggtaagaaagcgtgggtaacgtttaaggttgctgccattggaataccaagatacatcaatggcatatcaagctcgtgggcgataataaagataattggtaaaacaacgacaagcccaacttcaaagaataatgctaacccaatgataaaggaggcaaggataacagcaacttggatccaacgccgaccaaacttattaatcaatgttgttgcaattcgatatccaccaccggcatcagaaactaatttaccaagcattgacccgaaaccaaagataatagctaagtgtcctaattggcccccgatcccggtttcaattgtctgcggaatttttgtaagtggaaggccgagtaacaaaccaacgatgaatgatgtgattactaaaccaacgaaagtgttcatctttagtttaacaatcatgaaaattaagataataaccccgattaaaacaataagtaaaggcataataataaccccctaatgagtagtagattgttgttgtaatttagcgatggtcgaataggctggtgttaataatccttcgacctgcttaaaaagtggtaagtaattttgataaacattaaccgcatcttgatttggctgataagaactgatatcaccaactaatgttttaatgatttcatagttttcaatcattcctaaactcttcattgccatggtgattgcaccgagacaaccagattcaaatgagttcgggatattgaccggacagttcaagacatctgctaacatttgccgccaaacttcagctcgcgcaaaaccgccagttgcagttacgcttgcaggattaccaacaagatcacgaaccgcttggaaaacagttgcaatattcatacaaattccttccattactgagcgcagcatatcggcacgagtatgaatgtgggaaagtccaaagaaactaccgcgcgcattagcgtcccataatggtgcccgttcaccgccaaggaatgggtggaagagcaaaccgtgagctccggcgggaacaccttcaataactcggttagcaagagtgtagggatcaatattttcatttttaactgcactagcgtcaactaagtgttcaacggcccactgatagacatcgccaccattattaagcggaccgccgatgacccataaacctttatccacggcgtaacagaagagtcgttgctgaggatcgatcactggatggtcagttactacccgaacaccagccgaagttccaatcgtaatggcaacagtattttgcttaattgcccccacacctaaattagataaagcaccgtcaaaggcaccatagacaaatggcgtgtcagcggggatacccatttttgcttgcgccgctgctgttaggccaatcgcttgggttgttccgttcacgatttctggtaattgggaacagtcgacgttagcgagttccaatgcttgatcgtcccagtcacacgtattgacattcatcattccggtacatgaagcgatggaaacatcaaccttaaatgtattgaaaaactggtggaagaggtaggatttgatatcgccaaaatatgcagtttgagcaaccttatctgcttgtgtcttattgagccacataatcttggtcaatggggacattggatgaataggtgtacctgttttagcatagatttgctgaccagcaggactattctttaattcgttggcgacatcacgtgcacgggtatcagcccaagtgatgacccgtgaaaggggattgaaattcttgtcgagcataatcacactttggttagcactagaaaatgataccgctaacaattttccatttgttaaatctgctttttgtgctgcatcatgaataactttttcgactgcttcgacaattgcagttgggttttgttcagccattccactagcatcgcggtaaagggaataaccttggctaaattgatctaacacagttgcattttggtcatatagaactgcctttgtagaagtagttccaacatcaacaccgataaaataattcattgtagtaattctccctttatttatttgaaaacgctttagtttatcgttacacctaataatataatattagatgtaagcgatgtcaatagcttatttaatataagtttatcgatttcctaaaattaaaaataaaaagtaattgcatatgaatctcaaggtgtgatactattagttgcttaatttgttatggtttagctataagcaacgattttaaggagggattacaatgaaaatccggaaagcaacaatggcagatttagatgtagtagtagatattttacgtgatggacgtaaccagttagctgagcggggcgttgaccaatggcagggggattatccgaacgttacccatgtaaaagaagatattgagaatggttatgcttatctcgttaaagcagatgatggacaaacagttggcacgttagcaattgttgaagcaccggatcatttttatgacaaactcaacggggaatggctaattaatactgaaaattatgttgtaatccaccgcgtagctattcattcacgacacgcaggaaaaggatatgcatccaaattatttttgagtttgattgagtatttggagaccgagcgtccagaaatcaaatcaattcgtttaagcacaaatgaaaataatatggcaatgcaacggatcgcaactaagagcggctttaaaaaagtggggaccctccatggcgcctttcgtccaagtgagttgtcttatgtttatgaactgttaacaaaagtgcgtgtagcataaaaaaggggaaggcgttaagcttgtaacaccttcctctttacttttattatttttcattaattttcttagcatattcgcgagcgttgtaaagttcgtagactacccatgtttcaataagggtaatgacacagatgagaatagcggtatacacgtctggtaaaacaaacagtaagagtaagaagatccatgaaatccatgaccactgagtttcaattgtgacgattcgctgaactcgtttagtaggttcaatacggccagattgattaaaaatggttcgaatttggtaaaaataacgaacttcaaaaatactttcgataataaaaattgccgttaagatgattaataaaatgttcatcataaataagagtcccttatctttcaatttatttctaattttagaactcttgggcaagagaagcaatttagatagtaaaaaaataggtccctatcaaagattgagtgataggaacctatttttaattctacatatcaagaaattaaacgttcattgttttaccatattcattattaatggtatcaacaacgtccttggcatgcatatcatcttcaacaactgtttcaccatcacgaagagtgtactttacactttcgtccaagttatcaaagtctacatcattaccatctgcatctacaaaattgaacttcgaatcttggaagttcttaagagcatctgcattaatttccatgattatgcttcctttcgccattatagtaacacttaattaacgaaaattacagggttagggtaaaaatattattatattttacaggaggacatttattttctaaattaacttattcgtgttttcgctcatttttttgataaacagttttgactaatcctgtacataatttataatatgagtaggaagagaattcttggattgaataggaggaaatagatatgtcattgatgcaaaatacctcagaaattaacaagactgataagcaggtgtacttaatcactttattgcggaagagtacaaacatgccacaatacattgaccacatgatttatgaaactgcagaaggtggtcaagaatttatggcgcgcttagtcgaagctttttcacgggcaggttaccgggaaaagaagcttagtgacgataagtacaacctcgataacggacttgataagatcactttgcggggttcataccaacctatttacaagggataattaaaattgactaaattaaaagagctgatgctgcattttgaggcaccagctcttttaatttaattattgtttcgtaatgatagaaccttaacatcgttgtcgtagttagcgctccaccaaccttgtttattgacgtaaccagttggcaagcagagaatcactaagaagattatatcaatgactgaggaaatagtttccatcactgcactgtcgttacttgtaaaaataagggaaagtaaccagaaaaccaatacggtccagccagtcaaaccggtatcgcgaacccgccggacacagatagcaattccgggaataataatagcaatagcgaatactgcaataacgaagagcaagaaaattaagaatccaacgccacgattatagccattcataatcgaagtgacagaagcaaaaccagcgattgctagtaagaaatataaaataacaaaaatgatgaaattaactaatactggccaccaaaaatccgcccgcgttgaagtagcccggtacttaaaggcgttttcccagtagtatttgtaagcttcaaacatacaattctcctcctttgataggtttgctttgattatagcattttggggggatgtagattgacttatgatttggggaggataaaaaatccctagccttggtaattttttatcagggttagggaattactattttatattgaaaactaaattagataaattgaactccaccgtcaatttggacagcttgaccagtcatgtagtcagatttgtctgaagcgaggtaggagacaaagttagcgacgtctgatggatgttcaacacgaccaagagcaattccgtcaatagcggcctttaagtattgacctttttcaccaccattttcttcaaccatcttttcgtcgataaagtcccacatatcggtacccacaatacctgggcaataggcattaaccgtaatattaaatttagctaattccttagcagctacttgtgttaatccacgaatagcaaatttagttgaagagtatgctcctaattgttcataaccaatgtgtccagcgatacttgaagcattgatgattttacggattttatctccatcatcttgcttcctgaattgttcagcagcagcttgaatcccaaacagaacactatcaacattagtagcgtaaattttatgaaattcttcggctgattcgtctaggagattaccaatttgtgcaattccggcattgttaatgtaagtgtcaaggcgtccaaagttatccacagcagcttttacaagcatttcatgagtttccttttttgaaacgtcaccaggagctgccacaaccttatatcctttgtcagctaattctttggttgtcttgtctgtttcttctttatgataaccattaatgaccattgcatagccatcttttcctagttgttccgcaatgccctttccgataccacgactactaccagtaataacagcaactttttgttcagtcataataaaatctcctttaagtataaccttaatttctaacaacaagttaattattgcataaattaaaaataaaaggatacttttttgctaaaacttagtaaaatgcttaaatgtttttacttacgttgcataggagtgttaatttttcttataatgttaaagaatataaagttaaagtgggttattaaatgactatttggaagagcgaattagcatttgaaaatgaattaattaaccatcttagtaatttaggtggaactaagcaatgggaatacttaccacagattaaaacaacagatcaattgtgggacaactttaagcgtattcttgagcaacataatcaagaccgcctagagaaaccgttatcgccaaccgaatttaatcaagtgaaggcgatagtcaataaattaaatactccctatgaagctgggcagtttctatacgggactaatggaatatcgcaaattgaaattgatcgtgatgatggtaaacatgtatatttaacagtttttgaccaggatcaaataggcgctgggaatactgtttatcaaattgttaatcagattgagcgtccagcagtaattccaggacggaagaatcgtcgttttgatgtaacaatgttaataaatggtttaccgattatccaaattgaggaaaaagctgatggtcgggatgctaaagaagcgttaaaccaaatgcatcaatatatcgaagaagaccaatattctgatatttttggcactcttcaaattctagttgccttaacaccacatgatgcacgttacatggctaatacgacagctgacaagtttaataccgattttgcttttcaatggcaacgagcaaaggataataaaccagtgctagatgcaatgcaatttgcggatctaatgttatcgattccgatggcccatcaaatggcaacaaattatatgattttggatggaacaccccgtcatcaaatgataaagattatgcgtccatatcaagtttatgcaacaaaacgggtcattaacaaaattcgtgagcatacgtttgggattgatgatcaacgaatcggatatgtttggcatacaactggatctggtaaaaccatcagttcatttaaggctgcctggcttgcatcacgattacctaatgttgataaagttgtatttatggttgatcgagtggccttaactaaccaaacagttgatgaatatatggcgtatgatcctgaaaatactgaaggaagtaatgggggagtagttactgatactgctaatcggtgggcattagctaataaattgaagcgtaaaggaaacggaattattgtaacttctactcaaaagatggatgcaatggttcgaagcaatgacttcaagcctgttgataagaatcttgtctttattgttgatgaggctcaccgctcaacttctggagaaatgctgcaaagaattcggaaagtttttcctaaatcggcctgggttggttatactgggactcctgtctttccagaagaaaatggtaagtctaaaacgccgacaactcgtgatatctttggggatgttattcatacttatacaattcaagatgccattaaagatggtaatgttcttggattcaaggtggattttgagacaacattaactgaaaaagtactgagagaacaatatctgccagagtattttaaggctcgctatcctaagatgacagatgaggaaatccaagaacgaatcgccaacatgaatgaaaacgacatggacgataaggttgagccaagtgtctatgatgaaaatcataaacatgttgagttggtcgttgaggatatcttgaaaaattggaataaacgctctgttaatagtaagtacaatgcaattcttactactcatgttggtggcgggaaagcatcaactccaatggcgatggagtattataacgaatttaagaagcaaaatgcgaaaagggaacatccattacgaattggaattacctttagtcaagatacgtccaatggtgataatcagctagagacaaatgattctttgcgtaacgcaatgcaagactacaatgaaatgtttggtactagctttaatgataagcaggttaaagaatatacagaacaagtagtttcgcgattgaatcggacaattgatgatggcaaatactttgatcttgtgatcgttgttgaccaattattaacgggctttaatgcaccacaattaaatactctttatgtagatcggacattaaagggtgcagctttaatccaagcatattcgcgaacaaaccgggttcaggatatgcaaactaagccattcggccgaattgtaaattaccgatggcctaaacacacggaaaagttaatgaaaagtgcattggcaaaatatgcaaaccgcaactccgctaacattcaagaagaactttttaacgatgaaggtaaaaacgatggtgttattgccccttcctatggtgaagttaagaaagagttgcataaggtagtaaacaggttagctggtttttcagaagattttactgatatcccagcaagcgaaaatgcacaagaacaaatgtacaaagacttacgccaatataaccatttgatggcaattgccaaacaagacgataaatatgacgatacacatcctgaaaaattattaacttcattggggatgagcttggatgatgaagaaatcttaacaaccactttagcaaatcggctaaaaacaaaaattgctaaaaggcatcatattgatttctcgcaagttgacctccaaatggaacacgttaaagaagtgaaggtcaattgggattaccttgagggattgattgttgaagtgatgaataagtatcacgataacgacattgagggcgctaaaaaatccgctgaagaagtaaagattatttctgataaattagaagatcggggatatgcggccaaaattctaagatttattaaggatctcttcaaaggaaaggttaaatttgaataccctgtgcaacaaaagcacgttaaaaagttaattgcccaaaataatgaagggcaacaacgttctgccatttttgagtataagaaaaagtggggactagctgatattgaagattcacatttaataaatgaaatcttagataagcatgtcattggcgccgatgacctaaacggaaatggagagctcgacaacatcgtcatggaaggccaagcagtatacaagactgatgctgaagctgaagaaatacgaaatatgaatagatttaaatatagaaggatacttcgtgaaaatataactgaatttgctgatgaactaaagaaaaaatattaggagttttttaattgagtactacaagagaaattgagagtcagatttgggaaatggcgaatcgcttaagaagtaatatggatgctggtgaatatagaaattacattttaggtttcgtattctaccgttatctatcagaaaatcaggaagaatatttattaaaaggtaaagtagtatttcctgaaaataaccaaagtgtaaatgatgcatatttgggtataccagaagaagaactagttgacgcattacctgaaattgcaggggcattaggttatgcaattgcccctaaatatacttgggcatcaattgtcgatagagtcaataacaatacaattgcaccgtcagactatcaagatatgttagataattttaatcataatttgaatcttaatcataatgctaaaatggatttccatggaatttttgatgatatgaatcttggaaattctcgcctaggtaatactactgctgctagagctaaagcattaacagatattgttaacttgatagatcaaattgaatataaagatgaaaacggcaaagatatcctcgctgatatttatacttatttaattcagcagtttgccacaaactcaggaaaaaaggctggtgagttctataccccacaccaagtttcagaaatattagctaaattggtagctttagatttagactcaaagattcagaatccagaagtatatgactttgcatgtggatcaggctctctcttactgacggttcaagatcaagttcctggtaagaagttaaaatatgctggtcaagaactaaacacgacaacttataatttagcgcggatgaatttaatgatgcacgatgttcgttaccaaaacatgacgctaaaaaatgcagatacgcttgaaatggattggcctgatggagtagacgaacatggggtagatcatccacatagttttgacatggttgtggctaatccgccttactctgcacgatgggataacaatgataataagctaaaagatcctcgttttaaggagtatggagcattggcaccgaagacaaaagcggactatgcctttcttttgcatggcctatatcacttaaaacaagatggaacgatggcaattgttttgccacacggggttctattccgtggtgctaaggaagctcagattcggaaagctttattagagaaaaatcagattgatgcaattattgggttgccagcaaatttattctattcaactggaattccgacagttgtacttgtcttaaagaagaataaagaaaataaagatgtattgtttattgacgcaagcaaaaactttgaaaagggtaagaaccaaaacgtcttacgaaaagaagatattgataagataattgatacatataaggaaagaaaagacgttgataagtatgctcatgtggcaacgatcgatgaaattaaagaaaacgactataaccttaatattccgcgatatgttgacacatttgaacccgaaccaccagttgatcttgggaagttaacaaaagaaatggaagagactcaaaaagagattgaacagacccaaggtgagcttttggggatgatgaaagagctaacttcaaaagacgagaagacccaaaaagacttaaacgaatttatcaaaatgttagaaaacgaggtaaagcgtaatggataaaaagcccgaaaaattggtgcctgaagtccgttttaaaggatttactgatgattgggagcagcgtaagttgggggaggctcttactgggtttgaatatggtcttaatacacctgcaactgactacgatggtataaataagtatttgcgtattactgacattgacgatgtatctcataaattcgatatatcacatttaacttctcctaaattaaaagatgataattatcttttagccaatggtgatattctatttgcacgaactggtgctagtgttggtaaaagttacaggtacagtaatatcgacggtaaagtgtactatgctggttttttaatcaaagctcacattaaagaccacttttctactaattttatttttgatacaacacttctacctcgatatcattattttgttcaagtaacttctatgagatctgggcagcctggaatcaatgcaaaagaatatcaaaaatatataatttataccccctcggagaacgaacaaaacaagattagcgatttaatactaactattcaaaaattaattgatctccagcaacgaaaattggaacaattaaggcaacttaagattttttcattacagcgaatgtttattgataaagattgtaaacaaccaattttaaggtttaaaaactttaatgataattggttgcctcataaatttaatgatatagcaaatactttttctggaggaactccggctatttctaataaggattactatggcggtaacatcccattcattagatctgcagaaattaataaaaataccactcagctacatttaacaccagatggattaaaaaattcatctgctaaatttataaaaaaagggacacttttatatgctctttatggagcaactagtggagaggttggaatagctcaaattgatggagctattaatcaagctgtaatggcaattaacttaaaaaaagacaacgtgtattttataaaaacttggttaattaagaacaaaagaaaaattatttcaacctatcttcaagggggacaagggaacttatctgctaaaatagtaaaacatttgaagttaagtttacctaaaattgaagaagaaaacctaataagcattacgataatgaaaattgatagtttgattaaactccagcaatctaaaatcgatcaattaactattcttaaaaaatatcttcttcaaaagctctttatctaatttattgcatgaagcgtaacctccaataaataatacatttgtgtttttgacactagattatttattggaggttttattatgtctcggaaacactacagtacaaagctattttataaatactatatggattggattaaactttataaggaaaaagcagttcgaaaagtaacgttggataaatattatttaacgcatagaaaaattaaagaacttgcaccagagttacatatgaatgaacttactcgccaatcatatcaaaaattgttaaataactatgctgctactcatgaaaaacaaactactcttgattttcatcatcacctaaaagcagccttagttgatgcactagacgaaggattactggaacatgaccctacacggcgagcaattataaagggagttgatcctagcaataaaaagaataaatttttgaacctttatgaattgcaaaaactactccgccatcttgatctaggtgacgaattaaactgggattggtttattttattagtatcaaagactggcttacgatttgcggaagcgttagccttaactccagaagattttgattttgaaaggcagcaaattatcgttaataaatcttggaattataaaacgccaattggtaattttcaaaaaactaagaatgaatcttcaaatcgtgttgtgatggtcgattggcaccttatgaatcaatttaagtcacttattcgaaataaagaaagtgactggccaatttttgtgccacacaataaaagagtatttaactcgactgttaatggcttgttagaaaaatattgctataaattagatataccaactatttctgttcatggtttacgccatacccatgcctcattattactttatgaaggagtgtcagttgctagtgttgctaagagactgggccatgccaacactacaacgacccaagaaacctatattcatattattgaggaactcgaaaataaagataataataaagtcttacatcatctatctcaactgaactaaacaaaaagcggtaccagtaaactaaatgctgataccactttttttagatgaaaagcttttgtaaaagatactttttcaaggcgattagttgagtatgtttgttttgttggagactgattagtgcttgaatctgtgaaaaaagattagctattttttgttgttcatcaaataatggatagttttctttgaattcttcaatatctttttttgataggtttgtttgacctacaccatcatcgaacttcaaaaagtatcgattcctgttcattaatacatatagaaaatagctatttatatcggaactaggagaaattcctgcaattctctgatttaaactgtatttattatcactatctatcaagtaggcctttgctagagcttttccgttcggtacatcagataaaacaaaagcgatctcacctttttttaagagttcgattggctcatttgaaaatttctttactttaccatttgttgaaatgaattttgaatttacaacagtatagattccattcatatcaatatattgctcatgagcttttccgtttctataatttgcaatatcacttaatttgcgctcttcccaatcaccattaaagtttttaaatcttaaaattggatgtttactatttttttcaacaaataattgttgtaacagcgccttttttagctgtttaagttgttccaattttcgttgctggagatcaattaatttttgaatagttagtattaaatcgctaatcttgttttgttcgttctccgagggggtataaattatatatttttgatattcttttgcattgattccaggctgcccagatctcatagaagttacttgaacaaaataatgatatcgaggtagaagtgttgtatcaaaaataaaattagtagaaaagtggtctttaatgtgagctttgattaaaaaaccagcatagtacactttaccgtcgatattactgtacctgtaacttttaccaacactagcaccagttcgtgcaaatagaatatcaccattggctaaaagataattatcatcttttaatttaggagaagttaaatgtgatatatcgaatttatgagatacatcgtcaatgtcagtaatacgcaaatacttatttataccatcgtagtcagttgcaggtgtattaagaccatattcaaacccagtaagagtctcccccaacttacgctgctcccatttaacattaatacatacttttataaaaattattgataatactgagaaatagctggtaaaaagttacgatataataagtatttagaatatatatttaatgggtgaaatcatggcagaatataagagaagatcagtagaaaaagcaattattatggcattaagagatttgggtgggtcagcaagccgaaaatctatttggaaagcaattgcagataatgaatatgatggattaacttatgatcaagtctattcaactaaagaaggtaaaacgggcacttattcaccattcttgtttgactttaactttggtattcgaaatttgcgcagtattcaatatattgaagctcctcatcgtaatcaggatattgttcttactaaggccggagagaacgatgatttaacaaattatccttcgttagaacagaaaaaagaaattggtgcttattgggataagaaaaataaggaacgtgctgaacgtaataaaaataaagtaagtgaagaaagcggagacgaatcaacaggaccagaagaccaagaggatactaaagatttaaactggaaaaaccaattgattactcaattaatgaagtttgatcctagtaaatttgaaagtttttcgcgcttattgatttcaaaaatgggtgttgtaattgataaagatcgcggaattgttcgttccggtgaccatggaatcgatggctttggatattttacatctgatgaattcagaactagtcgggtagcgattcaatgtaaaaggtacacaaaaggagcagtatcagaacctgaaatcgataagtttaaaggagtaatggatagttttaatgctgaatatgggatatttatcacaactaatcatttcacagatcgtgctcgaaaaaaggcaacccaaggaaataatactgtaacattaattgacgggcagacactagctgaattggttgaaaaatatcaattacatattacgccagttaatacgtatgctttggatgattattacttcgatttgaagtgaattttaggagctgaaaatgattgactatacaacgttaaaacatcaagccgatggtactccgacttgggatgcatttttaggagttattttaaaagttgccgttgaaagacagaattggcaaagcagtgaattgatacaaagaactttagaagaagctaatttaccgcaaagcatgttgcaaatgcgttatgttaacaccggttctaaaatgtaggaaaacaccgatttgaaaatgtcgattttcctacaattttttatactaattgcattaaatcttttgaggtgatttgatgcgactagaattacaagaggagttaatattttacaaaatggcaaaaattaaacctaattatgcggccctaggccgtcaatataattgcgaccctaggacaattaagcggtatttaaataatccacaagccggtaaacgacaaactaacaagcgttgcccaagtaagttggacccataccgtgatgttatcaaggataaatacaaaacctgttctgcaacagccattttctatttcattaaagaattaggctacgaaggcggaatttcaattttgcgtgattactgtcaccagttgaaaaaagcacaataccagcagccagtgattagagttgaaactgcacctggtgatgtaagtcaggttgattggaaagaagacttagtcttatataccagagaaaaccgccccattactttttcactatttctgtatgtattgggttattcacgcaaaaaattcttaaagttagtttttgaccgtaaacaagacacactatttcaatgtttgattgaggcttttcaaaatactggcggtgttcctcaaagaatttatttcgataatatgaaaacggcggttgatcacgccaagagtagctatcgaaaagttatttggaattcacgcttattgaatttctctaaagccgcaggctttattccccaagcctgtcggcccttccgtccccaaaccaaaggaaaagtcgaagccttagcgagaaccgtagaccgtattaaagtttataatcacgaatttcaggatgagaaggcgttaaaaaatatcgtgaagcagcttgaaacacagctcaatcacgaaataagctaagcaactgatcaaagaccagaagatttatggataaaagaaaaagaatatttacagccatacaatccaatccttttgaattcattagttgatcacgatctaacccgcaaagttagtaatgaatcgatgatcacctatctaggcaataaatattctgtacctgtaaagtatatcgggcaaacagttaacgtcaaggttacagaccaaaaattaatgatttatcatgcctcacgattggttcgacaacattacctgagtaataaaaaactaaattatcatcgcgatgatatgaaggaaatccttgggacaactatttttcatgacttagatgacgataaattggcagaacaggtagaaataaatttacgcatgtttgatcaattatagtggaggaatgacggatgactatctatacacaattagaagacaatttagaaaagctcaagctgactgcaatcaaagaatatttgccaaattacttgaataataatgatttatcattagcagaagctctagaacagctaactgcaaaagaaatcacatatcgaactgaacgatcagctaaaatgtccattcatattgcacactttccttacgacaaaggcttgaatgattttgactttaactttcaaccttcggttgataaaaaccgtatcatgaacttaaaatcgatgaattttgtttcgttagcacaaaatatcttattcatcgggtcttcaggagttggcaaaacgcacttagcaactggattaggaatggaggcctgtaggaatcatctcagtacttattttgtcaattgtcatgaactaattgaacggctcaaacttgcccaccaagaaaatcgtcttgaggcaatattaaaaaactacagtcgttataagcttttgattattgatgaaataggctatctacctattgacgatttgggatcagatcttttcttccagttaatagctcgtcgatatgaaaagaaatcaacaatcattaccactaatattccactatccaagtggggtcaaacattctctaatccaacaattgcgaatgcgatcttagatcgcttagttcaccattctgaaatattcaaaattactggaaaatcatatcgaatgaaagactatcaagaacaacagacaacagaaacaaatcggtgaaaaactacatttttaaaccggtgaaatcctacattttaaaatcggtgttgacatgcgttatccacaaaagagtcatgatttggtcatgcgtaatcgagttagttttgctttaagtgatttagcaatttcaggtttattaaaccgacccaagagaggcctttatctcccgactcgtcgcgggcaagagcttagtaaagaatatggaattaatataacgagaactttgatccataatgagccagcttataagaaatacaaacaagaaaaaagtaatcaaaagaaaaatagacagaagcgagaaaataaagatttagctgaaagtcaagttaaggaatggtttaatcagcaagacgaaaaaacgcaggatgaattattaaatcacttggtaaaaatgaatccatataaatttgaaaacttaatggttcagttgttatctgtaatggggtacaagggtgatgaagggcaggctttagtaacacagaaatcaaatgatcatggaattgatggaattattaatcaagacccactaggtttgcaaaaagtttatcttcaagtaaaaagatatgcgccagataattcagttcaaatgccagaaattacagcatttagtggttcaattaagctcaagcatgcagatagaggtgtatttattacaacttctacatttactcaaggtgcaatcaacgcagcaaaggacttaaatattacactggttaacggcgagatgttaactaatttaatgattcagtatcaagttggagtagaagtaaaagaacattatatgacatataaaattgatggtaatatgttttaagatactaaatcttctttaaatctgaaatcgcttccttaaattatcgcccaaatgcgttataattaacttaactgatcaacaaagaggcgattaaatatgaagtgtccatgtcataacttgtcaaagaaccaaaagattgttttattaacacttgtcgcaggagccttaatttggccaatgtacttactatataagctggcaaagaagaactaatttttatccgaagaatcacttgcgagtggttctttttttcatgatataatttgaaagttaactaaaaaggaggcgagtcacatgttagatatcctagattacactaaacaagaattgatttctgatgccgatttttggcaattcgcgggtgagcatcttgaaaagccaaccgaatttaggggcgtttcatttgtttcttcaattaagtttattgaggagcaactattaccgcgctatgataaggtcactttgatcctcggcttaagcgacaatgggaaagaatcaattggcaaacggatgaggcagttaaatgaccggactgaatttgtcaattatggttatgaacaccctgatagtgaatttacgaagcgaattttagatggtagcttgcaacttttattcactaagcaagaattaattcataccaaaatgtacttaatgacaagtgacgaccggtatctttcatttgccggttcgatgaatttaaccgaagcagcaattcatcataatttagaacaacttgacagtgactatggaatgcagacggatccgctttatcaatgccatgtccagatgttcaacgataaccttcgccatgcgactacctatctggacgcaaagaaaatggccgggttcattaaggcgaaaaataaagagcagcttcagattaatgtctataccgatacggtgaatatggtgaaaaacaaggataccggtgacaaggatgcggtgattatcccggcagaagaagtaaaagaatataaggatcagtatagttctgacgaggaattaaagaaactatcagctccagaaaaattgagtgtcgcccaaactgtcaagctctttggtaatgctggctataagaaacgcaatctcgaaaatatagggaaagaactctacagccttacccaggtagttaaacatgtgtctcgaaacgatgataactcaggaaaggttacccgtgaagaagacctctaccctaaaccagtcttgttttataacaatggtcagttatttgaagcgccccgtgttggtgataatgtaaagtcagaattaataacatcgaatttaacgggtgaccggctccgtgaacagctgcaattatttagtgatattgcccatgagtacgataattacaaagaagtcggtgaggggtggcaggcatgtgatttcatgtgtttcctatttgaggcgccttggctatggaaaatccggaatatgtatgaattatcgccaagtagtaaatcgcgcgaagatgtaccccttggagtagccttgattggtcaaggacgaacagggaagtcgaccttgggaaagcggctagcagccaagctaacggggagtggcaatttccttgatggcggtgtttttgatgctaaaaattatgcattaggaaagtccaatatcaatatgactattacaaccgtcttaagcgattatatgtatagtgccgggcccgttaatccaatgatgattgatgatattagccccgacttaacaacacggccatattttgatcgcttcattaaagaaattactaacaatcgtagtttaactcagccactcccatcatttatttttacgatgaatcgtcgtgagggtgatagtaaatcgcaattttcccttaaaccggaaattatgcgtcgtttatggtacctcagctttgaatcaacttttgccggggatgaggatgaacgtgaagctaaattaaatgacttgcttgagcgcgctaacgatcagctttatcgttattgccaagttgaactcgcaaaattcttcaatgatgtgtcaccagagacagaacaaaagattgagaaggattacctttatcccatcaaatatgtcttgaaacaagcgatggaccaatttgggatgtttgagcttgttaaagactactttgatgataattatgattactcactctttgtcgggcgaaatgattggacaatgctgattaaccaggcggaagtgggtgctgatctaacgtttattcagcaggatggtcagttaaaagcgcaaattaataagcagctttttaataaggtttcagatagtacggcgcgaaataatggttcaatgatgatggaacggtacttccaatacttgccgcgaaagtatcggattagttatcaatatactagtaccggttttattgtcgatgttgctaattttgatcggtggcttaacagtgatacccttcagcaaaagtataatagcagcgaggtagctcgggacgctcaaaaggtaaatactgatgcaaaggtgactgaattgcttacccggttaacagaggcacaagaaaagcaagcgcaccgccatgggatatttagctggcttaaaaagaaataaggtgaacctatgaaacatatttggaaacttaacctatttcaaaagataattgtttggttatttataattgctttaattacctggcccatatatttttacgtaaaggcaaaatggggctaaaataagagtgtaggtagtgataggtttttgaacaaaggagtagattcttatgaagaaaaataaaactacacaacctaagaagcattcaaagaagaagtttactattttagcccttttagctggcgcgattgctttaccaatttatttagtaaagaaagcgtaaaattataacttatattgaaaaggatcacgattaggtggtccttttattatgtctttttaaattttattgatcgacattaaacagaataatgttcatttgttataattaatgtaaccgctatactaacaattcacaaagaaaggatgccgataacaaatgaccaaaaagataatccttgactgcgatcccggacatgatgatgcattggcgttaacgatggccattgcttcaccgaagattgatgtccttgccgtaacaacttctgctggtaaccaaacaccggacaaaaccttaaataatgcgatgcggatgttaactttactccatcgtgaagatattccagttgctcaggggaatcaaactccgctggttgagccgcttgaaactgcaccagaagttcatggtgagacgggtttagatggtgcggaccttcctgatcccgatttcaaagttcaaccaattccggctattgaattgatcgctaaaactcttcgtaaaagtgatgagaaagtcactctagttgtcaccggtccaatgacaaatgcagccttattcttgcgagtctatcccgacttggcaaaagaaaagattgatcaaattgtcttcatgggtggggcaatgggacttggcaattggcgaccatcagttgaatttaatatttttgttgatccagaagcagctaagattgtaatgaacttcggcctgcctctggtaatggcaccgttgaacgtgacccataaagcgcagattatgaaagatgagattgagcaaattgggcagatcgataatcctgtcgctcaagccttctacggtctcctaaacttctttgaacagtaccatgaaaatccaaaatggggttttaaaggtgcacccctccatgacccatgtacgattgcttggttgattgatcctactatgttcggtactgacaaaatgaatgtggatgttgaaactcagggcgatcttacacggggagagacggtttgtgactactatcagttaactgataagccccaaaatactaaagtcctccttgatattgatcgtgagaaattcatccaattgatcatggataccctgcaaagtttctcacagaaataaatttgctgtttacaaaaagaaagtgaagagttacactatatgtaaatttaacaatctaattttcttcggggcagggtgaaattcccaaccgacggtaacaagtacgcttggagtccgtgacccgttagcatttatgttaacggttgaaccagtgaaaatctggtaccgacagtatagtctggatgggagaagaaaactaaaaatgacacaatcagtttaaacgtaaagccccggatagcagtgatgttatccggttttatttttaccgagctgttttttaagttaactatttaacgtcccgagagaaatcttagggcgtttttattttggaaaggatggttagagtggaagatgtttatttcatgcaaatggcaatcgctgaagcagcaaaggctggcaatgaaacttggaaaaatcctcgcgttggggcagttgttgtgaaaaatggtcaagttttagcgcgaggtcatactcacgaatacggtggaattcacgctgaacgggatgcaataggtaaacttacgccgaaacagttacagggagcaactctttatgtcacgttggaaccctgcaatcactatgggaaacaaccaccatgtagtcaggcgattattgacgcgggtatcaggagggttgtgatcgcggaaacagacccgcaccagcttgtcaccgggaaagggattactacgcttcaacagcaaaatattactgtcaaaacgggcgtccttaaggaagcagcacaggtcttaaatccgcattacgatttcttctatcggtaccgacgaccatgggtaactttaaaacaagcagtgagtcttgactatcgcgtggccgcagaaaaaggtcaacgaacggcgattactaattctgctgtggcaaaaatggttcataccgagcgtggtaattttcaaggaatcttgattggaagccaaaccgcaattatcgataatccaactttattaacgactagtccgacaaagtttccgccagtaaggattgttcttgaccgccggggacgtttaaaagataatccaaccttacacttgttgactgaagggcaggcacctacttggatttttacggaaaatagttcgctacaagatcagtttgctaaaggcattcgggtgttttatcgccggacgtggtcaattaacgacatcttgcatgaacttggttgtcgagaaattcaatctgtttatgtggaagggggtccgactgtccatcaagcctttttacaggaaggcttatttgaagagcttattacatacgtagctccccacatgcttggcaaaaaaggtgttagcggcatggaactagcttgcccaatgaattttacccatcaggaaattaaaatcttagaaaataatattaggattgcggaaaggaagattgaaaatgtttagtggtttagttgcggaaacgggacgaatagtaaaaattacccaagatggcgaaacgattgaattggtggttgaacctcatagtgatgattttttaaccaccgtgcaacttggcgattcaattgcggtaaatgggacatgtttaacggtcgtagaaatcaacaacaatcaatttacgacgacattaatgtcacaaacctttgaaaagacaacgttcaaaaacttggaaaaagggtccctggtaaatcttgaacgttcattgcaaatcggcgcacggctagaaggtcatattgtaacggggcatgttgacgaactatcacgagttttaaagcggactgtcaatgaaaatgctattgaagtgcaatttagtcttccgcaacgcctgcatggtcaagtggtagcgcaaggaagtgtcgcgattaatggcgtaagtttaacagtgatggaaactggtgatgactggtttacggttgggctgattccgcacactcaactcgtgactaacttagatacgcttaaagtaggggatgaagttaatctagaaaccgatattttaggcaaatatgtagtcgcaaatttactaggaggccgaaaataatggatgtaaagaaaattcaagcaacgattaagcatttgcaagaagggggtttagcaattgtcatggatgatgcagaccgcgaagcagaaggcgatttggtggggcttgctagtgaagctactcccgaaaaggttaatttcatgactaagtatgcccgtggattgatgtgtgttcccatggcaccggaagtagctgaacgattgaaattacctcagatgactgctgataattcagatccttttggtacggcttttacgatcagcgttgaccatcattcgacaacaacgggaatttcagcttttgatcgttggcgcactattactcatcttgccgcaccgactgctaaaaacgaagacttctacaaaccaggtcatatctttcctttagttgcaaagaaaaatggagtattagaacgaaatggacatactgaagctgctgttgaccttgcgcgcttagctggggtggaaccagttgcttatatctgtgagattttaaaagacaatggtgaaatggcacgatcagttgaactccatgagaaagcagccgaatttagcttacccatcattacgatcaaagaacttcaggaataccggcaaagtctagcgagcaaaccagtagcagaggtgcacctcccgtctcagtatggtgactttcgcttacggtggtttgatggcaataatctagcgctaataaagggagatattgatccaactactcctgtaatggttcgcttgcattcagaatgctttactggcgatgttcttggttcccttcgctgtgattgtggtcctcaacttcatgaagcaatgcgccgaattgagaaaaacggcaacggggttattatttatttgcgtcaagaaggtcgtggaattggtttagcaaataagttgcgagcttactatttacaagagcacgactatgatactgtcgaagccaatgaaaaattaggttttgcgcctgatgaacggcagtatgaccaagcagttgcgattttacatcaattagggataaccaagattaacctacttactaataatcccgataaaattgcgcaattacaacttggcgatattgaaatcaatgaacggataccattagaaatcgcacctaataactacgatgagaattacttaatcacaaagaaaaataaatttcatcacttactgaatctggaggcttaatcatgaaagaatttactggaaaatttaatgttcaaagtgcaaaaatcgggattgttgttgctgattttaacgaaactgtcactaaacaattagtgcagggagctaccgaaatgttagctaagtttgaccttgaaaacgttgatgtataccatgtgccgggagcatttgaaattccgtttatgacaaaacaattattgacaaaaaaggaatatgacggcattttgacgttaggcgctattatcaaaggtgaaacagatcactacgatttaatttgtcaaaatgttgctggcggcgtaatgaatcttaacttaacgagcaatattccaattacatttggcatccttactaccgataacattgaacaggcaatgcaacgcgcgggactcaaagcgggtaatgaaggagcgatcactgcacaaagcttactagagatgatttcgttaaatcgacaaataaattaaaaataacctccattcttggataaatccttgaatggaggttatttgctaacgtttatttttcttaatcaaacgcttgatttcgtctagctcagcctttagttggcgattttcatgttgaattttgactaattgtgcagaaatcttccgttcgtcttttttggcaaagaactcagtaatcgtactggtaagcatcccaataaaaccaattcccaagagcatcaagacaatcgcggctgcccggccaattccggtcttaggaatcacatccccgtaaccaatcgtagtagcagttgtaattgcccaccacagggctgtttcgtaagagactttctccgagatgcaaaacattgcagcggctaccattataacagcaatcgtaatgtacaagtagtagagcaactcattgcgctcaaagaagacgcctaaacgaccggtaaatccgactaaacgcataatgcgcatgagtttaagcatctgaaaggttctaccaatttgtccaattcggaagagaaagaagaggctgctggcaggaatgattgatagaaggtcaaagatgttatctttaacaaattcgcgtttatttggtgaaataatcaggcggataacgtaatcagtaaagaaggccaaccaaatcccattgtcaatcatattgtaagggtaggcatcaatattgatccgcttagcataatatgcgatcagcattccaatcgagataacggctaagatagccataataatttggtagacaatataggtaaacttcttatgcacgattttttctcctgcccatagatttaattttatcttaagcgtctcttaaaagggatgcaagaattattctgctttacttgcgcttccgttcccatacgatcgtaatgattccggtaagaatggtccagcctaggccaatcaagctgagtaatacgcctaatttgattcctggcaactcatagctaaaggtaacatgatgagttccggcaggtaagtatactcctaggaaagcctggtttgttcgtaaggtagttgtctttttcccattaactttcactgaccaaccagtagaataaggaatcgaagaggtgaggacgccaggacgagtagttttaatcgttccctgaacttggttgcgtttgaatttaacgtcctctagacgatggcgttgcaatgttttaacttcacgataataattattatctagtttttctgctactacccggtatttgagcttataagttcccagctttgaaggctggaaggtgagtgaagttggcagtttgccatcataataaccaatattaagcgtcgaattagtaacgtgtttaaataaagaaagggtactttgccgcgcctgttcaatcgtagcagttccaaacttactgccgacattaagcttaaagctaatatcaggtgaaccatttaaaacgtggtaacgccaatagcgatagtgggtatagcgctgattaataacatttccgggattaaggaccgtttccttcagatgtgcttgctcataggcaatctgttctttcatggagaaaggagtgtacttaatcttagaaaattcaatatgcaactcgctgccctttaatttttgctgcatttttttactttgcagttctgataattgcaattgataagtttcttcactatcggtataggtcagcttagccgggttaaccttattcaagcggttagaaactaactcgcttttaaggggatagacatgcgtcttgagattagcggccttcattcctcgaagcttttcttgcttatcaaccagaacaccggtagctaaaacgcgttctttttcagttggtgagagtgattgataatcttttttactaatgtaattatcttgccagtaaagtaatgggaaagcatagttcgttttgtaccgcattgtttgcgtgggcacaaactcatctttgcttttgggattgcttggctgtccttcatcataattgatgactggatcagttgctttatctaaaaagtaaccagcgggaatctttgtcgcgttatcaccattgctttgaacaaagagatatttgacgccaaagaaattgttcataattgtccgatcatcggcttgccgaatggggatattagcctgatactggttattttgtaggcttgtattaaactgtcccaaatatttattttgcagtgaatagtaagaatcaatgttatgcaatccagaagtaaggtcgttatcaaggttcgggccgtcaataatcttattttggctaattgttgaaacgcggtaaaaagaattattcttcaaatcctgatcaaggttaccgtaacggttgctagtaattgcttgatactctccccggctcagcatactactagagaaatctccgttataggggaaagccgcgtaaattgcgttcaccccagcgttaagcattgtaatcgctagtaaccaccggtaaggatgagtaagtttatttaagtgaatcaaccagatgaccattagggagccaattaagaaaataaccggcataaaaatatcattctcattgtcaaagaagaaggttgcaatcaagacaatgaggtaaatccctgttgcccaacttaggaccgccattgtcttttgatcaagcgttggaatgttctctgctagaatacagacggccattgctaatggaaggtagatcaagagcgtccaacggttagaagctgacatcattccgttgaagaaagcgccgactgctggaattagcagcatgattaaggaaagaccaaggctaatcgttagcaggggatactttcggggacgagaataaatgtaaacaagggcgataaaaccaattgaaacaatccctagcgcagaccagaacatgaaataccattgaccaccgttaatcagtgacttaggcaaaaagagatagtagtaaagaggataggtttttaaaccattagcaaataatgatccagtccgggttgaatttgtgaccgcgataatttctgggacgagcaagaccgcggataagaggacactagtaattgtcgcaaaggcaagtttaagcaaggctttcccataattaagcgtgcgacgataatgcgttcctacgcgaaggacaagatagagaaatgaaccaattcctaaaacgtaagcaaggtaatagttgcttactagcatccatgtaaaggcaccagcaagcggccagggcgagccttcttgcaatatccgttcaatctggaccacgattaaaggaaagataataaatggcgtggtaaagaacggctgggcgatacaggcatagagtaaaaacgaattgaccaggtaggttgttgcccccatcaaaatgacgctattccgaaatttaaagtgttgcgcgaagtagacaaaagcgaggccaacacaatacatccggataatattaattacctggtaggcgagggtaatctttgctgcgggaaaaagtagtacaaggtaagagaaaacgtctccaatcgtatagtaagaatatacttgaaaggtatcactgcctagccccatttgccatgaccagaagtttaggcgaggatggtggaagaagctaatcagtgcttctcgatactttgctagtaaaggtaaatgctgattgagagcatctttgctaaggataaaagtatgaccagtaattaagtatgtcccgaaaatacataaggctaaaaagatgaataaaatagtatattcaccatatagtctttttaccggtcgttttttaaatgagaaatccataattcctccttggattaacaatcattttttaggatatctctaatattttaacaaaaaaatattaagagtgacgttcttaattttagcggatattcttaggatttgggtggtaagttctaaaatgatcaattacaataaaaaagatctttatattaaaggggtaattttatggaaaatataggtaactttacagtagcaaaacgatggggatcttttctgctactatatttaggatatatgattttatttgctgaccgcacagtgatgaatatttcccttgcttacatcggtaaagactttcatgttggggcggcagcgttaggggcaaccgccagtgcgttcttcttagggtatactttgatgcagatacctggaggatacttaactgataagtttggcagtaaactgatggtaattatttccttgtttgcctggtcgttgatgacaatggtgactggctgggcgtggtcccttgctgccttgattgcgattcggtttctgtttgggattgcagaagggccatatccagcagcggcattaaaacgaatttctgaaaattatgataagagtgagaaatcacaagcaacttctgctttaatttcatcgaattatgccggggcagcagtagcgccactaattattgtgccaattattgctagcagtggttggcgaaatgcctttgttttgcttggggttggtgggtttattattttacttacctattacctggtagaacggccaattaatagcagccaagaaaatgggcaggcgcgttccaagattgaatggaaaaagattgaccaccgtgtctgggcctttgtagtaattggacttgcgctgaatatcattactaagggacttgaaacctggatgccagtttatttcttgcaagaacagggaattaacttgaagaacttggcctggttagtaccactgccagttatttctggaggtattgcagcatttatttctggctttgtgatggtgcatttgtttaagaagcatgaacggaggatgattagtattgcttcattcctgactctggttttcatgtttggtctctttaagtcaacttcattagtaggcgttgtgatctttgatgtcttgatctatttcgttaaatcattggcatttaccggtatctttagtttcattgcacagattttatcggagaaaacttatggatcatcaattgggattgttaactttggtgggcaactcggtggttttgttggtccactcttaattgggtggattgtccaagcagccggctcatattcagctgctttcttcggccttgttatcagtgcattagttgcagtgattgcatgtttgtttattaggaaagcataaaaaataaggtgttgggagaaaataaaaagctttctctcagcaccttatttttgctttataagtccttacttcattaatacttttaatagcttgccgtggcaacgatgcaaggcactttggacgctccgtttagagcaatcaagggtaccagcaatctcagttatcgaataaccagtatggagataaactaatacttttcgttcaaatgtagaacagcggcaaagtaaacggtcaagactctgccggcaataaataatgtcatcaggggaatgatgtaaaaagtcggtaagtgtttcagcaaaatcatcgcttaatgcgtaaagacagcctgctgggatccgtttgtgagcctgagtttgtcgttgaatatcacgaatccggttagttaagcattccttaaaaaagcagctaaacatgcgcggaccttgattattgtataaacgaataacttctagcatcacaacacgggcttcctgttcccaatctgccaattcaaggccgctaatattatatcgttgccacagtcggcgaacgagcggccaataacggcgaaataactcttcgaagtctttattgcttccgcgacgggtattgttaatcagcttaaggtacttttcttcatctttttcattgaagcgcatatcaaaaatgctctcctttaaaactataatttacgcgacatgcttcccatcatagtgtttgtcctatttatttttcttctccccaaataggtaaactgacgacctaaaagaagggattcattccttaattcaggcaagataaaacggtttaattttatcacgcagttcgcctcgcgttggtattaatttatcaaatgtcttattttagaacaataacggaatttgtataatcagaacgattaatcgaacgttaaggcgagaaaagatagtagtaaagatgaataaccattttttataattctaaataattttattttcgaataataattaaagaaatgatcagaagattaagaccggggttgattgatcaaagtaactatactggtactagtacattgatcattgcaatggatatcgacttgccaggtttggattcgccggccacgtttaatcggaattgcaattgctcttaatttaccattcgataccgcaatgaggtgctctgtggtaatattaacaccgagagctatttgatcttgttgacgatcagctaaccattgattggcacctaaggaagctgcggtttcagcgaggactgaatttattccaccatgaacgattccataaggttgcttgagcttatcacttactttaacagtgataacgcacttgttggctgtgactgattgagtttgaatatctaaattttctaataggttcattattattgacctcacaaaaggagtagagtagttatgacaacagttgattggcaaccggttaaagattattctgaaattatttttgaacgagcgggaaagattgcaaaaattacaatgaatcgtccagaaaagatgaacgcctttacccccgttacaattcaagaaatgatcgacgcgtttaccatctgtcgtgatgatagcacaattggggtgattatcctaactggtgctggtgataaggctttctcatctggtggtgaccaaggagttcgtggtaatggtggatacgttggtccagataagattgcccgtctcaatgtccttgatttgcagcatttaatccggattatccctaaaccagtcattgcgatggtaaaaggttggtcagttggtggcggaaatatcttgcaacttgtttgtgatttaacgattgctgctgacaatgctaaatttggtcaaactggtcctaaggtcggaagttttgatgctggctatggatctggttatcttgcccgcgtaattggtcataaacgggcaaaggaagtctggttcttaaatcacttctatagtgccgatgaagcctaccagatgaactggattaataaagttgtgccattagaccaagttgaatcggttaccttggactggtgtaacgaaatcttgaagaagtcaccaacggcattacggtttattaaggctgccatgaatgctgatactgatggactggctggcctccaacagctcggtggtgatgcgacgatgctcttctacaccactgatgaaggtaaagaagggcgggatgcctttaacgaaaaacgggaccctaattttgaccagttccctaaattcccataaataaaagaggcaatttaaatggaaacacaaaactggctattaaagcaagcagcaactcagccgaaccagattgcgattgacgatggtaatgaacgcctatcatttgctgaattaaaaaaacaggtagaggtacttgttggaaaaattgaccatcttaatcctggttcgcgggtaggcatcctagctactaatactctgatgagctataaattatcactagcgatcatgtgtagtggccgcacgattgtctggttgaacttgcggcttgctggtgaagagcttgaacgacagattaaagatagtggacttcagttgtgtttggttgaaaattctctctggcgatcagggatgacggatccttttaagtcttacagtgcgttcttgataacaagtgctgatccaggagagctaattccagtatttaaatcaaactgggtagccagcattatgtatacttctgggacgactggtaggcctaaaggagttttgcaaacttttggcaaccatttttattcagcagtctcttctgcattgaatttaggtttatcatccgcagataagtggttgtgtgtagcgccgatctttcatattagtggtttttcgattattatgcggggattaatttacgggatgactgttcgcttggttgagaagttccgtgctgaagaacttgaacgaattttagcaaatgaaacggtcaccattatgtcggttgtgccttttatgctgaaaaagctcattcagcagcaaaataagactaatacgcactataattcagcatttcgttgtatgttacttgggggcggaacgattgatcgagaaacgctcgaagcatgtttgcaacggtcaattcctgttgttcaatgctatggaatgacggaaacatgttcccaaattgttgcattacggtcagctgatgcactcctaaaattaggatcagttgggcagccactattctcaacccaactaaaacttagtaaagatggtgaaattctgctgaaaacaccagctttaactccgggctatcttaacctgcctgataagttgccttctaaaatgattgacgggtggtaccggacaggagatatcggtcacctggacaaagaaggatatctctatatcgatggtcgcgcagatgaaatgttgatctctggtggagaaaatattttcccccaagaagttgagcagatctaccaacgttacccacagattaatgaagttgcagtcgttggtcaaaatgattctgtctggggccaagtaccagttgcctttgtcgtcagtgatcgtcgtctttctccaactaagctaataaattatggttatgaacatctggcgcgatataaagttcctcaacactatatttttgtttcagaattgccaaaaaacgcgagtggtaagattcgccggtttatgttacgagaaaaattgaataatgagtaaaaaaacgaggctgggagaaaacttttgttttctctcagcctcgttttcacgaacaatagcaagataacgtggaaactaaccacacgtctccatattttataattactttttattctttgccagctttttaatttcacaatcgtagtcacaagctgcacatttcccttgcttgcctcgttgaaaagtcttaacaaggaggtaaaaggctaacgcaataattgcagcaataataataacgttaataattaatttcattttaaatcacccaataaataatcgaccaacctgaaagataataaatgcaagcccgtacgcaacgactaaactggatgcaacagaataaagcatccactttgtagaaccagtttcttgtttgatagttgctaacgttgcgaaacatggtgcatataagagaataaagactaataacgtataagcagaaagcggagtcataaactgaccaagtgaagcgatgaggaatgctttactgcttgtatggaacattaccatcatactagaagtaataacctctttggcaaggatccctgtaaacaaagcactaattggctgccactggtcaataccaattggcttaaagatcggaacaaggatgtgtccaaggtcggcagcaaaactattagccgaattagtaacaaaaccactaggaccaaaacttgataatatccagattaaaacagttccagcaaaaataattgtcccagcctttttaataaatcctttacccttatcccatgttccgtgccaaattatatcaagacggggaagatgatagtgaggaagttcaactacaaacactgagctttcttttaccttaaagattacttgatagaattttgccattgctaaagccacgacaattcctaagaagtagactgataaaacaatcagtgcttggtgacgtgggaagaaggcggcaacgaataagctataaatcggtaggcgggctgaacaactcataaacggcatgattaaggtagtgatcagtcgttctttaggctgttcaattgttcgcgcagccatgattcccgtaacgttacaaccaaaaccaataattaatggaataaaagacttaccatttaaaccaatcatctgcataacccggtccgttactaacgctgcccgcgccatataaccagagtcctcaagcagggaaatgcaggcaaagagcatgaagatttgtggaataaaggctaaaactccaccaaccccggcaataatgccgttaacgactaacgaccgtaatgcaggaattgcccctagactagcgagggtttggtcggtagtagttgaaactgggcctgatataaactgatcaagcatatcggaaagtggggtgccaacccaatcaaaggacatcttaaacattacaaagaaaattaggacgaaaattggtaagccaagaatcgggttggtaacgattttgtcgattcgacttgttatctcaacttgcccaccattgttaagtggatgacgggcctggttgagagtgtcctcaataaactgtagccggacttcaaaaatttggtcagcgaacttttgcgcgtcataatatttttgttgcgaaagaaggggagttagctctttttcccgggcaaatttacgaattactttattcttacttatgaattgaatcgctaaccaacgcgcaacctggggcgcaaaagaataatcactttccaacgctgtacttgcctgcctgattgcttgcttgatcatcgggggataatctaaatctagttgggtagggtggagcgaattacaattgatagtttcttttcgtaattgatcaatcccttgatgtccacgcgcatttgttgtcattactttacaacccagccttttttcaagcaggtcaagatcatagtcgtaccctgatcgacggagatcatcaatcatgttaagaaccaatacaacaggatagccgagttccaatacctcgattgttagcaaaaggtttcgttttaactgactagcattcgtaatatttaagaccatattaggttggttatgcattaagtagttagttaccactgcttcgtcttttgtcaaaggatcgagtgaatatacgccaggtaaatcgatgataataatatctgttcccttaagcgttccttgtttcttttcaactgtgactcctgtccaattaccgacataggcgtatttatcagtgagcgagttaaacagggtagttttaccagtattagggtttccaatcagtgcaactgttgtcattttattctgcccccgtaagcatcgtaaaaacagtgtaccgcaaaccaattcgttggtgatcattttcgattatcactgggccatgaaaaggatatttttgaactactttaatcggacacccttcacacaagcccatatcatgtaatcgggcggcagtggctgtatttaaacagtcaaatgagtgaagaatataattttgttgaatcattatcgccacctgccttatcaaatattctaaaattatataaacactatattatatctttattatacactcaaattattcatcgagaaaacgcttaaaataaattgagatgaatagttttatttttttattattcggatataataagaatgtaaagaatttgttgatatttatggaatatttaccgagaatattttggaatatttcgggtcaggaggatgaattttatggcaacactagaaataaaggatcttcacgtttcagttaaagatgaagaaagcaaagaagaaaaggagatccttaaaggggttaaccttaagatgaagactggagaaatccatgcaattatgggaccaaatggaactggtaagtctactctttctcaaaccatcatgggtcatcctaactatcatgttacaaaaggcgatatccttcttgatggggagagtattgttgatatgccggtcgatgaacgagcacgaaaaggtctctttcttgcaatgcaatatcccgctgaaattcaaggggttactaatgctgagtttcttcgggctgcgatcaatgctcgtcgtcctgaagatgatcaaatttcggtaatggactttattaagaaactcgataagaacctggaattgcttgatatgagtcaatccatgactgaacgttatcttaatgaaggattctctggtggtgaaaagaagcggaatgagattttgcagcttttaatgattgaacctagttttgcgattcttgatgagattgactctggacttgatattgatgcccttaaggtggtttcaaagggtgttaattcaatgcggggcgacaactttggttcattaattattacccactatcaacgtcttttgaactacatcgttcctgatacagttcacgtaatgatgggtggtcgaattgttaaaactggtggtcctgatcttgccaagaaacttgaagatgaaggttacgctggcttacgtgacgaattaggtcttgatatcaaacttgtagatgatgaagactaggaggcagtttgatgacagaattaaactcagcaaaagaacaaataattgctgctagtaaagcaaataatgaacctcagcaattgattgatcgccggcttagtgctcgggagttaatggaaaagcttcgtttgccacggatgcaacggttcgattttcgaacttggccccttattgcggagcggccattgaaatgggttgaagcagacgccgacttagttgaaaaaccagtcaccgatgatgaagtaattaaggtaactcagtttgggcaaactttgctccacgttaacttgccacaaaaacttcaagatcagggggttattctcacagatatctttactgctgcgcgcgaatatcctgaacttttcaataagtacttcatgactgctattaaccccgaagaaaacctattaactgcttatcatcttgcctaccttaatgccggtttattcctctatattccaaaaaacgttgaaattgaaaagccaattgaggctgagattattcaggacagtactcaagatgagcctctaatttcgcatattctagtaattgccgatcgtggcagccgcattaagtttatccaacaccttacaactgttggtgatcatgaaaatgccgctaatatgatgattgaattaatggcgcaggaaaatagtgagattgatttttcttccttagatgaatttggtccccatacccatacttactttaagcggcgtgccgatattggcaaggatgcgcacgttgaatgggcagtcggcttgatgaacgatggtgccacagttggtgatatggattccgaattgctaggtgatgggggttatgctaactcaaagatgattgccgtaactactcgtgaccaagaagttggcgtcaacaaccgcgttactaatcatggcaagcatactaccggattgataaaccagcgaggtgttattcttgaaaagtctgaattgatttttaatggaattgggcaaattattcatggtgctcatggtgcaaaggctgatcaacaaaaccgggtattgattatgtccgatcaagcacgaggagatgctaacccaattctgttaattgacgaaaatgatgttgaggcaggacatgcggctagtgttggcccagttgatcaacaacaaatgtattacttaatgagtcggggaattccgcgcgcacaagcagaacgaatggttattcgaggattcctaggagcagtcttgagtgcaatcccagcagtggatgtacgaaataagttaattacgattcttgaaaggaagctcgccgatggacaacaatacgaatgattatttagccgactttccagcacttaatcagcgagttaatgatgaacgcttagcctaccttgataatgctgcgactgttcagcgcccacgtcaggtaattcaggcacttattaacttttatgaacaagataatgcaaatgttcatcgaggggttcataccctagcagaacgtgcaactaaggattatgaagaagcgcgaaaaaaagtgcaaaagtttattaacgcgtcgagtgctaatgagattatctttacaaagggatgtacggatgggttgaatctcgtcgctgcaacctatggcgaacaaaatattcaacctggtgatgagattgttatttcaataatggaacaccatagtaaccttattccttggcaacaattagctaaggaaaagggtgctaccctgaaatatattgaattaactccagatggcgaacttgatcttgcagatgctaaaaagaaaattaccgataagacaaagattgtggcagtagctcatgctagtaatgtattaggaacagtgacgcccttgaaagaattagcaacgattgcgcaccaacatggggcaatcgttgttggtgatggagcacaagcagttccccatatgccagtcgatgtacaagatcttgatgttgacttttacgctttctctggtcataagatgatgagtccaatgggaattggggttttgtacggaaaagagaacttattacgagcgatgtctccttaccaatacggtggagaaatgattaatgacgttcaccggaatgagagtacatgggctgatatcccgtttaaatttgaagcgggaacccaaaatattgccggggcagttgggcttggagccgcgattgattatttaaatggtattggaatggataggattgtgcaaaaagaacaggaacttgttaattatgttttacccaagttaattgctattccagatgtcgaagtttatggtccgcaatcgccagcaaaacatactggggtaatttcctttaacatcaaaggtctccatccccatgatgttgccacggcccttgatatggatggggtagcagtccgtgctggtcaccattgtgcgcagccactcatggaagacttgggagtaacagcaaccgctcgtgccagtttttatttttacaatactaaagaagatgctgatcaattaattaacgcaatcaaggaaacaaaggagttctttaacattgggactatctaagttaagtggtttataccgtgaagtgattctcgaccatgccgatcatccacataataagggagaattagcaactactacgaatgcaatgacccttcataatccgacttgtggagatacgattaatcttcaagtcgaagtagaagataacaagatcaaaaatattgcctatactggtgatggctgtactattagtcaagcatcagcaagcatgatgaccgatgctgttaaaggaaaaacaactgaagaagcccttgcgatggcaaagactttttctgatatggcaattggcaaagaacattcagaagctgacttggatcaactaggggatgcccggattcttactagtattatggaatttccagcccgaataaagtgtgccacgctctcatggtgggcattacaacgagcactgttgaaggatagcgaggaggaagaaaataatgagtaatgatgcagctagcattataaataataatgaccagtacgaatacggctttcacgataacgttgagccggaatactcaactgggagagggttaacagaagaaactgtccgcaaaatttcagctgctaagcatgaacctaaatggatgctagattaccggcttaaagcctacaagatttataaagaattaccgatgccaaaatttggtccagatttatcagaattagacctgaagaacatgctttactaccaaaagatgacggataaaaagtttcgcgactgggatgatgtgcccgaagatttaaaacggacttttgatcgcttaggagttccggaagcagagcgaaaataccttgctggttcttcagctcagtatgaatctgaagttgtttatcacaacatgaaaaatgagtttgaaaagctggggattatttttactgatacagatacagccttaaaagaatatccagaattatttaagaaatggtttggtaaattagttcaaccaactgataataaatttgcagccctaaatgcagcagtatggtcgggcggttcatttatttatgtaccaatgggcgttaagacaaagacgccaattcaatcttacttccggcttaatgcggaaaactcaggacaatttgagcgaaccttgattattgttgatgaaggggcaagtgttgattatgttgaaggatgtactgctcccaattactcttctgatagtctccatgctgccgttgttgaagttaacgtctgcaaggatgcttattgtcgttacacaactattcagaactggtctgataatgtttatagtctagaaacaaaacgggcagcagcagcagaaaacgcaaccatggaatgggtcgatgggaaccttggctcaaaagtcacgatgaagtacccaagcgtctaccttaatggtgagggggcacggggaaccatgctttccatcgcagttgccagcaacggaatccaccaagattcgggagcccgaatgatccacaatgctaaaaacacatctagttcaattgtttcgaagtcgattgctaagacggggggctcaactgattaccgcggaacggtccgctttggtaagcactctgatggctctaaagcccacgttgaatgtgatacgatcattatggatgaccaatcatcctcagatacgatcccatataatgaaattgacaatgctcatgtcgcaatggaacatgaggcaaaagtatctaagatctctgaagaacagctttactaccttatgagcaggggaatttcagaagcaaaggcaactgaaatgattattatgggctttgtggaaccatttacgaaacaattaccgatggaatatgcagttgaattgaaccgtttgatcagttttgagatggaaggttcaattggttaattgaattaacaaataagtttggaggaacgcttatggctgacgaaaaggatactcccttttccccaattgaaaataaagtgatggatgcgttggaagaagttattgacccagaactgggaattgacctcgttaaccttggccttatttatgatgttaaagttgataataatggtgaatgtacggttacaatgactttaacgacaatgggctgtccattaggcgacatcttaaatcgcgacattaccaaggcagttacttctgttgaaggtgtaactaaatgtaatattaaccttgtgtgggaacctgtctgggatttgtcaagaatgagtaggtttgctaaaattgcattaggaattcacggttagatataggaggtcagacatggatattaaacgctttgtttatcaacgaaaaagactcggctactcacaagttgccttaagcaaggggatttgtacccagtcgaccttaagcaagtttgaaagcaatggtcaagtaccatcactcacgattttggcgcagctttgtgagcggctaggattaacgattgatgatttaagtaaggataatacgtcttcaattcgttatatccggagtctgctagaccaaattgaattagctttaatgattgaacactttccacaggcagttagtaaccttaagaagattcggcttgaagatttaaaatcgccacaagaccggatgcaatattattatttaaaagggatgatttacactttaactaataataacgcgtcgacaagtctttttaactttactaagattttagatgaactggatgagcaacatcggacgatcttttcaccattagcatatttaggatcagggatcttatatgcacgacaaaattcaatggaacatgctgatttctttttctcaaaggttattgcattcttaagatcaaaggctgatgaagacttagcgggtgttgatcggaactattatctacggattgtaacgatgatgtactacgctgccgagtatcattcattaaacaagcggttggaagttagtaaccaagtgttggaggctacgacaaagatctgtgctagcaaccacgttacttatttcttaccacgaatcaaattactagaagcaaataatacaattgagttaggagaaaactcgaaaaaaatacgtcaacttttaactgaagcagaagtatttgcgcggttcaataaaaataatgttgttgaagttcaagtagctgctcttttaaataattttgataagacaattagtaataaatgaaaataatgaggctgggagaaaactttgttttctctcagcctcaatgattttcgcgaacaatagtaagataacgtggaagccaaataggctagctccgcgtcgtaatcataagactcgaggctaagtacgaacgataatcagcccgtgccgtgctaatcaccgttctatccttagcctaccgccttgtcgagaagattattttccactcccattatctataggtctactaattgatgtttaactgcatagtggagaagttctgcgtgtgaagcaaggtttaatttttgcataatctttgtcttatgggcttcaacagttttaggggatataaacatcttagtagcaatttctttgttagtatatccgagaacgattaacggtaagatttcttgctcacgtttcgaaagagcaacgtaatttcctaaatcgaagtgcggagaaccgcctttgataactaataaatctttcttcgttaccataatattattgtctaagtatttttcaccattaatagcgtgtcttagggcatgaactagttcttttggagaggagcttttaaagatatagctatttgcgccattataaattgcctgattgatgtattgaggttcattacgagaagaaaaaataataattttggtgttagggaaatgttcatgaattcttttgattgtgatcagaccattttcaccaggtggtatcgctaaatccataataatgatatcaatgtcaccttgttcaacccgtaatgaggcatctattccggttgtttcttcagcaattactttaaaattatctagttgttcaaccagatttttaactgccattcgaatgatgggataattatccgccacaagtactctatacatcaataaacctgctttcattcttaaagttatctcttcttcagtatcttctttttgctaataattatcaagatccaaaagttatttttcacacttgctgaaatagtttcaataaacggctggaataattgtgaaaatttattgcagaataaaactaatgctgtaaaataaaagaggatcattgatgacatgacaacatcaatgatccacagtagaagtatgttggcgaaagtgattgcagaatcaccttcaccttttattataccaattttttgtcctaatgtaataaagattatctttttatctataaattattttatgaaaagagtggaaaaggcaagaagagcaatcaaaaagccaattttaacaattttattaagttgattgaagaaaaaataataatcatctaataattaatgcatttacggattgtttgatctagaatataattattagctattcttgaatcagagaaaggtgaagcattgatggcagaaaaaacatttacaacaaccgaactcgctgagttcgatggtcgaaatggacatcctgcatacgttgccgttaaaggcgttgtttacgatgtctctaacgttccgcaatggaaggatggtaaacaccatggaaaccttgctggtcgtgatttaacttcagtaatgcctcgttctatccatctggaatcagtccttgaaggtatccctgttgttggcaaactagttgactaggaataactatgtaaaaagctaggaattggtagttttaaactatctcttcctagctttttatattgtaactttgaaataagcttgcaagtatttcgccagcccgttatgctcgttatcaattggggtcacatcattagcaatacttttaagctcagaaatggcattatgcattgcaacgccacgtccagctgcatcaagcatttctaaatcattatgctcgtcaccaaaagcaataatattttgccggttaatttggtactgcttagcgatataaaacattcctgactccttatgagtgccacgatggatcagttctaagatgttgtaagggccaccccatactcgtggttcaacaaaatcgccgtatttttcattaactgctttaatgatttcttcttggtgttctggttcatattggatcgtcattgcgattggattgcctgttaagttagtcgcggttaggatttgatcatcgcgcaacttgttcggtaagaattcgggtaaatcattactagcttgattagcccatacatgatgtttattttcaacggtaattgttttaattcctagttctttccggtgggctagaagatcgagggctagctcccgtgttaattcaacatcatattctttatcccagtgttcatgaggtatatgcgttagggccccattaaagtttaccatcggagttttaatcccaatttcatcgtaaatatgtttggcaattcggtaaggacggccagtgatgatgctgacaatatgtccatcccgggcaagggcacgtaaagttataattgtctcgtttgttaatttcgattgattatttaatgttgtgccatcaagatcaagcgcaatcaagtgttgatccattactatctcacttctctttccataaaaaattcaattataatattgtaaacaaaaacttaacgctttgccaagtattttgacttaaaaagactaaaaaatacgttacaataaagatattacagtaaagaggagcgaaaaataacgtgcaattaccaaatgaatttgtcacgaaatacaaaaaactaatgggagcagaggccgatgagtttttatcagcacttgctcagtcaagttatagtggttttcgcgagaatccattaaagaacggacagccggttgcaacaattgaaaaagccacgggaaaagtaccgtatgtgccgacaggatattatggtcaagtgaatggaaaatcattagaccatgttactggatgggtatatagtcaagagccgtcagcaatgtttgtaggagaagtggttaatccacaagctggagaacgagtgctagacttgtgtgcagctccgggaggtaaaacaacacacctcatcgctaaaatgaacaaccagggactattagttgctaatgaaattttccctaaacgggcgaaaattttggctgaaaacctggaacgatggggagcaaaaaatgcagttgttactagtgagagtcccgcagatttagaaaaacaatttcctcaatattttgaccggattcttgttgacgcgccttgttcgggagaaggaatgtttagaaaagagcctgccggaattgaatattggtcaccagaataccctgctgagtgtgctaaccgtcagcagaagatcctagcatccgcaatgaaaatgctaaagccaggaggaacattagtctattcgacctgtacttttgcaccagaagaggatgaacaaactatttcatggttgcttggtgattatccggatttaaaactcgtcccgattgaaaaggcagtggggatggatgatggtcgtccagaatgggctgatggcaatgaagagttgaaaaagacagtccgattattcccgcaccatctcaagggggaaggacatttcattgctaagttagtaaatggtaagccagagtcaactaatgaaaagcgcaaaaagaagaataagcggaaaaagcaatcgattgttaaaccggacaaagaacagatcaaactctttaaccagtttgctacaagcgtttttccagactatcaaccacaccaattgattttatttggtgaccagctctatgatttgccattagaagaggacaagatcgagggactaaatgtacttcggcctggacttcacctcggtacttttaagaaaaatcgatttgaaccagcgttggcatgggcccttgctagcttaccacaggaggcaaaacgggtcattgacctaaacagagaacagtggcaccaatatgtccatggggatgtaattaatattgatgctgaccttccgaatggttggtatttactagtatgcgacaaacatactgctggttttggaaagttggtcggtaaaacaatcaaaaacttttatcccaaggggttacgtttttaaattaggaggattatcgagatgaaagaaaaaacagcctttcacgttaacggctacctcgggttactcggggcgattattatcggtttaattagtttgtggctgatgtttgttggctttacgcgtaattttccggtagtcctgacaattggaattattttattcttaattgtgattctttttagtacatcattgacaattattcagccaaatgaagctaaagttttaactttttttggtaattatattgggactattcgtgatgcgggcttatttatgacggtaccatttacaaataaggagactgtttctcttcgtgtctgcaattttaatagtcaaattttaaaggtcaatgattcgaaaggtaatccagtcgaaattgcggccgttattgtctacaaagttgtcgataccgcaaaagcactcttttcggttgatgattatgagcaatttgttcaaattcaaagtgagtctgcggttcgtcatgttgctagtgaatatccctatgatagttttgaagatcaagatgcaattactcttcgcggaaatcccaccgaagtgtcagagcgtttaactgctgaactgcaagaacggttaaatgtcgcgggggtcaaaattattgaaacacggttaacgcacttagcctacgcaactgaaatagcgagcgccatgctgcaaaaacaacagtcatcagcaatcctatcagcgcgcaagataatcgttgagggggctgtttcaattactgaagaagcgattgaacgcctaagcaaggaagccaaccttgatttaacagatgagcaacgtttgcaaattatcaataatatcatggtagcaattattagtgaacggggaacgcaaccagtaataaatacagggacacaaggataaatgatatatttaacaattttaatgtctgagcgtgttggtttaattattattctagcgtttttgctggttagtgtacccctatttcgccgcctgttatttaatcaaaccattagtgccaaaattcagctaacgattcttttttctatttttgctattatagctaatatgactggaatagagatcgatgcgaataaccagttgcataataaaattattcttacggccatttcaacaaatgactcgattgtcaatgtccgaattttggctgtttcagttgctggaattattggtgggccatgggttggtagtttagtaggattagtagcgggggtccatcggattattcaagtgcacccctgcaaggttggttttatgtgcccagctcagttttgattggtgcgctttctggttttttgtatcatgatcgaaaaagttattttaaggtaatgacgccgtggcatggttttattgtggggattttgatggaaagtattcagatgctttttatcttgctattcagtccaacgggatgggatttagttaaatatattgccttgccgaattcctgattaaggtctttagactaaagaaaatttctaaggtcggaactggtcttggtcttggatccgctggtcacactgttggatctgctaaggcggttcaactagggtcaattcagggagcaatggccgcagtggcagttgttatcgtttcgttagcaatggacattttggttcctatttatgctcatctttttatgtaaattttaattagggagagaaaaaggagtatggcgacagaagaacatcaaaaggttgttttaattggtgatggagttgtggggtccgcttatgcttttagcgtgatccagcaaggtttagctgaggaattagttattataaataagagtaatgagcgaagcgttggggatgcactggatttggaagacacaacgccatttactgccccagtaaaggttaaggctggtagctatcaagattgtaaagacgctgatattgttactatttgtgcaggtgctgtgcaaaagccaggtgaaatacggcttaaattagttgaacgtaacttaaagattatgaaggaaatcgttcaagaagtagttaataccgggtttaatggaatcttcttaattgctgccaacccagtcgatatcttgacatatgctgttcaaaaaatttctggttttccagcacataaagtaattggatcaggaacctctcttgattcggcacgcttaagagtagcacttggtaaaaggttagcaattgatccccgagatgttcatgttgatatgttagcagagtacggtgattcagaatttgctgcttattcttgtgggacaatcggtggaacgcctttaatggattatgttttagctaatgggctaacaaagcaagaattgttaaaactagaagaacaagtacgtaataaggcttatgagattattggccggaaaggcgcaacatattatggagtagcgactgctttggcaagaataacaaaagcaattttgtatgaccaaagtacagtattacccgtaagtgcatatttagatggtgaatatggagaaaaggatatttacctcgggacaccggctgtaattgataaagatggtattcaaagggtagtagaattaccattagattcgcgtgaacaagaggctttaattaattcagcatcagttttgcgtgaaacgacagccaatggaatgactaaagcgggtctattgaactatctttggaaataaataaaaatgactaagattgaggagcaatattttcctcagtcttagtcatttttgcattatagtgaccgatgatggttatttatttgtttcgattaagtgtttagccaatgcaaaattaccgagagtagcagagccatttcctggaacagaagggttgacaatatattcatcgagcgatccaactggaagatagtcattccataacattgcaaattgcttccgaacccgttcaagaaaggctgggcgcgaaacacttccaccgaagataattttttgtggccgcaaaatggcagttacctgaactgccgcttgtgcaacgtaataggccatgatatcccaaacagggtgattatcaggaacatcttcgccgctaataccgagccgcgccttgaaagttggtccagctaccaatccttccaagcaatcgtggtggtaagggcagataccagtaaagtttagatcagctgggtggcgttgtaagcgaacatggcccatttcaggggtactaattccaccaataaagcggccattttgaattgctccagcacccacgccagttccaagggtatagtaaaccaaggccggattatcatacttatcttttaaattgacatattcaccgtaaaccgaaccattgacgtccgttgtccagtagacgggaatattgagggcttcagtcattgtgccgacaaaattgcaattttgccacttaactttaggagtatcagtaatataaccgtacttttcactagccggattagtatcaattggtccaaaactggcaattgaaagtgcagctagttcagggtactgcttaaaaaattcaattgaagcccctaaagtttcttcgggggtggttgtagggatgatttttttatcaatttcattaaaattttcgtcaccgacagcacagacaaacttagtaccgccagcttcaatacttcctaataacataatcaaaaacctcatttaattaaagtgaacgtttatcaatctgataaccatgtttgagtataaaccttagaaaacggtatcacaagcacaattactctctttttacttataaaacgtttcactaattcaaattaatttctgaactttcgcgccaagtggctttggcaggcaaattaatatgaatagggatttcatttggattattcagacggtggactagtctttgaactgctattgtccccattgaaaaactcgctggattgatcgatgaaagggacggaactaaatattcagcaatatccgaatcattatagctaataatttgaaggtcttggggaactttaagctggtgttgcttcagggctcgatatgcgccgatagttagttggtcactagctattaaggcggcctgaaaattatctttcaaaagagtattcatgctgtcaaagccatctttaggagtccacccattaaggacaatcaatggagaaatattatgaagtcttgtccacatcaaataggccttagctcgaatatcttgatacgagtctgtcgtttcgccattattattcatgggatgaatatttccaccgataaaggcgattttattaagtccattttctagtaactgatcaagaacgatctgagtggcttcaaaatacgaattacggataatatcgtaagcggggagatatcgatagtcgtcaattaaaacgatatggggattgtttttagctaaattagcgtagaattcttgcgtaaaaactccggcaacaattacgccatcatatttttgagcgtcagtaaattgaaaggctttattgggaaaacgaacaaaagctttgatttgaatgttttgcttggaagcttcctgaataattccatcatggacttgaatgaaataagggtcatgagcttctgtctcgagcgaatgagttgtaagcactagaattgaacgaggagttggcggcggagtaacggtcctgtttaggtggggatggtaattatactttgctgctacttttttaattcgtgctcttgtttgttcacctactgaaaaagatgaatcattgcttaagacacgtgaaacgctggcaggagatacaccagcctcacgtgctatttttctgataccagtcataggaaaacctccttttaatcaatttctagcataacatatttttagtaaacgtttagtagccaatattgacggatgattgctggcatatcaataatgaaagcgcttgacgagaaataactaaacgtttattatagaatcgatttcaagaaaggggccacaacgaatgattacatttgatgaacaacaacgtgtttttcacttaaaaaataaagaaatttcctatttattttcaatagaagagggaaatatcctcagtcacctttattttggaccggcaattcgtaactaccatggtgaacgccgatatccacgagttgatcgtggattttcagggaaccttcctggatcgatggaccgaacttactctaaagatgatttgttgcaggagtattcgggaaacaataccggagactatcgtgtgcctgcaattattatcaaaacaaaaaatggttcacgactgactgatttccgttacaagtcttataagattttaccggggaagcccaaactagctggattacctgcatcttatgttaaaagtgataaagaagcagaaacattggaagttactttggttgataaaacaatcggtgcacaacttattctttcatacaccatctataacgaacggccggttattacacggaatgcgcggttagtaaacacaagcaatcaagaattacgaattgaaaagattgcctcaatgcaactggatttaactaaacatgattatgacgttatctccgttccaggacaatatgctcttgaacggcaacctgaacggcaagaattacgtcggggaataacagaattttctagccgtcgaaattctagttctcatcatatgaatccgtttgtggccttggttgacaagaacaccgatgaatttcagggaaatgctttgggagtgctccttgtctactcaggtaatcaccagtttaccttggaaaaagatcagatcgaccagattcgcttaataactggaattaatgattataactttgaatgggttcttgaaccgggaaaagattttcagacacctgaagcaatcatgggctttagtcagcgtggcttaaatgggatgtcacaagtattccataagttattacgagaccgggttgctcgcggtaagtatcaatatgcagaccgaccaattgttattaataactgggaagcgaccttctttgactttgatgataagaagttagaccaaattattgatgaagcaaagccattgggaattgaaatgtttgttcttgatgacggctggtttggccaccggaatgatgataattcatcgcttggtgattggtttgttaaccaggataagcttactggtggattaaagcgggtagcagaccggacccacgagcattgcatgaaatttggtctctggtttgagccagaaatgatttcagttgactctaagttatataaggaacatccagactatgccttacatgaaccaaaccgtggaatgacactttctcgtaatcaattagtgctagactttagccgtaaagaagtcgttgataatatttacaatcaaatgtgcttaattttagataaggtgccacttgactatattaaatgggacttcaaccgtaatcttactgaggtcttctctagcgcagcggatgcagaacatcaaggagaagttagccaccgttatgttttaggtttatatgacttaatggagcggttagttacccgttatcctaatatcttgtttgaaggctgttctggcggtggtggccgctttgatgctggtattctttactacatgccgcaaagttggccatcagatgatacagacgcggttgaacggttaaagattcaatacggaacatctttaacttatccaatctcatctatgacggcgcatgtatcggtttcacctaaccagcaaactggccgttctaccagttttgagatgcggggcgatgttgccatgagtggggtctttggatatgaacttgacttagcagatttgactgaagaggatcggcaaatggtaaaggaacagatcaagttttataaggctcaccgccacttaattcaatatggtgactttattcgcttagaaagtccttttgatagcaatacagtcgcctgggaatttatcagtccggataagtcagaagcactgctatttatgtttaagcagttgcatactaaccgttttgaaattaataataccaagatggcagggcttgatccaacaattgattatcatgatgaaatgactgataagacttatggtggagatgaattgatgaatgtcggtttgttccgtgacccgactcgtacgggggacttcacttccgaagtgcattactttaaaggtaaataatttaaaataataaaagaggctgggaattaactattaattcttggttctctaacagtaaaatccggactatgatttttgatcgatccaaaaatcgtagttcggattttaaattatttatgaaattagtcgccaatcgactaattgattgtcccaatttcgttagatttaatgccaccagggctagcccaatgtcattttccacagctcgttgtccgcgtagatgagttcggcatatgccaaaatccctcttcatgtgatcaaagactggctcaacgtcgaacttctgtcgacgataaattgtcttgccttcgtcacttgagagggttgcttttactttagccttgtaataattccacgttgggttaacctgcatatagtgttgccgaccacttggtgtttttgccaactcatccaattgttctgacagttggtgcttatccgctcgatagagtttgaaatcacgttcgaaaccatatttatcggttcgcctactataacgataaaagctaaagcgaactcctaaatgatcgatgtagtaatcatcttcggcattatactgccaattttgtgatttagttggatcgtttttaaatttatgtttctgttccttttgataagttgtgtatggaataacaggctgcttttcaaactgatcaagaatcattgtgtaattgtactcactaccataaccggcatcggcaacgatatgcttaaagaaatctaaagcatgaaactgggtaagaaatggcactaaggtcctggtgtcagttggatttgaaaagagcccgtaatcaaggacaaattgcttatgtgtagcgatttgcaggttatagccgggcttcaactcccgattcatcatcggatcttccttcatacacataaaagtcgcatcatgatcagtcttgaaatagctattacgaccttggaagatatcttcggtacgttcatactttttggcacgcggaattaggtcgttgcttaattgatggcgaagttttttagaaaacgacggcgccgttttctaactgaaccacctttgatgatttttggttcttgcttaatctcttcatctaacttaatgattttctccgcaagctcttgtttcattacttccatgccttcggcagaagtaaccagctcgggtgccatttcttgcaccacttgtttttctactagttccccataaagcttactcgtcttttctcttaacttagcgtgatacttttcaaccgcccgccgccaagtaaatgaatatttattggcatcggcttctaccttggtcccatcgataaaaactgcatcattttgaattagtccgtgatctttcaaagccatggtaaagtagacaaaggcatgtttaattagcttactagcgtgctgactgcgtcgaaagttattgatggtatggtagctataagtataatcatgggctaaccaacgcattggcaggttcttatccaacatcatttcaatctttcttccagaataagtttgacgtgagtaggcaaacaagagaatcttaagcataattgctggatgcgatgaagggcggccggtagccgctcctgaatcttctaatagcacattttgtggaatcgagtcgacaaaatcactaattagccgcgcaatatgattttgtggtaaatcatagttatagtttagtacgaattcggtttgtcctatggtataattttgatacatggaaatcgctccctttggttgtttttaggggtaattacatcatatcaggaacgatttcctgtgtacataaaaaccggatgatgaattgttcaaaaaattcatcatccggtttttatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattttggactaggagttttttcccagcctcttttattattttttactttttattaatgcatcaatcgtccacatccagattgcatgtcctaaaaattcagaaacatgttcttcaagtggttgatcttttgcagcaggcactgttcccattaatggcattaacttgaggtggaagaaatcccaaacagcaatcccgaatggtattccatcgccttttttgatccacggcgctaactgtccaccgatactatagagaactccaaaaccagctgagaaactaaagtgaacaacatagcttacccatggcaactgttggccggaataggtataagtagcatgtgtaatctgtgttggaacgccaaattgctcaagcattttttgtggtgggtttgtttgatctcgctctggtgtccgtggtgggagaatattttcccaaccaagtttaacaaggccggcaacaagaccagccgttataccaactgtaattgatttgccccaattaattttattcacttcaatcaccatccaaacctttagttattaaatcaattgtatcaatcttaataggaatttcaattatttaggttagcgtaagtgtcgttgacgagcatatgatagtaagtctgttcctaaaacatattcaacacgtgaaagctcggtaaatgatgagcaaccaaggagcgcgagcaagcgtttgacaatcacttgccattcaccgagcgtttggtctaatgcttcatagccttcattttgaagaatattgaggaagtaaccggcaacaccaactgcccgggcgcctaatacaccggccttgataacatcgaggggagaagtaattccgccagaggcaataatttcagttttaccgcgccgaattgaatgagcttccaatagtgattcgggagttgtttgtccccagtccaataaactctcaaaattaatatcatggttacgccgattctcaatcgctgcaaagtttgtcccaccacgaccactaacattgatgaggtgaacgtcatgggtttgcagtttggcaatcgtcgttttgctcattccaaagccaacctcttttacaataactgggacttctagttcactgacaaggtattggatgttatccaaccaattaaaatcgcgatcaccttcaggcataattaattcttgggccgcattgatatgcagttcaagggcatttgccttcaaaagtgaaatagcatttatcgcttggtcaagactggcatttgcacttaaatttgcaaaaataatgccctttggattttcttcgcgaattatttcaaaagacgaaaaggattgggggtcttttgaaataatactgagagatccagttgccattgctaaatggtgtttatgagctaattgagcaagttgttggttgactttaagtgcttgatcacttccgccagtcattgcctcaatataaaaaggacattcaatttctaaattatcagctaactggacatgcaaatcaacatcatctgttgtcatttcaggtaagctatcatgaattagacgcacttgatcaaaataatgatgttgatgaacctggtcataatatttggcagctaatgaaaggtgttcgttttttcgttgggcatgacgtgattccatcatggagcctcctttgatctacttgtgaatgtaagaaagatggtgcttaacagatttcttgaagctttttgcgttatcgataaagtgtacggataaaggaagttgttcgatgcggtttttggcccagctctttagaacgttcccaaagttagagttgctatcaatagcgacgatcccacaatcaccgccaccagcaccagatgtcttagcagccccaccaaaagattcagcgatttggcaaagcttagataatgattcggtttcgatgtttacccccgaattagtgccgagttgttttaagaggtcacggttataacgaatttcatttttaatcgcttcaagatcttgacggtgaaaaccatcaaccattcgttggatacatgatttacttttttcaagaaaatgatgatattcagtttgacgacgagctttaaaaagagaaattttatcaacaagttgggaagttgaggctggtttaccagtccagccaattaaaagttctaagtttttgggagcagttagagactcaatattcagatcaggccaaggtaaatcaatgatcgtctttaggtcaagatacttacgttgttgggcaagccactgccgatcgaatgaatgataggaaatccaaccaccatatacggaagcggcaacatcacccaacgaaccatttccttgaacttcaaaatgggcaattgcagctaatttaaagatttggtccttgttaacgggcaaattatagaaccgacaaagagccttaacagttgctacagtaacagcggcagaggaaccaagaccatattttcgaccattagcactgtctaattgactgtcaatatggatattaaatattcgtaagtcgcgactaaaagtacgagcatattcttctgtaactctaatagcagaaagaatgtaagaaaaaggattatcacgtttgtcaactaccatttggtctcctaaacgtcgccaggataattgatcgttattatattggcgactaataatttgaccaacttcttgagtgctttcctcgattgtacaggtaacaaattgatctaacgcaactaaaactgcaggataaccattttcaacaacagcatattcgccggcaatatacaatttaccgggagctttttcagtaatcaaaatttaaagtccccttatcattaaattttattcattccaaatctttattccaggtcccggttgtgaaaccaccaaccgttctgggccaacaatattacttaatttttcaacaattttgctccggttttctcggtcgtaaatcactttgacgttcggaccggcatccattgtataatagcagtttattccctgattgcgcaagtcttccactgctttaatgatggttaacgtttcaccattaaagtaggtaaaaccagggtcagctgaaaaagtaagtgcgtgcatccgaagagcattttcttcagcaatatggccgatttggtcaatatcttttgctttgatagctttctttatggcaaccatatcattcgctactacttggcgccaagcatcatagtagggtgaagtttcaacactggattgcattccagatcgactggaaatttttttcctttttgtatcaactaaaactgctaacatttcgattggaaagtcaacattttctaaaactggttgtgcaaacgaggatgcatcatcagttcctttttgccattcaaccaatccgccataaatagatctagttgccgaaccggatccacgtcgggcaagtcgtgatagatcacggcttgagagatttaatccggccgcagtactagcagcgcctgctaaggcagcaaatgcggaagctgaggaagcaaggccggctgcagttggaacatgattaattgactttacgcgtgcaaaagcttttattccacttagttgccgaacaatatctagaacatgaactacttttttggcccctttcttactaagtgtttgttgatcgatggcaactaagtctgaagtaaggtgattatcaaaatttacggtagtagtggtgtaaaactcattaagcgtaagggagagactgtcagtttgtggaatgattaattcttgattcttctttccccaatatttaacaagcgcaatattagtatgtgcttttgcagttgccattagttattacctcgcttatcaagtggttgaagccaaatatcatgtgccccgttctcttttaggatacttgcaaggcggcgagctcccatagctgtttgcattaaggcgatcatacaaccgccacgaccaccaccagttaattttgcaccaagagctccattatcacgtgcaacatgaataaggtgatctaatgatgggtctgacacgttgagagcagctaaatcagtttgcgcaaagttaagagcatcgcctaattttacaatgtcattttgtgtaagatagtcttttgtttggtttactaattcaccgagatgcttaatatgtccttcagctttttcattgttatttttcagttcatctttaactgccaaaatagcttccttagtagcacctttttttccagtatcagcaattactaaagaggcatcaaggttcatttcaattggtaccccaatccgccccttaacataaaaaagcggtttatctgaactgacagtagcagcgtctaaaccggatggactacgatgtgtaatttgttcttcgacatctgcaagctgaagcaataatgttcgatcgagtggttcatcataataatcaaagaatgctcgaataattgcaatcgcactggcggcagacgaccccattcctcgttcagcaggtaattgactttcaatttttaagtcccaaccagtttcgtggtcattaaaccttgcagataaagtgtcaattaattttttaattccgatcatggaggaaggtaaatttcctagactaccatgataataacggcttttaataattcgctggttatcttggcgactgctgagcgtaactgataattgaacgcttggcaatggtaaggctattgccggttgaccgtatactacgctatgttctcccattaaaatgattttcgcatggctagtaccaatcccttgttgtttcaccatcgtaacctactttctatataaaaattcaaacttaatcatagcataaaacagtgattctagctaaaagcgattgtggatgttaccaaatctaaacattttagcacaaagaaaagccgattcgtgtaaaaatgagaaatttatagtagaatggtgtatcatttagtttagaatatttagtaacttaatataataacttcggagaaatatggtgatagtgtgacacagcgtagtagtcagcgcacaaaaaagcgtgacaagaaagcgccaatctactcagttgttgatttagaaacaaccggaacgaatgttaatcatggtgatcgaatcattcaaatcggttgtgttctcgttcaagatggcgaaatcatgaatcactttgaaacaaaaataaatccacgagagaaaattcctcgttcaattgttcaattaacaggaattgaagataaagacgtacgaaaagcacctttgtttgaggacattgctggaactatttatagtttgttggcggaaacgacctttgtggctcacaatgttaattttgactttcctttcctaaatgcagaattagagcgagctggatatccctcattatcaattcctgcaatcgatactgtaacccttagtcagattcttcttcctactgcaaagagtttccgtttacgagacttaactagttcgttgcatattgagcatgatcaccctcatagtgcagtatcagacgctgaggcaactgcagacttacttaatgacttgttaaaacgagttcaagaattaccaacgcttatgcttgaaaagattactcagttgaagctcaacctacctcagcaaacagccggggtttttgatgctgaattgcagcgtcgacgtaaatcgccccagccattaagcgaagagttgtatgtctctcacggaattgttcttcataaatcgcggccgattactgctaatggtcagcgagaaaagcataaatatccttccactaaaaaggcaaaggaaaagctatacggagatacgttgagattgcggcctgttcaagccaaaatgatgaacagcatttacaataattatactcatgctgaaccccaaaatatgattgtcgaggctggaactggagtagggaagacattgggctatctttttccgctaagttatgttgcatatcttgataagaagattgtcgtcagcacagcaactaatatcctccagcaacaaattattgatacatcaatcgcacagttaaataaggtgttgccttttaaaatgaatagtgtgattatcaaaggaaacgctcattatattgatattgcacgttttgttcattccttaagtgtgattgaagaatcgaagcttgttcagttgttaaaagctaaaattttagtatggctgctttcaacgcaaagtggggaccttgatgaacttaatttaaattctcagcagtcgccatactttactgaaattcgtcatcagggtattcggagcttgaatccagcaaatgccttttaccatgatgattttctcgttcggcgggaaaagcggcttcatcaagctgatattattattacgaatcatgcgtacttggttgctcatgcccaggaattaggggatggaactcgtcgcccatacttagtaatcgatgaagctcagcacttaagcgaaagtatcttaaaacggtcacggcgaacatttaattttcaaaaattgcgcacagcagttcatataatgtctggattagttaataatggcaatgaccggaacttaactgatattttcgctgaacaggcactaggcagttataatgttgaattgcttcgtggtgatctcaatgcagtagaagaagcggttgaccttttccagcaagccctttaccgtcaatatatggcaagcgctactggtaatcctgataatgaattaattgaacaaccactacaaaatgatcaagtgatggctcttttagatattagtgggcccgtgatgatgaagctagagcaggcattaagcagtgtgcagcttcatttttctgccctcagtcatttatttagcagtcagccagaccggtggttattaagtgatcgttacctcatgagccaatttcaaagtcagcttgcaaaattaattgaagccgatcagacactaaatgaatttaacgaaacacttcaacaacaaggagaggctgctgctttttggattactattcgccaatcaagtgaacaaagtgccttacagcttagtggggggctattggaagcaacccattacctcacaaagaatgtttatccatattttgctcaaccattatttgtgggggcgacattgtttacatcgccacgatcgccgtatctttaccaccagttagatttagagcgcaataatactttaacgcgtcgattcgcatctccatacaattacaaacagaatgctaaattattgattgcagaagatgcaccagtaccgagcgctcaaaataacagtgattacattaaatatctcagtgacacgatttaccaattaacgaagaatgctgattatcagacaatgattttattcaactcactggtgatgattgagcaggtatatagccaacttcgtgaaacggatctatttgatcagcgggatattttagcccaaggaattacgggtaatcgtgataaaatcttaaaacagtttagtggtggaaaaaattcgatccttcttggtgcttctagtttttgggaagggatagatttaccagagtccgctcttgaactcttaattattacgcgcttaccgttcgattcgcctgatgaaataatgaatcgtgctcataataagttacttcagcagcaggggaaaaatccgttctatcattcagaattgccaaaagcaacgatgcggttacgtcaggggattggacgattattacggacagaagatgatcatggggttgcagtagttcttgatccacgactacagacaagacggtatgggaagacgattttgagtagtctgcccactgatttaccggttaatagcaaaaaaactgctgacttgatttcaattactcagaagtttttacgaaatggtaaagaggacaaagttaattaaactttatcaacttttaattaccgatttctggtataatcgaaaacgattgtcatataagaatctaaaaaactaaagagataagagggaaaagatatgcaaagtcgacgtgaagttcagcgtgaacaaagtcgcggttcctcaatgcggacaattcgtaaccttttgattgcgattttactaatcttgttaatagtgtggagtgtttttgcagttagcaatcagccgcgaaattcagcgcgacgacagacaatttcacttgctgaaaaatatgctcatcttcaatctcctgaccaattttatatttataatcgagagaatacttactatacgattagtggcaagaatcagcaaaaccaaccgatcttggttatggttccccaacacggtggcaagatcagagttctaaaacaatcaagtgggattactgctgcgagagcacgagcgatgacaaaatcaaatcgtgatctgcgagaaattttaaaagttgctcccgggatatttaatgacaagattgtctgggaagtaacatatcgtaatcaaaaagggaacctctgctacgatctgattaattttaagactggacaatacgttcaaaatattaataacctttaataaaagctgaaactaatagaggctgggattactcagtctctttacttttgcaaaaatattttactaagagaggagctgattaaatgccagatgcaagccttttacaacattatttgcaggcaggagaaacaaatataagcaacttattgctacatcattataaagagttggggatgacaacttctcaatttgtcttatatcttcagttcaaatcctatcaggaccgaggaataatgaatccggatgttcgtacaattgcaaagaacttaggaacaaaagagcggcaggtgtttgaacagcttcaccaaatgatgacaaaccatcttgttgagcagaagatgcgaaaaatggaagatggtaaagaagatgcaatatatgatttttcgctccttatcaataaattagcattgctcaatgagaatgaccaagaggaaacaattaaggttgaaaatactaatagtcgggttgagacatttaatcagctagaggccgaatttggccggccactctcatcaatggaattgcaaattgttaatgattggttggataaagataattattcggcaataatgattaaacttgctttacggcaggcagtaatgaatagtgcgctaaatctccaatatatggaccggattctacaaagctgggatcgtcagggcttacggacagaaagagatatcaatgagcacgaaaagaggtttgaacagcgaaaagaggctggacaaaagccagaaaagaagacattaaaaaagcctaaaataccgatttataaattaggcgaataaaattaaataaagggtggttgacatggaaaaatcttcttctcaagtaatgaaaggaattatatgggcagcggttgcctccgctatgtggggaatatccggaaccgttttgcaactcatctcacaaaatttagcaattcctgctacgtggatgctctcaatgcggactttttcagcaggagtaattttattagtaattagtgtatttttatatggaaaaaagatttttaacgtatttaagacacgagcaactgctatttcagttattagttatgctattttaggattgatggcaaacctgcttacgttctattatgctattcaaacaggaaatgcctcagcagcaacaattcttcaatatctttccccgctttttattgtgttaggtggaattatttttatgcatcgtcgtccgttcaggagtgatattattgcgtttgttgttgctttgattggggtagcattatgtattacgcgtggtaaccttacccaattagctttaccgtttgtatctcttctctggggcttaggttctggaattacagctgcattctatgttgtccttccacaacgtgctgctgatgaaaatccgccaattgttgtcctcgggtgggggacgatgattgccggagtcctatttaacctctaccggccattttgggtcaatccaccacatattactaccacgttagtagcatcggttgcgacggtggtgttattcggaacgattttaccatttggaattttgcttcatgcaactagatatgccccatctgatgtagttagtatcatggatgctgttcaaccaattacaacttcgattttaagtgtgatcttctttaaattgaacttgaattgggcagaaattttaggaattattttagtaattattgccgtctatattctacaaaatggtcggcgaaaacgtacaattcattattaaaaaaagttgataataaaaaggattgcggagaaaattccacaatcctttttattatcttcaatttttaaaagatcttattagggattagttgtgcttggttgtgtagcagaggcagggctagaacttgaactttgtgcgggtgcagatgaacttgaactagccggagcactgcttgatgaagactcagctggagtattgttgcgttcttctgtgcgactttcgctgctactacttgaagcagagctagaagaagatgaagacgatgatgaatcgcttgagctagaagtagaactactatcacgatcatccgatgtatcttcagtgtaatcaaatgcccattttgaatcacgaattacaagctgacgtttacctttaactcgaacagcctcaacagtgtctggcatcgtccaatcagatgcgtgattttggctgtcaagatattgcattaagtccttgtaaagcaattgcgctgactttacatactgttctgaaatgctgccaccaggttcgagtgggtggtcataaccagtccaaactgcaattgagtaattcttagtataaccagccatccaggaatccattacgccagactggctagaatttccagggtagtttgtcgtccctgtcttaccagcttggttaacaccgtcgagtcgagcgtcagttgcgcttccttgtgaatctgtgaaaactcctttaagcatatcagtaatcatgtaggcagtagccttattcattgcgcgtttacctttaggattgaattgctttactgaaccatcttgagtagtaatcgagctaatgtagtaaggtttgtagtaagtaccaccattagcaaaggccgcatatgcagcagaaacttggagtggggagatatacagcgcaatcccgttttgtaaagtatatggttgtttttgtgaaattcctaatccatcaaggaaagaagtagcacgcttaattccaacagcttgcaatgcgcgaatagcaggaacattccgtgattgaactaaggcttcacgcattgtcatattacccttgtactttttgtcaaagtcatgaaggacagtgttggtaccaggaaagacaaaccgcgtatcagcaattgatttaaaagttggccattgcaagtattcgatagccggaccataatccattaatggctttgcggttgacccagaactacgattgctttgcacagctcggttaagtccatacacaacatttcctgtgtgacggccaccgagcatggcaataatttgcccgttgtgggggtcggtaacagccactccagcttgcattttatcgttttggaactgaacatttttatttgcagcatcataaaggtgttgttgcgcatcgaggtcaagattggtgtgaacctttaacccatcactataagggtcgtatccttgtgcctgtaaatcagcaagaacctgctttacataaggatccacaaccttagaatctacagcagttccgcttcccgaaatattaccgtgatcagggtctaaaccagcagtaacgctgtcgcttgcagcttggttagcctgggattgggtaatataattgctgcgaaccatcgcattcaatacttcattgcgccgttgcgttgcatactttgtgttacttacaagtggattatagtaagtgggagattgtggcatcccagcaagcagggctaattgggaaaggtcaagatcgtttaaatctttaccgtagtagtactgggctgctgtttgcattccataaattccatttcccatgtaaaccttgttaatgtagaaatcaaggatttgactcttgctaaaatgctgctcaacattaatagcaagccatgcttcttgggctttacgttttaatgttcgatcagaggcagccgttgagaagacggataatttaactaactgttgagtcagcgtacttcccccctgcatcccggctgaacgaccaaaaacattagaagtggctgctccaagaattcgaattgtatcaacaccatggtgcttgtagaagcggcgatcctcaattgaaacaacagcattttttaactgctttggaatttgattatccttggcatattctcgcttttgtgctcctaaacgagaaattactcgattttgatcatcgtaaatagtcgtaatactctgacttgttaagtcgcttctactaattttaggcgcgcttgaggcatagtagaaaaataaagctgcagatgccaccattagtagaacgacgattcctgctacccatagcaagattttctttattaagctgccaacattgcgctgttgattgtcattattattattatgacgctcactacgcgttgactgattatcatttgacatagtaaactcctttacgcttttgcagcaattattttatcaacagcgtttaaatatggtaaacgcggattgagttgataatgaatttgatagccttctttagcgatatcagttcgcaaaattgatttacggccgccattttgctgttggtcccaatatttaaacaggttggaagcgggaagcaggtatagcaggtcaagctccgtaaatttaatgaaagcaaaacaaattcctccctgtgctacacattcacgcatatgttgaatttggtggggatgaaagttctttaatggaaaagaatttttattacgtgtttctttagcatcaaaatcaatgtagtatccacggtacactccattgtaatcagtagttgatggtcgccgaaaatatgcttctttaataacagccgcactccgcttggggtaatcaacttttacaagctgaataggggtaggctttttatgaataacagcaatatggtgagccaaatagtaatgattactatgattgatctcatcctctaatgacatcccacgtttggcataaatagattgatgtggtgtcggtaattcattatgtgtattatagtgttgtacaggttgctgaccattgggatagtgaatggtcacagtgatcactctcctaactagagatttattataccagactcgttacataatgattgatacaagatgattacaagtttaagttaaaggctttagggagaattttatgaagagattatggattactggctatcgaagttacgaactaaatatatttaaggatgatgatcccaaagttcaagtaataaaagaggtgctaaaaaaatatttaagggctcaattagaattaaatgatgatgaattttgggtaataactggaccacaaatgggaacggaaagatggggacttgaagctgctttagaatttcaagcggattttccacaattaaaaacagctttaatgtttccctttgcagaatttggtaagcaatggaatgaaagtaatcagttgaagctgacaaatattacccagcaagttgatttttttgctaatgtttcagataaaccttatcaatcgccacaacaattacggaattatcagcagtttatgcttactcatactgatgaggcttttcttctttacgatccagagtatgaaggaaaaactaagtatgattatgagacgattcaaaaatatatagaagaaagtgagtattcgatgacgcttgttgattttgatgaacttcaagaagaggcagaagaatgggccgagcgtcaaagggaaaaagatgaattttaatcttgcattttttctttgatttggtattatagttattggactacgcaaactaaacaattgaggtgtttaagttggataacataaaatttactccacaagatattttgcacaagcaatttaaggagagaaatattggcaaaggctacgatgaagcggatgttgatgctttcttagatgatgttattaaagactacgacacctataacaaagaacttgaacgtttaaatgatgaaaatgaacgtttgagagcaaaggttgatgaattaaatcgtcaagtagaagttggttcatctatgagtagccaaactacttcccgacaacctgtatcgagcgctacaaatatggatattttaaagcgtctatctaatctagaacgtcgtgtatttggttcacagttagatggtaatgataataatgactcacatttgctttagtgcgtgtcgaatagtttattaataattttgcaagttttgggtaattgagcacagcttatgttgtgttaggaaggtccatgctcgcacaggctgcgatgcctgtagtgtttgtgctcgctgaaaaaataaggcggggcaccattttatggtgacggcggaaaaacggactaaggttttaactatgtcttagtattcctgaaaagtgccacagtgacgatacaatgttggaaacgatattggtggaacgcggtaaacccctcaagcggtaaacccaaactacggtaggggagctttggataacaaattgaagtgattccaggggagagtatttcggtactctgagatagatgattacctcgatataattatgcctgataattatattacgacaaaacatggcctacagatacttgcatacaggcacccgagttcgctcgggtttttttattttaaaaatcagagtatggttttattggttctctttttgtagaatgcgttaataattactcgcttgaagtaaaaagttaaatggcgataaattaaattttagaagcttaagatagatattacttaaaatagcaataaaatataaataatcgtttcattttattgcaagtgcgcctataatgttaaaggggttagaaatgagttatttgtaaattagcttatcttttgattaataaaattagataatgaagttagggaattatggataataagagaataaaaattgtatatatgtcgttttctgggaatgtacggtcatttactcatcggcttcaagaatacgcaacgcaacaacatcatttgaataatgaaaatcctttagtcgatttattggagatttcagaggagacacttccgactgaaagcgatagtaaattttttgttttactaccaacatatatgattggtggaagtagatttacgccgacattaacagagattttaacaacaccaatgcacgattatttggaaagctatgacaatgttaaatgttgtgcgggaataattggcagtgggaacttaaccttagggaagatgtatgtaataactgccaagacatacgccaaagaatatggtttgcctttattggacgcatttgaatctcgtggcaccacctgggacatagaacgcgtttataaaatattaactgataaagtaaatgagaattcattaatgtagttagattaaagtcaactaccattcataaacaaaaagggattgtgacataagttaagttactttcataaaaagcaaatacgcagtacaacaatggcctccaacgtccggcaaaaaagccaaacattggaggcctattgttgcttgcgaggtctcccagaggctagtttcgcgtcgaaaaacaaagtaacaagtgacttctgtctcgcttccttttgtttcttcttgcgtcttcttttcattttaaagcaacataaggtaaaatagctaataggaataagtctaaaggagcgtttaatgtgcaaacatatcagttaattgctactgctgctgcaggtattgaagcattagtaggaaaagaactaagagatcttggctatgaagtcaaagtagaaaatggtcgggtgcgttttcaagggacaatgaaggatgtcattcggactaatctctggctacggaccgcagaccgagtaaaaattgttgctggtgaattcgatgctcggtcttttgaagaattgtttgatcgtactgaaaacattgcatgggaagatttgttaccaattgacgcgaatttcccagtggaaggaaaaagtcataactcacaattgcataatgtgccaagtgttcaagcaatcactaaaaaggcgattgttcaacgcctcagtaatgcataccaccgtcggactcgcttagccgaaactggtgccacttacccgttagaagtagcgattaataaagaccatgttcttcttacgttagatactagtggagaagggctttttaagcgtggatatcgtaaaaataaaggtggagcaccgttgaaggaaaatatggcagccgccttggtgatgctggcttactggttcccagataatccatttgtcgatcctgtatgtggttcgggaacgattccaatcgaagccgcattatacggtcataatattgcgccgggcatcaaccgttcatttattagtgaacaatgggttaatttagttccagatggtttatctgatgaagttcgggatgaagccgattccttagcaaattatgatatcgaattagatatccacggatatgatattgatcagaatatgattgatattgctcaagaaaattctcgtgcggcaggattaactcacgatattacgtttaagcaattagccgtaaaagactggcaaacaagcgaagttaatggagttatcgttgctaatccgccatatggtgaacggttaagtgataaggaatcagttcatgaactttaccggcagatgggtgagttatatcgtccattaaccacatggagtaaatatattttgacggctgatatggaatttgaaaattattatggcgcacccgctaccaagcgtcgtaaactttataatggtgctttacgaacagatctctaccaatattggggcaaaaaagatcgctccaagatcaaatcccttaaatagcaagggttccaagcgattcgaaagatcgaaaataggtgctagggggcaaattttcccaataataaaagccttagtaggagttacattgtaacgaccgctaaggctttttctctgtttggtggctgatagaacacgtggatgatataattaaaacgatatgatgttttctaaaatcactctattttatggagggcctgatttgctaaattatgtgctccacgattatggctttcaggaatccactgggtaacaactgttggaaagtgttggagaagaggatttaatgctgctaattctttttggtaatgttttgtataatttttgccgattgcgtcacttaagatacggctatcagtataaaataggattgtttcattattgctaaagtgatcaattaaatatttaaatccaaagtgagctgcagcgaattcgccatggtgattatccatgctttccttatctactgggattgcaagctgaatttgcttatgattggcaattattattattcccaaaccagtagggcccgggtttccttttgttgcagcatctgtaaagattttgatcataaaactacctcttttctgaaaggatgacatttataattatggaagaagaaactcgttatttttaccaaccagaccttacggggacaattattagctggtgttggacttttctcttctttattgccggtctcgtaatttggcttgaaattactcattttcagtggctcagcgcgctcttttttgcagtttttgtaatccttgccttattagaatggcggcgacgaaccgtagtaatcactccgactaaaatggtgtttaatcgtttgttacaaaaacagtacctcgttatcccaatctctgatattcgtcagccagagtttaccaagcatacggtgacaattactgtgaatggagaggtaatgagttttacctttaccaccaaagcaattgcacgcttgaaattggcattgaaacaacagggggttcaataattgttactggggatcgctattgtaattattttaattttaacaatttgtgaccaattattaaaatcttgggttgcttcttcaattgttcttggtggtagtaagcagttaattcctggtattattgagttaactaatttacgaaattcaggggctgcttggagcatttttgaagggcaacaaactttttttaccattataactattgttgcgattattgtaattggttactttatctggcagtaccgtaaaaatattcctatgctaattggcttatcattgattatggcaggaacaattggcaactttatcgatcggttaagacaagggtatgttgtggatatgtttgaaacaacatttattaatttcccaatttttaacattgcggatatgtgcttaacaattggcgtaatctggctaataatttgcatcttaaaggagaaagactaacaaatgtctgaagaattagaattaacaattgatggtgagatggtgggaaggattgataagcagcttggtcatcactttgatcaattttcccgatcacaaattcaacattggatagaagatggtcacgtccttgttaatggcgaacaagtaaagcctaaatataagttgcttgtaggtgaccacgtccaaataattccagaagaaccacaaaaaattgatttaacacctgaggatattcctcttgatattgtatatgaagatgatgatgttattgtcgttaataaaccgcaggggatggtggttcatcctgcaccaggtcatccaaaccatacgcttgtaaatgctcttttatatcattcaccactatcaactattaacggagaatttcggccagggatcgttcatcggattgataaggatacctcaggactattgatggtagccaaaaatgatatggcgcaccgttctttgacagctcaattaaaagcaaaaactaataaacgagaatatgttgcgcttgtgcatggagttataaaagaagataaaggaacaattgatgctccattaggtcgctcgttaaaggaccgcaagaagcaggcagttgtggttgatggacgtcatgcggtaactcattttaatgtgttagaacggtttaagaattacacattagttgcctgccagttagaaacaggacggactcaccagattcgcgttcatatgaaatatattggtcacccgctggcgggagatccgttgtatggaccgcgaaaaacgcttactggcaacggccaatatttacatgctcgtttgttaggctttaaacacccccgaacaggcaaagaaatggtttttacggctccattaccagcctatttcacaaaaatgcttgaacatttacgtaagacagaccaataaaattattgtgtttaattcagagaacgttcataataatattgatcaattattaacaaagttttaggagagtgggacagtgacagcacgatacctaatatttgaagatggctcaattttcgctggcgaaggttttggttcaccagctgttacttttggtgaagttgtttttaacaccagtatgactggttaccaagaaattatcactaatcaggtttataataaccaaattgtcgtttttacccagccgaatatcgggagttacggcattcaacgtaatatttatgaatccattgtaccgacaattaaaggaattattgttcgttcccttgccgatgctggcaccgatgataatggacgacaattgacacttgataaataccttcaacaaatgaatattcctggaatcgctaatattgatacgcgagcagtagttcataagttaagaaaagctgaaaagccattaaaaggaagtattgttccagttccagatgatcacgcttttgaccagcttcatgcgactgttttaacgaaccagcaagttgctcaagtctctactcctaagccatatcctaatcctggaaccgggctaagtgttgttgtgattgactttggattaaagaacggaatattacgggaattgagtcgacgaaaatgcaatattactgtcttaccatatactgcaacggctgaagaaatattacggttagatcctgatggggttgtactttcaagtggaccgggaaacccaaataatgttcgtaggtcggtcctggaaatgattcgtactgtccagaccaaagtaccgatgtttgctattggactaggtcatgaattattcggaatcgccaatggagcaaatgtccagcaaatttcggtcgaacaccatggggtgaatcacccaattcatgaaattattactgaccacattgtctatgcgactcaagcagaaggatacttgattgatcgtaattcggttgaccgctcccagctttttattacatacgttgacatgcttgataatagtgttcaagggcttcgtcatcgtcgctatccagctttttcagttcaattctttcccgatggtgcaccggggcctgatgaaactgatggcttgtttgatgagttcgttgatacaatgaataggaggggggatcgtcattgatggaaaagttgaaatctgtattgattattggagcaggagccaacgatgttcaacacggtgatgagctcgactctgctatttaccaggtctcacgcgtttttaagcaaatgaagataaaaacaatcttggcagatgataacccattttcagtaagcttagaaaatgttgaccacggttgtattgtcccactaaaagtcgaaagcctaatggatattattaataaatttcatcctgatgcaatcttacctacactgggaaatcgtcgggcttttgaacttacccaagaattgctagaaaaagggattattcgtaaagaaaatattcaattgctaggagtccctgaagcaactattcgtcaaattaatagtgcggttttacttgaaagaacccttcgtcaaatggaagcacctgttaaaaaaatcgtaacggttaataattatcaggatgctttggatgaggcaactaaactaggatatccagttattatccggtcggtattacctaagagtagcagtacacgtaaaatcgtgcatgatcgaagtgaattggcagatgcggtaaaggcttgcttgagccagtcgcgtgcggaacaggtagtagttcagcaaagtcttgctggctataaggaaattgaagtagtcgttcaacgtgatagttctggaacgatgatgatgttgtcaatgattgaggatatggacccaattggtatccatgctggtgattcgattgctttcaatcctgtccaaacacttcgcgatcggcagattcaggatattcgggatacggcttttgctattactcgcaaattaagaattgttggtacaaaccatattcagtttgccctggatacaaatagtgatcgtttttatgtcattaagagcagtccatactttgatcgaattacagcgtttgtgtcgcagtcaactggttacccaattgctcaagtaacagcacaattatatgcgggaaagcatctgcgggacattgatcttggcgaaaattatgttcatcatgcggctcttattgaaccaacgatggatcatattgctgcacgggttccaatatggggattcaacgatttaccaaaagctagtcgtttacttggaacagaaaaacggtcggtggggacggtttttggtatcggccgaagcactattgaagcactttttaaagctattgaatcccgttatcacgagccagctgactttcatcttgccgctcaaaagcaattgactgatgaccaattaatcgccaaaattgtccacccagaagcaggacgactttttgtattaattgaagcaatgcagagaggatattcagttaacgaattagcagagatgacaaagattgacccattttattttgaacagattaataaaatgcggttgttgattcgggaaattgctgagcatccaaataaagaaccggttttacaaaaagcaaagagttacggattaagcaatcagcttattgcaagactatggaaaactacctctgagcaagtttatcagatgagtttagaccatcaattgttgacaaagtacaaggaaatcgaaccatcggccggggagtttgatcaacatactaatagtttttattctgcttatgaagaagaaaatgaaattagccgaacttcccaaccaaatgcccttgtaattggaacggggggactacgtttaggattaagtaattctggtgattactttgttgctatgatgttaaaagagcttcataatgagggctttaataacgtcattgtaaattcgaatcctagttcagttacgtttaatccagagttagctgaaaagcgctatgttgagccagtaacgattgaaaatattttgcagatattacggatagagcaaccccagtatttgtttattcctgctagttatagtaaattattgaaatcattgcaaaattatgacttggatgtaaaaatcatcgtaattccagatgaattgccaactactgctgctagtagcgataggcaacgttactccttcaattatgtctatgatggtaattatgcttatccattaggaacaatgactgatcttttttcaccaattgcgttaaactatcaatccaccgctttacgctacccggctgatcttccttcgtcaacttaccaaaatctcaatgaccaggctagtgttgctgtgttaaagctggaacagccaggattataccaagtgatttttgaagagaatgatggtgaatttaatttaattaaagttcaaccattatcattgccagaagtagcctttttatcaaaagcacttcatattagcttaccaggaatttttactcaattattcactggtaaattcgataaaatgctggagcccaaaccggtatcagggattgttaactatcgtgcaaccttcccatttaaggcgttgcgagtcaaaggtggaatccctgcccgcaaccgagttattggtgctcagatgcaatttttaggagaataatttagagacgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgtagcgccgaaaccgtttatcgcgtttatcgttacctggaaaccggtgcctcaattgctgattatcaagatcactatatgcgcaataagcaacgttgtggccgaaaacgtactcagttgtcactggctgaacttacttatatcaacgacaaaattgcccaggggtggacgcctgacaccattattgggcgcgctgagcgcccaattagttgtaaccggcgaactctttaccggatgtttgaacgggggcagttcggtttggatgtccgtgctttgcccatgcgaggtaagcggcacccgaatggctatattgagcgccgcgggaaggctggccaattggggcgaagtattcacgagcgtgccaaggactttccgcactatgccactgaatttggacaccttgaagctgataccgtccaaggcaaaaagcaccaaggggcggtaatgaccctgaccgaacgccaatcgaaggtcgaaattgtactcaatgtgcacgaaaagacggctgatgcgattaaccaacacttaggtcagtggcttcggaaattcccgcagcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgccgggacggcttaacaaaacagctagatttccgcaatcttcctgatgaattggtgacccaactgatgagtaagcgaaataacctgccccgcaaatcactaggctatcgaactccatatgaggtattcatgtcctacgtcactgatgagcaactactttctttctaacttaaattgacatttcgggagatataaaaaagaagtggaaaataacctcctcgacaaggcggttggctaagctaggacgatgattagcacggcacgggctgattatcgtccgtacttagactcaagccttgtggcgacgcaaagctagttccacgttatctttctattgttcataaaagcagttgaggctgggagaaaacaaaagttttttcccagcctctttttagttagaaagcttatgtggtgttacataaagtgttttctgacctgtaaaaataacaaatccaggtttagctccgtttggcttatgaagtcgcttaacagggagataatcaacgggcacgttatcggaatcgcgacctttagagaagtatgctgctaactgtgcagcttctagaatcgtatcttcagatgggtttgttgagcggattaccacgtgggaacctgggatatctttaacatgtaaccaaatttcatttttattagcaattttaaagctaagacgatcattttgtaggttatttttacctactaaaactgtagtgccatcactagtatgaaactcttctggggcacttaccttaacttttcgttgctttttcccacttttcttctttttaatataaccttgctcttgtaattctagtttaatctcttgaatatcagcaggagcagctaatttaatctgattttcaatgttttcaaagtatttgatttcatcatttgtcagttttagctgttcctttacatattcgacagaggttttaagcttattatacttagtgaagtacttttgggcgttacgcgatggtgataattctggagtaagcttgattttcagtggcttattatcatcataaaagttaggaagttcgatttctttcattcctggagttaatttactaagataggtagtaaggatctcaccacaaattcggtactgatctgcagttgctgcatcttgtaattgttgttgcagtttttttacttttcgccgatctttttttagctcattcttcaatacctttaacacttgcccagctaattctttggaacgatcttgctctgctttattagcataaaaggcatcgagaagggcagagagggagtcgaaatgttgcaactcaccatcaatatttaatggagggaacacagcaaattgagactttccattagagtgggtgattaatactggctctggattttcaaagtgcttaagaaagtgctgataggtagctggtaaattatcactttgcagtaattctgcagctaattcccgtgcggagtctttgccaaatccttgataatgcttctgtaactgatgacttaattctactgtgtcatcggtttgtcttacaagatcagagtagatctggtttggcaagtaagggttaactttatcttgctttggtggcatgacaaaggtagcaccaggtaataacaggcgaacccgattttgatctgagccaacatgcttaatggtgtcaatgattttacccgtcttgagattaacgagtgaaatattactatgccgggccataatctcactcacaagaactaattgttggctatctcctaattcatcacgagtgtcaaaggtaattttgataatccgatcattatcaacttgttcaattttattgacgattgcaccttcaaggtatttccgcatcgtcattgtaaaattagttggaaccgctggatttttgtatgggatctcagtaatttggattcgtgggtatgttggattagcagaaatgagtaatggatagttgtgccggtgagcacggatcataatgattaattctgcagggtaaggttgactaactttggctacccgaccagtagttaatttttgatctagctcatggacaattgcatgagtaaacaagccatcaaaagacattagtgtagcctcctaaatattataattacaaacgaaaatagcactattaattatacagttttacatcattaatgaaaagtaatgatgctttagtggacatatttttggttggtttagggccgtcaatgtggtatgctttttgtattatgtgggtgaaatccgcgtaaaaacgcaattatttttaattatggtagattgtaaaatttaagttgaacatattagtggacataaaaacccataaaggtctttaatggtgttaccacaacattccattagaaagaaggacctttatgggcaccactattttatcatttgaagaccgtgttgtcatcgaaactcttcgttatgaaaaccgctcccttaaatacatcgctgattaccttggcttcggtaaaaccacgatctttaatgaggttcatcgtttgactggtgaatatcacgcagttaaagctcaagctgatcatgaagctaaacttagtcatcgtgggcgtaaaaccatcttaacgactaacctcaagcgattaattgaagaaaagattaagatccaaaaatggtcgattgaacaagtggctcatgtagttagaatcgcctacaagaccatctacaactggattgatcaaggagtattggatattgacgtggctgatttacctgaccatggaattcgccgccgacgagccaaagaaccccgtgggacttttagccatggacgttccattgaagatcgtcctgctgaagttattgaccgtcatacctcaggtcgctttgaagcggatacagttttatctggaaagcgtaaaggtcaagcaatagctacgtttgtcgagcgtaagagtcgtcttatcatcgttaaacggcttcagggacgagatagtacctcaatgaccaaggccattttagaattagctaaccagttagaagataatctcaagacccttactgttgaccatgggaaagaattcgctaactacaagctaattgaagagcaggccaggattcccctctactttgcgcatgcttattctccacatgaacggggcagtaatgagaatcgcaaccgagtactacgacgctttatccttaaaagtcaaccgattgaggaaatcactgatgatgagttaattcaaattaactggtatttgaactccaggccactcaaatgtttaaactggcgcacaccaattgagatctttttgcgtaatctgcgtcactaactttgttcaagttatttcttgcaatctgccttatacaaatttagaacatggagttgataagatgaaaattgctgttgttactgacagcactgcctacctttctcctgaagaggcggcggctaataatattcatgttgtcccaatcccagtgacattggatggtcaaacataccgtgaaggtgtcgatatttccaccagtgatttttatgaaaagatggcaaattcaagctcttttccaacgacttctcaaacgccaatcggtcaattgatggaagtttaccaaggattagccgatgatgggtatgatgctgtgattagcattcatttaacacgggctattacaggatatttggatactgttgaacaacttgctgagcagatgaaggatacaatcaagatcgtaccaattgattcccacctaacagttaaaatgatggggtacttagccttagaagcagctaaattagctagtgaaggcgatgatttagatgacattgttaaaaaggtaaaggaatatcgtgatacctttaataatgtatttgtggttgatgacttgcaaaaccttgttcgtggtggtcgtttatcaaacgcctctgcatttgtaggctcaattttaaaaatcaaacctctcctgactatgcatactccaacgcatgccattgaagcgtttgaaaaggtgcggtcaatgaaaaaggctaaacttcgctgtgaacaaatctttgatgaggatattgccaaacttgactatccagttagagcgatggttgttcacgcaaatgctccagaagaaggccaaaagtggcttgataaacttcaagcggatcatcctgatatttcatttgagttgagttactttggtccagtaattggttcccacttaggacaaggagccctggccttagcatggatgcaagatacagcaaagaagcctttagcatgaaaaaacaaaccttaattaaaacccttttggcaattacggcgggtattttgatgatattaatatcatttactggctttcaaaccattttgccgaccggtaaggcgtttatgcctttagctggcgtgattgcagtgggaatagcagttgcattgggaattaatattgcatttattgtgacgcttgttagtgccataatcatgattgtcttaggaactgctgactgggtaatattagtcgattttattgttattttgattgtggttggcttgattttacgcagacaagttccattatctattgatctcaatcattcacaattattatggcttgctatttttaccggtctagttcaattattctttatttcaatcttttatggtctaattggattagtcctaacggggacgccaacaggtggattaacatttgttcaactgattattcctaatgcattactgacaggattattgtatggcttcctggtagcaccgatctcattgatttttcggtgggtagcgcgaaaagcattgcatattgataataatcataataatgattcaggtaactctgcaggcgataagcagggcggttcgattattgtcgacttaagaagtgctaaaaataaaaaagatgataagtaagcaaaatgccttggaaaaacattcaagttttccaaggcatttattatttctctaaataatttacatctttgcatcccattctgcatgaaattcatcaagaaagtcgagcatcacttgttgacggtgatttgcaattttcttggcagtttcagtgttcatcatgtcttttagatgtaagagtttttcatcaaagtgattaatgatagtttcatttgctaaattacgatattcttcccgggacatattatgacgaggcttaatagccggatcgtatattttttcatgatggccacctccataataaattgcccgcgtaatgccaattgcgccgattgcatctaaccagtcggcatcacggactatttgtccaatgatggagagcttgacttcctctttatctaaggtatgagcaaaagaaatattattaatgacatccataattattttgacttggtcatcactaaagtcattttgccttaagtaatcaactaattcttgtttagctgcctcaacgttgtcaactaatttctcatcaattgtatcgtgaaggtaggccgccacgatgggcaaaaagggatcaactttttcaccaattgctaatcgtttactcatttttactacgcggttaatatggtccatcccatgtccagtcttgtcctgacctaatttttgaatggtgtactctttaatggcagttaattgttccgcttgtttcatcataaaacctctattcttgattggttctttaattattaaatactgaatcgcaatccacgtcaacgttttgtagaataagatgtgaggggtggaataaaatgaatttattattttcaattaacgacaaatttgtcacgcaattagcaacagttttgttatcgatcaagttaaatactcatgcacaagaatttaatgtatatgtcttacaaaaggagaaattgaaacgaactgaagacttggaaagagtttgtaagcaattaggaatgaactattttccaatcaaagttaatgatcaattatttagcaaagcaccagttacagaccgctatccgacaacaatttattatcgtttactagcacactgtcttttacctcaagatttgcataaaattttatacttggatgctgatgtattgtgtattaatgatctttcaagtctgtatgagacttcattagagggatacctatatgcttctgccatccatacaaacctgacgaatacgacagaggttattaataagattcgtctgcaaaactttgatgctgacgggtattataattctggcgttctcttgatgaaccttgatactatccgtaaaaaagtaaaggatacggatatttttaactacatccgtacccatacacttttattacctgatcaagacgtcttgaatgccttatatggacgttatattaaatctttccctgatcaactatataattttgatactcgtaaaggcggtatttacgaaacgatttcctttggtgaatggacaaccgattgggtaatgcgtaataccgtgattctccattattgcgggcgagacaagccatggctgccaactaaaaatagtggtcgttacactgctttatacaaaaactactttcaaatgactaataaacttattagtgcaacattattactttccccagaagaaactgattaagattttattgacttgcggattatgatgaagtaattcgtgtttagcgtttagcccagtaatcttaacttcgcggtatgaacgtgcgcggttattaataagatatttaagagaaagacaggaagcgtttgaaacttggctatcgttgccatcttttaagtcaccgtaaatattcaataatttaatttgccgtgggtagcggtgacgtaagggaagtaatttttgataggaatcattcattgcggaaggttttcccgtctttttattcactattagattagcaggttcattccaaccgattgcaccatcaaaggctccagccatcgcaacttgtttttgaatttgtggaagattatggttgccggcattagcaagcagaaaatacataactgccatgtttcccatggagtgtgcttcaatatttacctttttaaaatgatatttagcttgcagttcttcaagaacgttcttaacccattgtccttgtaattcataatttgtgctatggttatcattgaaattgaccatcacgagcggattgacggcgttatgaggaatatctcctttaagagtaacggttccatcgccagcaacatctgcggtgataactgtctttgacacacttgctttcacaaaaccatttaccatatattcttctgcatgggcaccgcttccgtagccatggaaaaagagggtgggggtagtagaatgaatatatttatttgagagatctgcatgaactggatttgctgctagtccataaatgaatattaggaaaaatgcagtaaatattgttaaagtaaatttaataaatttgatcatatagaagccttctttttctttttagtgctatcatagcatattgaaggggcatcttttaatagttaacagttgtatttaaaacgtaaaatatgttacagtattagggttgctaaacgaataacacatctaattaatgtaatgagaagggaaggtaatacgatgcaaatcaaacaagccaaaatggatgatttaaatcaaattatggaaattctgcgagatggtcgaaaccaattagctgaacaagggatcgatcaatggcaaggagattacccgaacgaagaacatatcaaagaagatattgaaaaaggatttgcataccttgtacaatcacaagatgatgaaactgttggtgcattatcaattgttgaagcaccagatcactcatatgatgaacttgacggtgattggttaattgacactgatcgttatgttgttattcaccgtgtggcaattcactccaatcatgctggaaaaggatatgcctcagcattattcactagtgtaattgattacattaagaataatcggaaggatattaagactattcggatcgatactcatgaagacaacaagatcatgcaacacttgatcgacaaaaatggctttactaaagttggtgaacttcacggggtttaccgtccagaagaaaattcatatgtttacgccttattaacaggtaattaaacactaaaatagcgggagactagggattcctaatctctcgctattttttaaattaatttttgaaactatgaattggggcgggaataagtccaccacggttaatcattgcggtacttgcggctttattgactgccattacaggggcatatcctaatagaccaccgaattcaaccgtatcaccaacttttttgccgggtgcgggaatcacgcggacagcagtggttttattattaatcattccaatcgccgcttcatcagcaatcattgcgctaatggtttcttttggcgtgtcacctggaattgcaatcatatcaagaccaacggaacaaactgcagtcattgcttctaatttagagatatttagcgttccagcgttaactgccttaatcatgccagcatcttcagagacggggatgaatgcgcctgataaaccaccaacatgactgcaggccataataccgccttttttcacggcatcgtttaacatagctagagcagcggtggttccatgagttccaacctgagcaacgccgatttcttctagaacttcggcaacggaatcaccagcggcagcagttggtgcgagggaaaggtccacgatcccaaattgaacgcccagtctttcagctgcaacagttcctactaattgacccattcgtgtcactttaaaggcagttttcttgatcgtttcagcaacgacatccattgattcgcccttaactttttctagggcggttttgataactccaggtcctgaaacaccaacatttattactacatctggttcaccaacaccatgaaatccgcccgccatgaagggattatcttcaacagcattacaaaagataactagtttagcatttgtcatcatatcaagctttgaaccagcgacgactacttcacccatttgtgcaacggcatccatattgatcccgctacgagtagagccaacatttactgatgcacaaacaaaatcagtttccgccaatgcttcagggagggaagcgattaacgtacggtcaccagtttggtaccccttttgaaccagcgcactgtacccgccgataaaatcaatccctaatgttttggcagctttgtctaaggttttagcatatttaacatagtcgtggtcttgagaagcagcggcaatgagggaaataggagtaacagttactcgcttgttagcaattggaatcccatattcggcttcaatttgttggccgactttaacaaggttctttgcttttgtcgtaattttgtcatagatcttttgacatgcaaccgtactatcactatcgatacaatcaagcaaagaaattcccatcgtgattgtccgcacatcgaggttttcattagaaatcatgtggctggtttcataaatttgttgtgaattcattaagtgatattcctcctgtatatcttaaagattatgcatggcatcgtaaattttggcatttctaaggttaatttcaacgccaatctctttaccaagttctgtaagttcattagttaattgataactatcaagattttcagggatcatcacagacatcatcattacgaaattgccatccataattgtttgggaaacatctagaatattaatttgtttttgggcaagaagggcacttaccttagcgataattccaacttggtcttcacctagaacagatacaacagctttcattaaagaatcctctctttcttttaatgattttaattatagtataataatatgaacatttctagaaaattttagctaataaaaaaggcatcactcgtttagaggtgccctttatggtaaaagatatgaaattggttggatcaaaatgcgcccggcttaccaatatagtcatctacaccgtccggatttcctgaccacttgaacttatcataccagatagaatgcttttcttgatctaacttgtcgatttgcttcatttcatccggtgatagggtaaagtcaaaaatttcggcattttcttgcatacgttgaggatgagtagtcttggtaagaactataaagccttgctgaatttcccagcgaagaattacttgggcaggactctttttgtgctcgtctgcgatttgcttaataacatcattggaaagaagacgaccattacctagtggcgaccaggcttcaagctgaatattattttctcgacaaaactttacaatcttaggctggtgaatcaggggattgaattcaatttgattaattgctggtttaattttggcgtgatcgagcaaatcagtcattcgttcaacattaaaattgcaaacaccaattgattttgcttgaccgtccttgtaaatctcttctaacgcgcgccagctttcattgtatttatcattaactggccaatgaagaaggagaaggtcgacatagtttgtttgtaacttttttaattgctcattcactgcttgccgaagtttatcataatctccttgatcaccattgaaaattttagtggtaagaaagatgctatcacgttcacggccagtagccttgaaaccatcttgaatgccttgtccgacggctgcttcattcccatattgtttagcagtatcgattaagacgtaatcattcataacagcctctttaaccatttgctgtgtttccgcaagtgaggctttccagactcctaagccaagttgggggatgaggtgaccgttgtttaattttatctttggttgtagattttgattcattttaattaaattcccctttctaaatcagttataacattaaatactttaggatccttgaatttgctcgttaacaaactgaagaaatttttcgattgctggagataagatggtatttttgcgccaggcaaggacatcccctgtcgatttgttaggtacaaggggaacaaaaacaaggtcaggatcatgaaaattattatagacgcccttaattgtcagaccatagtaattactatttcttaaaagtgaaacggtatttccaggtaaactagttgtcgcacggatatttaaacgcgtttgatctaattttaagatatcactaacttcatcgcgaacaatactacattggggaagaattaagggaattttgtaaagatcttctttggtgatagtagaatacttggcaagtggggccgattttttcatcattactccccattcttcacggaccggtaattcgagaaagttatatttagcagcttcaacgggttcaaggaggcatacaaggtcattgagcccttcatctagttgacgccgaaggacatcgccatccccatcagataaattaaagattacgttcgggtaaagcttttgaaattcaaaaattattttcgttatataaggagagacactcgaaactgctgagccgagattaatttctcctgttaatgcctcttcttgttgatgaaggtcgttttcagtttgatccaagagttgtagcatggtcgttgctcgctgttgaaataagattccagcttttgtgagctgaaggcgccggttttctcggttaaacaactttatgtctaattcggtttctaggtccatgatttgccgggaaagggtaggctgggtaatatgtaattgttccgcagctttagtgatattattagtttgtgcaacagttaaaaagtattttaatacacgtgtatccatatggtatccctcatttttatttatattaaggagttattgataatggcaattttatattattcgcaattcggagacactgctagactcgctagtaagattcatgaagcaactggtgccgatattgtgagaattaaagttcccgatgatacttttccactggatatggaagaaactggaagaatttatcagcaacagcttaagacacatgccttccctaaactagtgaccaccttaccagacttatcgtattacgatttgattttagttggtggaccagtctggaatggcggagttgtctcaccaatcattgacttacttcaacaaattcaaaaattcactggtaagattgcgccgtttagtacaggttggagtaacactggtgattaccaagaggacttcatcaactatgctggtaagttaaatgtcactcccggctaccatattcttactcatggtagtccagctttcaatgaaaagtcattattttcatggttgcgaaaattataattcattttttgaataactcaccatttataataagatttttacattcttaatgctagagtttattattaaaccaacaattaattggatgttagtaataatggctaagaatgaatacgaaataaaaaatgacctttttggttttggtgataagaacgttgcatttgcaaaatactttattggaacaagttatctcaatgggttagtatctcctgatgataacattgatgtaaatgtttcaaacgttaattttgagcccggttgccgtaacaactggcatattcaccatgatggtttccaaatcttattagtaactgctggtgagggttggtatcaagaagaaggcaagccggcgcaattgttaaaacccggtgatgttgtagcaattcatgaaggtgtaaagcactggcatggagctactaaagatagttggttctctcatattgctattacgaagggaactagcgaatggtgcgaagaagtagatgacgctactcacagccgcctttctgattagttaattagtcagcttcctttgtcctcgtcctcaactttgatatactaggtaaagtttgaggaggagattacatggaaagctggctttttttagctttagtattattaattgcaatctttggtcataactcgtcattgattattgccacagtagtagtaatggttttgaaactgatcccttataccgccaagtggttgcccctgatacagcataaaggaattaattggggtgtaacagtgatttcagttgcgatcttgattccaattgcgacggggcaaattggttttgatgatttatgggcggcttttaagacccctgctggttggattgcagtcggcatgggtattgcagttgccatcttatcgaagtatggagtcaaccagttggcagctgttcctcaagtcacggttgccttagtacttggaacgattattggagtagttgcgtttaagggaattgctgccggtccagttatcgcgagtgggatgacctattgtattgtaacgctattgaatttgcatttttaaatagcaaaaaaccaagcgaggtcaaaagggatcttacttggtttttgttttacgcattttctaattgcgcttgcgaagaaattttatggtatagcttagtgctaaggtatagcgaagttaatagcaggcataagcatagaaggaagccggcttgaataccgaggtgtgaggacgggttgtgaactaagtgattaacaataccaacaattgaaacgatgagggcagttccaaaggcagccgcaatttgtcgtaacgtattaaaggtagcaactgcatcaggaacgatctcattaggtagcaatgataatgcttgtgtttgcagaggtattaacattgtcactaatccaaactggcgaattgtttggaaaagagtgatcatgaggacagaactacgcgcaccgattgcggcttgaccgattgttccgatgatatcgattatgagaccagtcccaacgagaatcttaattggataaatgtcataaaagcggccactcgttgtcgatagtaaacccgttaagattgcccccggaaggacagcgatggctgaaataaccgtacttttgcccaagacaatctgtacgagcaggggaatcaaaattgcattaccgtacattgttgatgtaattagcatattaataacagtggcaaaaacaaattgtttgtgggagaagatcctaaagttgattaactgacgcttactgtgacgttggttaagaaagaaaaggaagagaaagactaagccgataaggacataccctgcgacattaaatgaaagcaagtgactgttcgaaacatttgataagcccattaataatgaccataatccgcctgtgattaaaataagggccaatgtattaaagcggggatgttcattatgtgggattttaggaagcaggaagaatgaaagtagtaatgtaattactgcaaagggaataattaataggaaaaggtatcgccaagagaaaaagtgtaatagaaagccagaaatagcagggcctaagatgggggcacaattaaaggcaagaccaataattcccataatttgcccttttttacccggttttgcgtaacgaattgccaagacatttactagtggcatcatcattcctgcacccagagcttgaatcatccgagcaattacaactagattgaagctccacgcaatcgctccgataatagttcctagaagaaaaattccagagaaaataataaaaagatttttgaaagggaatctttttataaggaatgaactaacgggaatcattagggcattgacaagcatatacccgtttgttacccattgaacctgagcctcactgatatgaaagacattcataaaggttgggagagcaatgttcattaaggttgaacagagaagaccgaaaaatgtaccaaataccatgattactaatgcatggctgatgcgttgatttttcattagtagatatagcgctccttaaaattagtcaaacagtattgagtttactagccagattattaatgtcaatacacattaggaatttgcaagtaagtaaattaatgataaaatatagttacgaagaatttacatgtgtaaacgcaggaggaattagatgaatattaatttagaaataactcccgctgaatggcaaattatgcgggtagtttggagtctaaggcaaacgaccagtagccaaattattgaaattttacagaaaaaagttgactggaaaccggcaacgattaagactttacttcgacgcttggttgataaaaaagccttatctgccactcgtcaaggacgtggatttatctatgagcccttagttcccgaacagcaaacaatggaccaagcggcggacaacctatttaataatatttgtgaacgacacgttggaagcacccttgaacatgtgatcaataatgtaacccttagcaaggatgatattgctaagttacaagaattattggcaagcaaagcaactaattcgccggaccacgtcaaatgtaactgcattcctgatatgcagatgaactgctaatgaaaaggctccctgcaactaggaaatctttcctaaattgcggcgagcctttttaatatctatttttccttgctttgatcctcatcagctaatggcttcttctttctaggcttaatgtaaactaccttgaatttattaacataggcattcttcaaatcaagaggtgtgaatgagaaattatcgactctaattggttggccaacttttaagtcatactgccgttcaaggaaaaacccagttaaggttgttacttcagagttgtcaaattgctcgatgtttgtatcaaagtaacgttcaaaatcatctagtggcatcttacctgaaacttcgaaggtaggattacccttgctatcaggatccttcttttcaatcatatcagaggtagcatgatcaatttcttcgccaactgttccgaataattcttcataaatatccttatcagtaatgatcccagaagtaccaccgtattcgtcttggacaacgacaattggcacttgttttttcatcatctcagcaaggacattggtaagttgttcattttcgtaaacgattggaattcggcgcatgattgtgcgaactgattgttgcggattgatttggttttgccgcataatatcatatgcaaaaatataaccaagaatgtggtctttgtcattattagcaacaactggaaaacgcgtgaattttttttcgaaataaagtttagctgcatcttcaattgaagccgtaatatcaataaccgctaactgtgtccgatcaatcataatatcctcagcaactttatcattcatttcaaaagcccgttgcatgaagataacatcttctttatccatttccccagctttttccgattgttgggataaggtcataatttcattttgtgaatatgtgtcttcttctggctgaacattgtatcctaacattttcgtaattgccgcagcgactaccgcaaataaccaaacgaagggataaaaaacagtatggaagaattgtaccgggtgaacaattgataagagaattggtaccggtcgatcaatcgccatatttttcggaactaagtcagtaaataccgcgtggaagaatgtaaaaattaaaacaccgataactggtgcaatcgcttgaagaacatcgtgcggaataatattaatctttagcaatagatctgtgataaattcatcacctaaccaacctaaaactaaagaagtcatcgtaacaccgacttgagctgttgataggtactcattaagatttgctaccatgtgttccgcacgtttgacttttcgcgtttgccggagctcctttaactcactaggccgcactttaacaactgaatactccagcagtgtaaataaagcagctaacagcagaattaaaataatgataattaatttaaaccaatatgaatcccataaaccattcatcgtttaaaaatttcacctaaactttcttaaaaaatttatcgactactattgtatcagtaaaatgtagtgaaaggggagtttaattatttttttataagtgaaaatgctaaaataaaggaaaataagtaggagaagacacatgacgactaatgaagaagaaatcaagaagtcagcacgcttgcgtaagattatgcaagtgatgcgaaaatatcattttgttagcaatttttaccatcaaactaatccacaagctatttgtcaggcactgcaagaactgggaccgacctttattaaacttggtcaaatattatcaacccgtccagaccttgtctccccagcatatattaaagaacttcgccacttgcaagatcaggttaaagctgatagctttgcgaccgtagagcaaacttttgaagaagaaactgggaagaaaattaatgacgaatttgctagctttgcggaaaaaccttttgcttctgcgtcgattgggcaagttcaccatgcaacgcttaaggatgggacaccggttgttgtcaaagttcaacatccagaagtcggtaagcttgttaatactgatttagccttgttacggaaagcagtggtcttatttaagtatgttccccaagacattgcagtagttgatttggataaagtaattgatgaactcagtacttcattattaagtgaggtcaatactcttgaagaagcaaaaaatggggaagaattttatacattaaataatggtgacggacctatcttagttcctaaagtatatatgaagtattgtgctcctaagattcttgttaatgaagcgatggaaggggaaagcattcgatatcggtttaagcagccgaatgataatgatcaagaggcaacgaccgttaatcatgaaattgctactacgctcgttaataactttttaaaacaagtttttgttgatcattactttcatgcggatccgcatccaggaaatatattaattcacgaattacgtccggatgaatcagcaaagcaatacgcaacgaccaaacaccatgaaaagaccatttataatacaaccattagttatgatcaacaggaggcattaccaaattaccggatcatctaccttgattttggaatgatgggaaggttaagtccagcgatggcaaatagtattgcgaatattgtgattactatcaacacaaaggatacgcgaaaaattggaaaagcagttttaaatgtttgtaatcgaaccggggaagttgacgaaaatgcattttataaagaacttggcgcctttatgcaaccctatttttcaaccggccttggcaatattgatttcgtgaaaatgctataccaaattgtccagctatgtaagaaaaaccaccttcaaatgaggggagaggtaacgatgctaattaaggcatttggaactcttgaaaactcggttgctaaacttgatcctgaaatatcaatgcttgaggttgcccaatcgtttggccggcgttatttaaaacgaaactttaattggcgttctgcccttgataataacctagtcaattttttccttgctagcaaagcaatggggaagatgccagaaagaattaatgaattgatcgatacatttgtaagtggggatgccaaagttgatctacagtataaaaatgagcaacgagtgctaaagcagatagaacggttaatgaaccgtttcatgattgcaattattttagcagcagtcatcttaggatcatcattattagtccagggaacaccagctgattcacatatctatcgtttaggagtatctggctatattattgcaatcataattattattcttttagttgttacggagattatccatcgatggcgaaattggcgaagaaaacgatgattaatgatatatttaaacttagttgatgaattaatatgtgtgttatgctggggaattacgattaggcttattttgattcgtcatttaaatagtgaaaccaaggtggccagattcaatacgtttgcgtttgttttgatgttgctcaacttgatagtagtgttgcctatttttgcttttttgcttaaaaatttaccgattcaatcagtaagttggctaagttcattagtagtagcaactattgacgttttaagtacctttaacttaattttattttgtgttttcagttgttgtacccgcctgcgaaaatgtcctgctacggttcagggctttctggttttaggggcagctgttaaacatggccaagtcccgccagtgttagctactcgccttgataaagccattaattgttggaaaactcatcaatctgcaaaaattattgtttctgggggaatagtacagaaagcaaaagaatctgaagcagaagtcatggctgcttacttaattgctcacggaatcccagcaagaaaaataattcgcgaaaacaaggcacttaatacatggcaaaatttagccttcgctagtcaactcattaagccgcaagagacggttgtagtagtaactagtgattttcatgttcttcgtgcgagagcttatgcaaggaggatggggttaaactggtcattcattagtagcaagactccttggcgatactgtccattaacttttattcgtgactatctcgggattatccgtgaccattggtgggtattttgcggtagcacgctctttttacttttagttgaatttattttcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtttgaaaatgaaatatgagcgagacagaagtggaaaacaaccttctctcgctcatatttactttatttattcttatatactgcaatttcaatcagattattatctggatcataaacgtaaagcgaggtcatttcgccttccgccccttgttttacaattggtccagcaattatatcaatataatagctattaagatggtgaacaatatcgtcaatactatctccggcaactaaacataagtcagcagaaccaattgtcggatcagctgcctttaaagtagttggtcggtcaattttttgtaaacggattaactgatgcccacaccgcattgtaattaagtcgtcattactttgttctttaatcaccggcatatcaaatacttcgtgataaaagcgcattgattgctctaaatcagttacagttaaaacaacgtgatcaattcgtcgcattttcattatctaagtctcccttaaatttttaaatcaatatcattatacaagtttctaaattgaaatagcaaaagttgtataatgaaatgattgcagatctaaggagattttttatgaatataaaaacaataatgagtgtctcgattggcggcttcctcggcggaattacccgttatgaacttagtgtcctattaggcggcgatgggattttatatgccaaccttattggttcatttttgttagcttttataacttattattttattgagcggggactattagcagcatggctaaatgccgggataggaactggttttattggcgcttttacgacattttcaagtttagccacaactattgttaagcttgaaaaccaaggtataattgctagcatcggttattttcttgtgagctctcttggcggcttggctttggcactgctcggttttatgttggcacgaaaatacggaggttcgcggcaagatgattaatgtagggcttggagcagcaattggggctgtgatccgttatatcatcacaagctggtggaaaaagttaagaattgattggcccctagcaactctgtttattaatatcaccggtagttttttattaggcattcttaccaaaaattttgctagtaattcatcgctcatgctattatttgggattggcctattaggaggttacactactttttcgacttttaacgttgaactaatttcaatgatggatgaaaggcgatggggaatgttcgctgtttattttggcttaagttatcttggtggagttattgccaccatctgtggaatgatgatatgaaaggagtaaaaaatagtgacagaaaccagactaccaacgcaaattgaagtaaaaggtggaagagtccacaaccttaagaacattgatatcaatatccccctacataaatttgtcgcaatttcgggattatctggttctgggaaaagctcattagcgatggggattttatatgaagagggatctcgacgctacttagaagcgctttctacttacacaagacggcggataaagttaggtgctcaagccgatgttacaagtgttaaacatattccttcagcactagcattgaagcaacgtcccgcaattccatctgaacgagcaaccgttggaacaatgagtgagatgttgaacgtaattaggctgatcttttcgcggcttggcgaaccggtctgtccaaatgggcatcgtttaaaaccaagccttgaaatcgcagaggtaatgagtaagagcggcgatgaaatgggacaattaacctgtcctacttgcggcacaaagttttatgcctatggagcagaagactttgcattcaattctgacggagcctgcttacgatgtcatggaacaggaaaagttcgtgaactggatgaaagtaaacttattggggatgaaaatcttagtttagctgatggggcagttgcttcatggcatttgcctggacgaaactttatgccgagtgttgctgaacaggccggtgttcgaatccatgttccatataaagatttaacccctaaagaaaaagattttgttttaaatggtccacaaaagaagtttaagatggacttccgctctggaacaggccgtgtttttcatgactttaatgctttatatgagaacgctcatgaagcggtattagcatctgccaaaagcagtaaaagcgaacgagcacaaaaacgaattagcgaatttttccattattcaacgtgcccagtttgccatggaacacggttaaagccagaattattaaaacaattagctggtggtttaaatattgcgcaagttagtgaccttacgcttggagagttgagcaagtggaagcaagatgttttagctgctcttccttcagatatgaaaaagatggcgacctcattatttaaagagtttgatgataatttacgaccattactggaattaggccttgattatttaactttatcgcgaaacggaaatacgttatcgacaggtgaattacaacgtattcagcttgcaagaactcttcgaacccaaacaactggtgtcttatatattctggatgaaccttccatcggcttacatcctgataatattacaggcctcttaaatgtatttaaggaattagtggcccaaggtaattcattagtagttgttgatcacaatgttgatattatcaaagaagcagattggattattgaaatcggcccgggttctggagaaaaaggtggagaaattcttacggagggaacaccatcgcaaatcgctgacaaccctcagtctaaaattggtccttatttaaatgggacagcagtattaaaaagtcgccccatagcaaacgaaccagctagtcaagagattacctttgaagtaaaagattattacaatcttaaagacgtctatggagagattccggttaatcggctgactgctatcactggtttttcgggtgctggtaaaacaagtctgatccttgatagtttagttcctgctatccatgctcaagcaagtggggctaaattaccttcgcaagttcgaaaattgtcaagtccgttaaaagaagtagtaagtgttgatgcagcgccaatcggtaaaactaaccgttcaacagtcgcaacttataccagtattatggataatctgcggaagttatttgcagcccagcccttagccaaagagaaacactatacaccttcttacttttcttataataataagcagggagcatgtccaacgtgtgggggcgcgggggtcgtaactcttgatattcaattcttgccagatatgcaacagacttgtccaacatgtgggggaagtcgatacaatgaagaagttcaaaaagttaagtggcagggatattcaattgttgatctcttaaaattagatgttcgggcagcgatgagtgtatttaaggaagttccgaaaattgctcgtgaacttcaattattagatgaagtaggcctaggatacctgcacttaggcgaaagtacgcctagtctttctggcggtgaggcgcaacgcttaaaacttgttaaacaccttaatcataatcaaagtgaaacgttatttgtatttgatgaaccgactattggcttgcatccccttgatgttaaaacccttttagcggtaatgcagcaattacttgatcggggagcgacaatcattactattactcatgacttaaatttgattattaacgcagattatatgcttgatatgggtccgcgcggtggcagcaatggtggggaaattgtggctcagggtaatccgttagcccttattcaaaaaccagaaagtttaaccagcaagtatttggcagaatattggtcaagatttaattaaagataaaggctccaaacattcggatttgccggacgtttggagccttgtttttaatcaagttaattattttgttgctgctttttcttcatggttttgccagattttgcgaacgagtaaataacagccaattagaattaaaatagcgattgcgacaccgatcagtcgtctaatgttgcctttgaaaatagcatccccaccaaaggcatagagaaaggaggtcggtgccattcctacggttaccatcgccaagtagcgtttccaactcacatttaaacgggcaccagcgtagtttacaagtacactagggataaccggaatcataaagccgattgtaagtgcaattaacggatgcttttgctgcaagaggtaatgaaggatcttacttttctttacccgtttggagaggttaattttacgaattatactcattacagtagagtttcctaaaatgtttccaacccaattaatcagaaaaccaacaattggtccataacataacccagcaaagatacaaacaacggaattcgacattcccggaatcgcatttaggataccgattaaagctacaagaagaaagatatctgtaaaaccatgacttctaatcatatggagaagcttagccttattatgggcattaaagtctagtagtaggtcaatttctggcttatatgttcgataaatgaagtagagaacgatgacggcgaggataattgcgccaacgatcagccatgttttacttaatttacgctctttcatgattattgttcctcctttggtagcgtaaacccagccttctcaaaaagggaggtaagagaatgtcgtaaaagcggatcatgagcgtaaagataagttccatatacaccacgtttaaataaaacgttcaaagaattcataatcattcttttttctaaactcttaatttcagctggatcagttaggtcgtcacgttttttgaatgcttcaacatctgtataacgatctaaatttacttgaagttggtttgtttgaggtgtttggctaattggcggaccgataataatgccggtgtaatttaagtcaaacccttggcaggtgtagattgagccaacttcaccaatggtttgaggcaattctgcccagggggtgactgtatagttatattgatcccagggcattttaaatctgccttcctcaatgtaatgtttaccaccatcgagtgttgatggatatccagatgttgaaagaatgcgggaaagtcctacttctttattacgttgaacaattgctttcctcatttcctcagcatcactgtaaatgcgaaaatcataatgatcacgggcggatgctggtaaagcggttaatttatagttagtaaattcattaaaccacttaactaattcatcgctcgcattcatgcgaaacatgtgggtcaaatggtaatctttatggggatattggtttgtaattgcctgaagtcgttcaggggtccagagacttttcatccgtaagacttggtattgatcaaagacaattataacaactttagcacgtttaataatctcgacaagctgattatcatggtaaaaattattataatgatcgggtttggataataaaagatgagcttcatcaataacagcaacatcaatggtttggttttgcttatccaattgattaattaatgaagttggccgagcgaagtcctttttatataactcttttatcggcccagcaatctctttatagactttcagaatttctggatggttaacaagaaaataattattagtatgataaagaacggaattttgttgtgtccgcgcttctttttgaatgtgaacgaataattgtgataagattacgctttttccagtcccagcatctccgtagactgtatatattgcaggatgattttgtgttagatggtgtttagtaaatgaaataatatcattgacgagttgttcttgctctgtcgttaattttttaaatggtgaaattttgttagttgcagcgttgtctatatttttcataattatttcccttttaacgaattactctatttaatggtatcgaaatgcatgaatttcgtcaatttgaacttgagagtaatttactcaatgctttagaaagtgttagaataataagagcattaagtattactaattattaaatgtaaaatcaagaaggagtggaatagatgaatctgcatcctgattacctcttaaatgaagttaatgaaccaagcgatattaaggacatgtcacttgacgaattaaaacaattagcaacagaaatgcgtcaacttgttcttgaacgtgacgcaaaaattggtggacacgtgggccctaatcttggcgtaatggagctaacaattgcttttcactatgtctttgattcgccccatgataaagttatttgggatgtttcacaccagagctatgctcataaaatgctgacaggtcgaaagttaggttttcttgatccggatcattatgaagatattaccggatttacgtcaccagaagaaagcgctcatgacttttttgaaatcggccatacttcaacatcaatctcacttgcagtggggatggctcaagcgcgtgatttaatgaagccgcaatcacataataacgttatggcagtaattggggatggatccttaagtggcggattagcttttgaaggattaaacaatgctgctaagcttaattctaacttgattattctcgttaatgataatcaaatgtcaattgacgaaaatcaaggtggtctatacaagggactaaaagaactacgggataccaatggtgaatctcccaataatatttttaagtttatggggctcgattacaagtacgttgcagatggcaatgatttgcagacgatgatcgacacctttaaggaaatcaaggatattgatcatccaatcgtccttcatgttaacaccttaaaagggaaggggtatgagcctgctgttgaagaaaagatgaagtatcattggcgcactccatttgacttaaagactggtgaagataaggttaaagtaagtggagaatcatatagcgatgctgtccttgctgaattggataagcaaattgcagcggataagccagttgttgctattaatgctggaattcctggtgcgtttgatcttggcaagtttaaggctaagcacccggaccgttattatgatgttgggattgctgaacaggattcaattacgactgctgttgcaatggcgcaagcaggtgcacgccctgtcgtatttcaaaatagtactttcctgcaacgagcatatgatcaattaattcatgatatggcattaaatgatgctccggttgtaatgattgtgcgaggcgggtcaatttcagaaagctctgctactcatcaaggaacatttgatatttcaatgattagtgatttgccaaacattgaatatttagcaccaacaaacgtcgaagaaatgatttcgatgttacggtgggcaatcaatcaaactgatgaaccagtagtaattcgtcaaccagaaaagcctcttcttcacgggacgccaacacaagatgactacagtacgattaagtacgatattgctcatcgcggaagtgaggttgcaattatggctgttggtgacttctgggaacttggtgaaagggtaaggaaggaacttcaagacaagcttaacattgatgctacattgatcaatccaaagtctgtaactggaatcgattcagatgtccttcaccacctagcagaaaatcatgatgtagttgttacgctagaggatggggtccttagtgggggcttcggggaaacaattgctcgttactatggaccaaagggaatgaaagttttgaactttggagcaccacgggaatttgcggataatgttcctaccgaagtactatatgaatggtaccacttaacccctaaacaaattgtggatgatattgagcaggttatccattcactataagttaacagagctgtcatcgcaggtaaggattacttgtaggtgatagcttttttcgatttaaaaaatgcgaattgcttctctttacgtatatatattaaagagtatataaaagaggagcgagataatatgaaccatttaaaccaccttcgtgtattgcgaaacacttgcttagtaggcttaacgacagcgtcaacgatcctttcgctgtcgttaaatactccaccagttttagctacaactcaagagctaattacgcagcccgtatctaacgcaaataaccagaaggaatgtgtccaaatcaaacgtgtaatttattttcatctcttaaatgaagttaaaaaagtggaacaagtgtcttatgctcaccgtgaagtaccgaatgatccaaccaaaaaggcaatttggattattgaaccttttgaagaagttaatgtccctgaccaagccggttttagaccatcaatggataagattccaactgttacagaaatagaggatttatcacaattaaaaagcgcagtaaatgtttattatcagcccctcaataaagatgaagggccaaaaaaagacagcaaagagaatacgttagcagaaaagcaaaaggaggggcaagcaaaggagaataaaaaagaggaaaagcaagattcacaggacaattaccccatgaaagaaggtctgggggatgataatcaggtcacggaaaattatgaggaggtaaataatacaagaaagcagcaaaatgtgcaccaacggatagcaggtattaataatcgactaaatcgttcacatcgggattcacgtaaaaacgataattctgaccagcaaatacttccacagacaggaaatgagactgataatttaacgacttttcttggcttgggaataacggtaacggtcgcggggatgagtcttttttcgctaaatagagcgcacaaaaagaaataaaacaaaaaaacttgataaaaggacttgcatttttaattttctaatagtattctaatgttattgaaaaacgaaatggaggaaactaaaatgcaaatttacaataaatcgattattcatcacctaacctccacctcaaccacaacaacaattaccgtggttgagtagttttaatatctcttaaatctgttagcaatagctattcaagatgtctcaaccacttatcaaaaattgacaagggttggctagggacattttgggtagcttttttatttaaagtgaggttagaatgatggataatcagaaaaatgaagttaaattaaatcggacaatgactcccggacaaatggaaatgattgcaattggtgggacaattggtagtggtcttttcatgggagccacatcaactattaaatggactggtccttctgtcctattagcatatgcctttgtaggtttagtcctgtatggtgttatgcgtgcgttaggggaaatgatctatatcagtccaggaactggttcctttgcggactatgggtctaaatatattcatcccttagctggatacctgacaaagtggagtaatgtctttcagtttatcattgttggtatctcggatattatcgccatgagtcaataccttaattattggtggcctaacttgccagactggatttctgggttagtaatgatcattatcttaactcttgcgaaccttgcatctgctaaggcatatggccggttggaattctggtttgcgatgattaaagttgttacaattattgttatgatcattcttggattgttagtaattgtccttgggttgggtaacaattggcatccggttggaatttccaatttatggtcacatggtggattctttactggtggattcatgggattcatgttctcactatctgtgattgctggatcctatcaaggaattgaattacttggtattactgctggtgaagcggcctcaccacgccatgcaattgttaagtcagttaaatctgttatttggcggattttaattttctatattggggcaattttcgttatcgtttccatttatccatgggacgaattaaaagcagttggatcaccattcgttgagacatttactaaagttggtattactggagcagctggaatcattaactttgttgttttgactgctgcattgtccggtgccaactcaggaatctatagtgctagtcggatgcttttcaagctttcagttggtggtgaggttcctaaggtctttagtaaattgtcaaagcgggttgtaccaaatgttgcgatcttaacaatttcattctggattttccttggctttattgttaacatgcttctatcaatgtttaatgcagcctctgctaatatcttcgtgattgtatatagttcaagtgtccttcccggaatggtaccatggtttattattttgatttcagaattaaacttccggcgtaataatccggctgaattaaaggatcacccattcaagatgccattttatccagcatataactactttagcttgattgcgctaagtgttatcttactatttatgttctttaacccagatacacggatttcagtcagtgttggggcagtcttcttagttattatgagcattatctacaagttaagaactcagcgccaagataaattagcataaagaataagtactctcgaaacagattgttttgggagtattttcttttatcaattaaaatgataaaatacttttacgaacatacgtttaagaggaaaggtattttagaaacatgcgatttcgattcaataaaaagactcagtatttacttttagctttagtagcagttctcggcattggtagtttttcccagccatctgacaagggaagtaccttaccacagggaatccaacgggtagcatcttggcgccattccagcaataataatcgatcatcttcttttacgccgccaacccaagagcaggctacgggtgttctttctaatggtgtccgtcagcagttaggaacatctgacataaaatggaatggttacggagcgtttattttaaataacaatcagacggcactaaacgcaaatattaataatgcgccatacgctgttaatcgacgtgattcgcgtggacgagcatggcagggagacgcctggctcaatcgtacaacacgccaataccgtaatcggaatgaaactgggaatggagccactaattggaagccagctggatttttacaagcccataacttaaaaggtggtatctcacatgcttatgatcgcggacacttactaggatatgcattagtaggtggtatccgtggttttgatgcttcagagtcaaatcccgctaatattgcaactcaaactgcttgggccaacgaagctcgaagcagtacatcaaccgggcagaactactatgaaggcttagtgcgaaaagctctggatcaaaataaacaagttcgttatcgggtaactgacgtatatgatggtaataatttagtgccttcgggtgcccatattgaggccaagtcaaaggatggcagtttgcaatacaatgtattcgtgcccaatgtgcaaaacaatattagtataaattatgcaacaggggcagtaacgcaagtgaacacgaattaaaaaactatgtaattagaataatccctcaatacttcatttgattaaagtattgggggttctttatcatctgcatataaaactagcgtagaaacaaaatatttcgatggtcacttgcaaaattggtttaaataaacgaaaataaaaagagttaatattgtttagaaaaggactacgccaatgacagatttagatctaaaaaagattcatattgtttttaatggtcaggatactccaccattaaagattagccagctttttgatgctaataagttcaatcgtttaacagcagttactggtaacgtgactgccgactttattaatcagtatctaagtcgattcattaaagtcgaagttgcactgagcagccctgaaaattatgaagctaaaactggtgatgaagtgatcactaaggtagctttaaccaatgcattgctatctgctgctaataaaaagcctgctaaagtctttgaagcattaactagtgacaatcaagcaaatgtgttgaacaatctttttcaagttgcaattgcaccaactcaggctatccattcacgtttttacctcctaagtaattccgagactcatgatactcgtgtgattttgggaagtcttaacttggacagtgcttcatttgataaagagcgtaaccaatatgaagaaatattagtctttgatgatgacattcggctatttcaaaatcttgataaccactataagaatgacatcaagccagtattacgaccattttttactgaaaatcttttaaatgcagcacaaaatcaaattgatgagagcttgaaagatactaaaggaactaagaatgcggttgtaattcttgataatgaagttaccgatcaaatcgcagcggcagatatgaccgacttgattagtcatgacgttcaaaaacaaattgatgaaaataaaattcccgcaatgattactaagtcgatgcgagatattacgactaaccgctctcaagataaagaagaagcagaacgacaaattcaacaacacgatacaatttacactttgcaaaaaacagctgtatcgccacgagcagctaagccaaaattgaaatcgcgcgaaaagatttttaaacaagttcaggatgcattgattagcggtatgacaccacaacaacggtcagcagagaagaagtatacaacgttcttatatgatcgtccgatggaaagaaatctggttaacaataatagtggcctgtacgtaccgaatgatacaggcacgcacccaattcaatttggaaagattgcgactattagtcaaattcgtgatggcttaaagagtattgatgcagtattaaaagggtatcagcaatacgttgttgactacaatgatgattatggtaagcgattctatgaagctattttatatagttttacggcaccatttttatgggaaattcgtgcgaaagctagtttgaatcctgaagatgggaatgatattcctaacttcttgattctaggagcaactgctggttctggaaagtcaaccctattacggattattaatcaattgacatggaacactgatcggtcattaattgattttgggactatctatcctacagatacaccgcagaaaaaagcaaaaactgttgatgcaattgagcactacatgaagcttggaagttcataccccgttttaatggatgagattgaaccatactttttccaacaagatcaatatagtcggcacttagttgttgatacgatgaatgaattggtcaacaatccacatgcaattgcgccattaatcggaacaactaactatgattctggttttactatgctacgtgaaactgcacggcgaacttattatctccaaattgataaggttatcgatgaccagcaaaaaggtgaagccaataaatatatctataatgtacgacaaaccttaaataatacgctgtttaaggactttgtaatgcggatggcaagcttactagaggacgatgaaacgccatggcgcgcattcgatgaaaagactggtaagcttgacttcttagcaaatacccgtaagattttccgcgattactatcaaatggcggatatggaagtacctccttactttgcggatgaaatctgtgatgactttaaggaaagttcgcgtaaccggtgggctaaactttacctaacacaggaagaagactttaaataccggcaacaagatcatagcttgttatttgatatctcgaagcttaatactttcaatggttttactgccgatagtattgaaaagtaccggaatgcactgccaattgaactctgtgtggatggtatcaatggcaagcgtggcaaatttgtggaaattaaagctgatgaattctttaaatggattggtgaacgcaacccatatgctgaagatactgcggaaaacgaagcaaataatgaagaaacgttaactacgaatacagctgaaaaagttacggaatcgcctgttaaagaacaaaagaagggattctgggcacgattatttggctaatataaaaaggtctgggacgcaaatagcattcaagacctttttatttactattaattttttgtgccttttgtttcggataatgtttcagattttcaagccgatttaccaagggttttgcatattttatgtagagtggattacgaaggagccagttatgaaaacgtggtgaaattttagtgatacaccatattgtgaggaggaagaatggaacctgcggaattacagggaggagcatcccaattatcccaccaacgaatgaaatgctccctaacaagatccatccaagttttaatactaattttaagatcattaaaagttcctcctttctttcatactatcgttattattattctatcatgagcgtatgaaaaaagggtggggagctgcttaagtttttattacatttaagttaaggagagaaataaattgacattttatacaattagctatttatcaaaccaccaacatatgaatcaactattcaattatattgctattatcatctttatccttctgattgcagtaatggcatttttatatttacggcatcgccttattacccgttatcgtgatttaggaataattttctttttgctattgttactttttattggttttcaagttaccgatatggaaaaaagtaccacacagcaatcccaaacaactcagatgattccctttattaaggcagttgctcgggatcataatgtttctccacaaaaagtagttgttaattccacaactttaacggatggaattcttgttcgaattgaggatcgggattaccgtgtcaatttaagtcaaacgagagataattatacccttacacgagcacatgttgttaatcatcaggttaatttaatgaagtaggagagaagaatggatacttattcgttaatcattataaagtttgtccttggtatgctatgtttgattctgcagattaatttattggggaaagggaatcttgcgccaacatccgccattgatcaagttcaaaattatgttttaggtggtattattggcggaattatctacaatagtgatatttctgttcttgagtttataatggtccttttgatttggacattaattgtatttattgtgaaatttgctaaagatcataatatttgggtaagaagaattatcgatgggcgcccgcaaatattaattcagaacggaaaattattagtagagaattgtatgcgtgcaggaatcagtgctaatgaccttatgttccgtcttcgtggtcacggaatttatgaagttgctaaggtcaagagtggaattttagaacaaaatggtcaacttgtaatcatcgaaaatgatgaagcaaatgttcgcttcccactaattaatgatggacagatcaatattgacgtaatggaattgatccatcatgatgaacagtgggtatttgaacaaatccataaagcaggatatggcagtgttgatgatatctatcttggcgaatatattaatggcaaattaactttaataccatatccaaaagcttaaaagaccatcctctttataattttcaagcgtataataagagtaaaatacaaaatgaaatgataagaagatgatttgatgaaaaaatctttaaaaattgccggaattagtattggtagcctaattcttcttgcttttggtattcagggtttcttactacgaggaacacctggacaacccttatcaccacaaaattaccaagataaaatagagtattcttctgttcctacgttacttattcctggttggggcggaagtacggttacttataataagatgattaagtactatcagcagaaaaacattgcacaaaaagttttaatgatctgggttgcccctaacagacgtatctggactgaaggagactttcatgggcaaaagaatgccttaattcaagttttatttgcttggaactataatggtacttaccatccacaaatcaagcaactgacgactgttttgaactatttgcagaaacactaccatatgcagaaaattaatgttgttgcccactcatatggaggcacagaattcattcatgcttatatgggttcaaaatatcttcaagatcatatgcggttaaataaagtagtctttttaggggtaccagttgaagaaagtcttagcgatcagttaaaatatcgctatcatttagttaataaatcgacagacaagaattttcaccaattatttttagagatgaaaaattggcaattaaattatccagttgaaatttataatttaatgggtagtgaagaaggcagtaaaacaactgatggagctgttcctcatatccaatcggaaatgttaaaatcattaattaaagttcatccatcgattaggtatcatcaaaaagtatatccaaaaactactcattttcaattacatcgccgcacaaaaattttaaacaatatcgctaacattttatggggaaggaattaaaatgaataaagaacatggtcaagtaacaggaattatatggcgtgggccggatgacttagctatataccaacaattaaaagagtatgcagataaaaaaggtatttcagtttcaaaggcagccaagcaattaattaacacagctctcagaaaagattaaaaaatcctaattggttaagtttattattccatgatagaatcttaaatgtacaaaaattaaaggggagttcacttaatgacaaatcaaaaaagtaagacagtatatttctgtgccgggtggtttactgacaagcaaaataaagcttatgaggatgcaatgaatgcaattaaggataaccctacagtagatgtagagaattcttatgtgccattacaacaccaatataaaggattacgtgttgatgaacatccagagcttttgcaagatcgcgaatggagtacagcaacttacaatggtgatcgagtaggtgtttcaacttctgatatgcttttagcagtctacattcctgaagaagaagatgtaggaatgggtgttgaattaggaatggcacgcgcactaggtaaatatattatggtagtgattcctgatgaagactttggtaaaccaattaatttaatgagttggggaattgcagataatttcattaaaatgtcggaacttcctaattacgattttaataaaccatcttacaatttctacgatggtggagtatattaagaaaaaaagatgtgcgatttcaactcgcacatctttttttgaatactagtttacataatatctttaacggttaataaattgatattcaatctctgataatagaccagtatgattattatcgtatcttgtaactttatcagcaacttttagtaggtcatcagtagcatttttcattgcatatccataaccaacttctgataacatctcaatatcgtttgaagtatctccaaaagcaactacttgatctagagttccgttcaagtaattttcaactagtctttttaatcccaaggctttatttacgcctgccggcaggatatcaatgccataagctccactataagtcgcttgaattaagtttggaaactgctcatttaattgatttacatatccttggataatagtttgggataatttgcgtttggcccaaccaatgtttaagttataaattggctcaatgattttttgaaggtcagaaaaatatgtgtggtggggataaaaagggactggaacatcgcgatactgctcggcaaggattgtttgtgtttcgccagataaagataggatgtcagggctagggaacgtatgcttaataaaagcataaagttgttgcaacgtcgcaattgaatgagtcttgccgtatacagatttgccgtttattatcagtcgtccgccattttctgctacaaattctgttacaagtgggcacggttgaaagatcgttgacaatgcatcgtaactattcccacttgcaataataaagtgatagttttgtcgttgtaatagttcaatatctttatttaaacggttaacgtcgaatttatcattatcatctagtaaggtgccatcaacatcgatcgcaataaaacggtattttcccatttgatttcctctctgaaatattaatttgtagaagaatcttgtggcttttctacagtagttttacttttaagttgttgccttaactgtgtattttctttttgcagttggtcaatctttttttgatacttttttaattcgtccttactaacacgcgatgattgtaattcttttaattgcttattagttttgaggtgattagaaaatgatagcaagtaaataataatagccccaataagtaaacagataaagattagcagcactagtggcatttttacttgtgctccaaaaagattgactactacagttgccgtatttaatagtgcaaagatagcgattatgatcagaataacgattgaagcaatggttgtagattgctttttcatggaaaattccccctcatgttttatgtaacatatctattatattaacttaagaaatgctggtaaaggagaagggggaataaataagcgtcatatgtatttgtatttttaaataaaattgacaaattctctttatttttttaataaatgcgctaaaataggaatataaggcgtccttagtgtaatggatagcacatgagatttcggtcctcatgatccgagttcgactctcgggggacgcatttttgagaaaatatgatgaagtataaaaatcctacaatcgttgttatatcaatgattgtaggattttttagtattttagaaaagtatggaaaaatattaaaaagtacaaagtcggtacacctttggtacactagtgtaccaaactaaagttggttcaaagcattgacaatcttgtcatcagtttttcctttgtattcatctattaaataagcgtaagtattcattgttgtacggatgtcactatgaccaagacgtttgctgattggatatatatccacacctttagcaagaagtagggcaacgtggctgtgccgcaaactgtggaagtgaaaatttttgcgttgaatacctaattcatctaacaattgtcgaagcattttattgactgcgttgctagtaggaatagtaccaaactgagtcataaataccatattactaatatgcttttccttcaattgagaaagcaattgtagaagagtttgatttactttgatagtccgattagacgatttatttttagttggcttgaaagaatgagtgtacatattccaggacttgctaacagtaatggtttggtgtagccaattaatatcattccatgttaatgcttgaatctcagatagtcgcattccagtataaatggctgtgataatcatataacgactggtataaatatcttgctgactgatctcagcttcagctttttctagcagttttttaatttcttctacatttaaataatcaacttttacttctttatcctcattagctaccagtgtaacgttttgagtaaagtccttaatcagataatcatctaacatcgctgaccggacacaagcgcgaacaatgttatttacttctttgacagtatgtggggcgtgagtagctccatactcattaataaatctttgatacattttgcgatcgatatgtttgaattcagtatcagcaaagaagctatttaatgcctttcgagtaaattcataacgcttataagtaatttcagctactttaggtttcttatacgtctcaatccattgatcgtaataatcaataaatttgatagttttcttaatgttgattcctttgtttagtttggctttttgttcaactgcccaatttttagctaatactttagtaggaaaaccgccttgacttttagtttgtcgttttccttcactgtcataccatgaaattcgagcttgccattttccataacgttttattattgaagccatacttgtccctccattattaaattgtgtataatgaaagggttgaattgagacctgtaaatcttattcaaccctggtccatctcctatgccagtaggggatgggcttttttcatttgtcagctttttacgtcatcaggctttggacgattcttagaaatcaagtattaatttaatgatataataattataaattcgctgaatcaaaggaagtatataatatgaaattatataaagtagttaaaaaaaacataccagttgaagcctatcaaacaaagaagccaatagatattcgaacgcttgaaggagtaatgcatgctaatgcaggagattggattgttacgggtgttgaaggagagcagtggccagtaaaaaaagaaatatttgaaaaaacatatcgtattatttcggaaaaacagtaatcttttttcttacaggagctgatcttttatcaaaggctgcatcaatatataagtttggtgaattaataaagtcttcccacttaactaaaatacaatatctgtcatcaattccccaagcgcaaccttcatgatcaggaatatagtaatttgtactaaattctttaataactgtattatcatcgatagcaacataattatgttcttgtccacatgtctcgcaagtataagtgcctttgtaaattttatcggtcatttctggaagaactattccgagaataccattgggatcattatataagcttgcctgtatttctcgtttaatataatgttgattttcgtatagattattttccgcactatgttttccaattaaacatatagtgactgttgaatcttttaaataatcttctcgtatcttccgcattatgtattcttcattttcagaattaattggttcattaagagatttatcaatcatatcgacatctaagtcattttgaatggtttctttatacaaaatatcttctggtttaaatgagataaagcatttatgtttcattaaatagattttcctttcttctttcctaaggaggcccaattggtgttttcattagagataatatattctgttcgatccactaaagtatgaaatttttcatcatcgtttagttcagaataagcacctgaagatgttagataagaatattcttcacgttttaaggcttctgcatttgaacgatatgcaatccatttttcatgccatttagttaatgtcagaataccttctgtaacagtagcaattgcagctattaaagcagtaactataacagtgaatgattggtgcctaaatgctactgatataacagggatggaggctgtacaaattagagtaactacttttgaccagtaatagcatttcttttgagtagcactttttttatcgtaccaatttatttgatcatccaatctattttttatatattcatccggttttaaattcaacggggacacttccttcaaatttttcgtattttttgtatatatacggtggttacttaaatcactcatagaaaaagtatagatatcatcgtttgtattatctgatgacgaatctaataatttagcactgattgttgtatcatctattctatgtaggaattgaaactctttatcattatatttgaactttacaattacacttttggcttgtttatgcgcgataatagtaattattattaatgcaattgaatatacagaaagtaagataattattggtcgtcgtatttccgcatcaactacaattgaaaaaatagtaagaatataggctaaaattgtaattgctataattgaaactataatatagaattgattttttatactcaataatcttttttctaaataatttaaattcataataatatagccataatatagtagtgatatgattatcgagccaactgctattatagacgttatattgattgaagtatttttatttgttctcttagcttgatgattagcttttgttgtagttactgttttattttgattaataattgaatttgcagatacacacggagaattacagttaccatcaacaatcgaaaaactaaaaagcacaataattaaaagaaacagccgtttcatgcttattcgtcactcccatcagtcacaacatcataaacagtgttaccatctaaagcttcgtataaaaccttgtcatgattttgcggattaacgatggctaatgcgacctttgcgccatacttgctaaccatttgagatgaaacatcgttgattgaatcggttagcttattccaagtttcttcatccccgtccccgtttgcaacgtcaacaacctcgtcagtgaattcactgtcagaagggatgattaaaattgctttgctgtctttatcatatgaaactatagctttatccttaaattgactttggatcattgaaactacttgatcaacgttcgagtcactagctgaacttgtttctgtactactttcagactcgtcatcagaagaatcgtcaacatcatcgtcttctgtactatctgttgaactatcgtcactgctaggatcagcatactcagatgagtcagggtcattttgctgagcatggtatataaatattgcagttcctcctataagtagtaaaacagctaaaattgcataaatgattctattaaacttcaattcactattttgattattctttttcaattatttatcccccaaagtcctaaagaattagaaatagaattataattataatcactggtattgtaactagtagagtaataagacacccgcaaccagccatactatctccagcagattgcattgtattacctattttttctgctttttgactggcttgataccatttgttttgttctaacatttgctgagctgttgtgtcattaatatatgtaacatcttttggcttttcatttttcagaaaatcaatttgaaaagtatatggttctcgaaaacttttaatgtgatcggcaccatctttatcaattattactttcttataacgcccacctaaaacatagattcggggttcgtagttatcatcattaaggcgattaataagtttgccatcgtccttgatggtcccgatattaaatcccttaccgtttcgaaagctaagataaaccctatagtggccgtcagtattactaattgaagtttttatatcatatgagtctaaaggatgtgttccaaattgataaactttttcatcgtaatgatattcaagaatgtcttgattagaaagaccatcatataattcatctttatcgaaccattctcgtaactcagatataaacttcttaatctggttatcatgacctgtagtatcgacagtatacatacatatcccccaacattatcgcagcttttaacgtcaatcagtatttggacgtaaattattatttaatactccatgaaacgtgaacagccttaccaacaattcggcctggattatctttatctaagataattgggtcgaattctttattatctggcattagcataattagatttccttggtgcttaacacgtttcagagttgcttcattatcaccatcaacaaggacagcggcgatttcaccgtcttccactgtgggttgttctctaatggttacaattgatccgtcgtgaatggttggttccatgcttttacctttgcaacgtagagcaaagaggttgccttttggaacaggcttttcaaaaatctcttcaacgtagccctcaatattttcctcggctgtgatcggatcaccacaggcaatttcaccaatgagggggatgctgatgcgctcaaaattatctcccagcgggtaaacgatgttagttggcaagttagtttcagaagtaacttttctttcctgtttaacgtcatagcccattagccagccttcatcaacgtttaagacttgtgctagggcatgaagtttatcttgtttagcttcatattttccttttagatagtcactgattgaatttcggccaatattagctcgtctcgctaattcggcttgagatagtcctgagctatctaatgcttcttttaatctattttgaaaagtgttcatattttttaacacccctttattgtattttagcacagatttatggacgcgcattatctaatgttcaaaaaaatgtacaacttatcttgactccgtgacagattgagatataatatagttgttcagaaaaatgaacaaaaaaacagaagggagtgtgtccatgagcaaatatgactattcattattagaaaagcgtatgcgggaaaagaatatgtcacaagcggctcttgcagaagctattagtatgagtcgaactgctttgaatattaagcttaacaatcatagttcgtttacccaaaaggaaattaaggcaattagtgcggttctatcaattcctgatgctaaaattagcacttatttttttaaagaatatgtacagaaaactgtactaggagggtagcaatggtgagcgagcaaaataaaaaagccacccaagggaggtgactaagtgcttaatttgctattgattttctttcttatttttgtgttttgcccgcttttgatgagcgtttctctttatgtcaacaagaagattttgaaagtcgtttgggataagaaattggaatatcaagcaaaacgagataagtgtcgcaagtaactgaaactggtcagctgtttctgtatagagcatggatactaccaaggagataagaattcctaatctatacaatctatttgttaacttttctgaaagtttatagttgctgatggaaattgatataacttcaatcaatatgacaaataaattccaaactaggtagattgggagcatcgcaattatcgttataagcaaatttgagtgttcaatttcataaagtgcagaacctttgctagcagttgaatacacttgggctacggaataagagccagttagtagcaaaactaagcagcaaaacaatgcaccaattctgacaagaaaacgtaatagtattcgtttgagtgccttgatgtaatcacctcctttcatagggagatgaattaagtatagcaaaatagaagaaagagagtagcttttgacagttgaagcataaaacttctagaaggaggagggcaatgatggatgaagaagaaaaagaaaaaagccctgctgctattggtgttagcagtgggactatcaaaactaatcgatttcattttagatgaagtttatcagccagttgatctatccgatctttcaaattcactttgatggcagtaatgaagaatagaaaaagccacctcgaaaggagatgactaatatggattggcaaagttttgctgatggattaattgtttcttcgatagtttgggcaatcgcttatgttattaccattacaaaattatgattatttaatggtttttatgattccagcggctgcattttttatagcacttgcttctttagagtcggaacctgtagtaacagaactccacaacatttttgacatcatatcagttttgatatggaacgtatctctatattctttaccgttggaatcagcataagtgacacttaatttgattggaaccttgtaattatcttttagcgacattgttaatttttgctttggaccgatgcttccattaattagtccgtttaatccttcttggatatcttgggagtacttattacttttatccaattcaataaagttaattgttttaataattgcactgctatttccaaagttcttaattacaagatatttactgaagtagacagtatcaattgcttcaagataaatagaaatatacggacgactggcaagttgagcagctacctttgtttgataggctgaccaacaggctattcctaaagaaactagaataccaactacagagatccagttagttaatgtcattataaataccacctttcttaatgatttagcagtcgtttgaatagagtgctaagtgtacgaggccaagtatatcgaaaatatgtttcggtgtcaatatattgtattaatcagagagatgtatcacaagatgttgtgggatgaagtcgaaaaagaacttaaaaagcaaaatatgagtatttaccagttaactattaaagcagggttaccacgttctaataggactatgtatgagtttaagtacggtcatattaagaagccaagttttgaactgatgtgtaagattgctgatgcgttgaatgttagtttagacgtttttagataactacttgctggcacaggtggttatccgtaattaagaagatttacaggtctcatcgttataaataaggtaggtgattactgatggaagcaaccttagatgaacaagattaccaaacaattactaatgaagtgctcaaacgtattaaggaacagtatgatttggtgcctaaacaatataaaccaatgttaattagtcttaaagaatttcgtcataagtatggtcatgataagtcgccagcttggttaaagttgtacttgttgcccaagatgccaggcgtctatggattgaacgctggaaaaggccatccagtacgaattgatgtgggaaaggctacacgctggttagcacaacatgaagataaagttgactggaataaatcattaccgcaataagaggtgattaagtggcatttctaattggattaccaatattaattattgcaatgtgtttgttatatgcactggtgtacagcttgctgtatgagcggaacaaaccattgctgctgaaagaaaaatatcagaagaaacattaaaaagaggtgaaacaaatgacgttaacaaaaatagttaattcgaagctcttagcaatgctgatgggtgcttggattgcttattgtgtaggcgttggcgactatggtggagcagtattcttgctgttcttctattcactaatgctatgggacttgcacacaaaaaaagccaccggcgctggtaacaccgatggcaaaatccaataactggataagaaatctacaaggagattataacatatgtcagaaaaagatactgcagcagaagttgaaaaacttgctaacaatgtgattgatcaagctatttttatttgtaatttatgcgatcaatttaagcatgcagaaacgtacagccatcatatgaagttagcagaagatattgcttaccaccttaagcggctaagcgaatctcaagactttgatgaattagttaagcagatttataactagggggttacacaatggcacaacgcagaatgtttagtcagaaggttactgagacggataagttccttgatatggggcttactgctcaatcgctttatttccatttggggatgaatgctgacgatgatggttttgttggcaatcctaagtcaattaaacggatgattggtgctagtgaagatgacttgaaggcattagttgagaaggactatttaattgtctttgatgatggtgtagtcgttattaaggattggttagtttccaactacgtcaaaaaggaccgatacactccgacgatatataccgatgatatgaaattaattggtcttgataagaataagcggtaccaatttgtatccgatttggaaccagaacggaaccaagttggaaacgaaatgtctccagaatgtatccaagatggagacaaaatggaaccaaactgtatccaaagcggttccaaaaataaaaatcaaatttcaagtgaaaactctcaacctcaacagggacaaggcttcaactccatggaaccaaattggaaccagaatggaaccgaaatggatcctcaggttaggttaggtaaggatagagttaagttaagtaagagtaaagataatttaaatactactactagtactactcttaattcatattataaaaagctcgaatccccaaaatcacaaaacgaattaaaagcgttcgtgaatgaacttggtggtgacgtggtagcatttgccatcacttccatgtttgagaatgctgatcgtccaacatttgcatacttacgttcgatcttaaatcgttatcagcaacagggattaactaatcttgcggctgttcaacatgataatgatgtttataacggtaagtcagttgttgttactggtgctaagcctaagattcctgtttatcatctgggggaataagcatcgatggtacaagttggaaaaaagagagctattaagttctggaaatattacaaagaatggtatgagacttacaaatacggggatgtccgtgatgtcacttaccaaagatatattttgacaggtaaacaaattaagaaacttgctccagacttaatgctagataaaataacccgagctgatatacaaaagctcatcaatgcttatggacaaacgcacgaaaaagtaactgttcgtaatttctatcgtttactagaagcgccaatcagagatgcggtctatgaggggtggatttctcgtgacccatgctacaagatccgtattacctctcaagttaagaagaaaaagaaacttaagaaatggctagaaattgatgaagttcataaacttgaacaagtctttaatgctgatcaaagcggatatggtgacttctttgattttacgttacgtactggcttgcgatttgctgaggtccttgggcttaccccagctgatgttgacatgaataacatgtctatttacgtcaataagacactgaactacaagaaaatagattactctcaagttaaacctggggactttatgccgactaagaacaagtattctgttaggcaaatcctaattgattttaaggcattaactgacctacaacgccacctggatggagtaaaagaagatgagtcaatctgggctcattggtatgctagtgactctcgtactaatacccgaggtggtaatcacatttataattcagtgtttaataaagagttaaaggaaatgtgtgaccaggcaggaataccaccaatttcagttcatggtttgcgtcatactcatgcatccctactaattgctaaccgtgtttcaattcaaagtgttgctaaacggttaggccacggcaatacagaaacaacccaacgagtatatatccacctgctagacaagctagcaaacgaggataacaacaagattatgtctgtaatgacgggaatttgaggtggaataatgcagtttgatacaaaaaccgttaataagctattagaaattgacgagtcatataaggccccggaaagaatgctgcagctaatgcttgataatcagaaacgtccagaagtctttaagaagttcctagaagtttcaacggacctaaagtttgactggttccatgaatattttgaagacgaacaggctgaacggaaaagtaagaagcaggattttacccctgatagcattgcgaccttgcttaatagcctagttgatagtgataagtttaacggccactattttgagatagctgcggggactggtggaattttaatcaagcgctggtgggatgactgtacaaatgatcgagttggtaattcattacatgctgaccctaacttaaaattcttgtcaatcttcacttatgaccctagagcttattggtaccaggtagaagaaatgtcagatagagcaatccccttcttgctattcaatatggcaattagggggatgaatggagtagcaatccaatgtgattcgttaagcaggaaagcaaaggatgtttattttatttgcaatgatacaagtgactttttagcgtttagtggagttaccaaaatgccccacactacggagctaaaagagctttataacatttccgaatgggttgataagtttgactgatttcataacagacaaattaagtgatgcccttgatgaactagaaaattaccacacatttgacggaaaattttggaaatacagtcggctgagagcagaagaacttttgccggctgatgattggcggctacaagaaatacttaaatttagaaaaaaggtaggcgaggagtaatggaattaaagaactacttacgacacgaatatgttgctaaacggcggcagggagatcaaaagatgttagaagatcagctattcgatatcatgcaggttaatctagctcatcagctacacgataagggtcattacaatcggctttatctccccattgatatggaagctctgggctgtgatgacttcgtgatggagcctgaactttatcatttgtttaatcttggcattgacgggcaaaaaattgcagagaagttaattcatttgatgagacgcaatggctggaaacttaattattactgtgaagatggtcaaatgtttattgaagtggaggagaagagttatgagtaagaagaaagcaattaattttgatttatcggaaattgcagatggcggtgtgcaagttaagcttaaccgtgcattacaacaagtagcagataatatccttgatccaaacacggacccaactaaaaagcggaaggtacaacttaatatcacgttagcccctaatgaaaaacgggatgcctcagatgtcacggttgaagttaagaccacccttgctccagaggttggtgtaccaactaccatgcttctaggtcgtgacactaacggtaaagttcacgttaacgagttgaagtcaggcattaagggtcaaacttacatcgatccagatgatggtaaggctaagatggacactggcgaaccagtagaagaagtggaaaaagaagaaaagcggaaggttattgatttacaaaagaaggagaactaactgatgcaagagccaaatattaataaaacagtttttgagggagaatacaaaggtcgacgagtaattatacgtgaaatgcgtcaatttgctggaatacctacttcattctcaccacttcaagattactattgtgggtacgttgaattattgccaagtgactactattacaaccatttatcagaaacagaatcatgcttatctgtatatggaggcataacatggactcctgaatatggtaaattagctaatctgccaaacggttgtttcattggctttgataccgctcatgccggacagcctccctttagtcagcagaccgtcatggatgactgtatggaattaattaaacaaatcataaaacgaaacgaggaggagaactaactcatggaaacaaagattaacggtgaattaacccaatttgaacaactcgtaaatgatgctaatggcaacaatctttttactgccttaaatggacggcaatatcttcttgatcacgatggggatgcagcattgcttaatgatccgattattgcccatcccctccaattgaatcagttaactagcttgattgaatggctggaaagtgagactcaagcaatttatgacagtatcaaaattcatgttgttagtccgactaaagtagaagtagtcggcgagttaaatggtcatggtcaacgtccttgttttgctgaggttcgggcagtcgttgatagtcttaacttagaaagttacttagatcaggaaagcatgattattatgctgcagtcacattttgaggagaatgacgaccggaatatcattctgaaagttgttagcaatcttcgtgatgaaagcattcaccaacaaaccgatgatggtgtaagccaaagtgttcagattaattctggtgttgctagtgttgatgaagtgaaggttcctaatccagtaaagctaattcctttccggacattccaggaagttgatcagccagcaagcaaatttatcttccgaatgcgtgaggggatgcaatcagcattattcatggctgataacaaccagtggcaagtagaagcaaagaataatattaagaagcacattcagcaactagagcaagaaacatttggcgagattaagtatccggtgattgcttaatgcggacacaaataatttttcataacggtcttaaattatcagtacgagaaactaccagggagatcattaatcaatcactttacggtgacgagattattgttactcggtttaatcttggccacttagagcgtttcagaattaattacgatgatatggctaaactcgttgctattggttaatgaggaagcaagccatgaagattaaccgacgaaatttacataaaatccttgttgagtatcaaaaattaatgaagagcgatgagagaagaaaagtgtattagattaatcgcttaatgatgaaagacctagcaagaagatttgagctaccgttctataaaggaacaaagtatcgtggcaaaaaacactggttagccaattcttcactttattgggaattgagaaaaattgaagaaaaagcagaagaggggatgaaataaatgacggaactattaattatcggcgccgtcttgatttttactgttggttttgtcttaggaactgtcctatcgataaaacaagcaaacttcgaggaacggcgaactaatcaggtgagaaaatacaatgacaagtaaacgaaaagtacttcagcaattatcaaaggagcgaaaggatctgttaggtaagatagatcggctagctcaatttattgttaaagagggaccaaagctttcatccccattagaattaacaatgctaaatgcacagctaaggtcaatgcaagcttatttagaaagcttggatgcaagaattatttatctgagggatgagcaataatgaatcttcaatcttttgcattaatcttttcggtagtgtcattgattattgttctagtattatctagatactaaataaaaaagcgcaccacagtaatggcacgctccttcaaattatcaaacataaatattatatcaaaatggggagagtgctaaaagtggggcttttaaaagaattagatgttgacggaactactgataatgttcgctatttctttaaggacgaatatgcacgcttatgtcgcttagcaggtggaggaattaagctaacgtccccacaaattgacggaatgccaagagcaagtgctgctagtaattcaatggaaaatcaaatggttaaagttgctaattaccatctcttggttgagacaatcgctcaagcactcaacgcatgtagtcttagaagtaggcgaatattaattgctaagtttattcagaataaaaaagattgggaagtagctaatcaaattggttatgaaaaaacgcgctactatcattacttaaaaattgcttgtagtgagtttgcggatacgctggaaagatatactagtttgctcggggatgctgacttactagaagatcttcatgcatataaggacgaaaaaagtgaacaacgagtgaacaaacagtgaactattagtgaacttcaagcccgtttttaagtgcgaaaatgatattgtcggaaggttagcgatgtagccttgtgacccccaattgtgcctgagcaagcctttaactactcaaatttaggattctggctttaaggaaagagatttctatgcttaataccacacgggatctcttgttaagcttgagtgtggatcagatgtttgactgactgatgggtctgagccccataatccacgttgagactatcattaactaacttcaaaataaatttacggtaacgattaaatttggtttgtgcgttttggaagatctcctttagatcattaaatttacatactactctgatagtctcgtagcaaccgtgctgtaatcggcagaagagtacgtaatctaactcaacggctaaaggattaccgtatgaatggacagcaataccgttacaggagtaggcggaaaactacgaccgggtgcggtgattgcgtggtcctgattatgcgaatatgcaaactagatgccaagtatcctggagtggtccaatatttgtggggcagttcccgatattcgcaattgcagtgctttacgagtcgcactgcttgctgagatccaagatgggcacacaatcggtcttgtgtggcaaaagtgtggtttgaatccacctctcggctttatcacggcaaatttaactatgataggagatgaacgctcctctttcgtaattgcatagtcttttttgtctaagccgtgatttaatgcagagatgcaatgagtaacaaaattcaaaaacgattagtggatgcaagcatttctgtattatgctgacgtagcttaatggtaaagcaccacagttgtttccgtttcaacgtggagaaggcggttcgattccgtccatcagcattcaaggctcatctacttttaacaacaatcaacgaaaggaggaagcacctacttactagatgttttcttccattagccttgattgtccgcaacgacgttaaactactacattttatttttacctcaggctagtctttacggctggccttttgtattatagtgttgaggtgaaaataaggtgacatattattcaagtacatttaatactttgcataagcctaaggattcagaaaaattctttgacattgaaagcaaaggactttatgagttcttagatttcttgtttttagcattggatcctgatatacgggagtttaattattcacttatgactcctaaaaatgttcttgtgtcctttagtaaagttgattttcgggtgttcttaggggatgaaaaagcaatagctgagcttaacactattgcataccaaatacatgaacaaacacaattgccttcgttagaggacgctaacaatataggaatacaacagctgggctttaaatttgactgctactttgatgtgaatattagtcaatttaataacagtcttacatttgtaaaagaaaattttgataaaagcagaactgaaaagctaaaagcttttagtggtttgtttgatttaatgcaagccattttaaaaaatgaaagtattaatgtatcaggatcaagcttttcgtttcttcattgttttatgagagcgcgtcaacaaattagggatgaatttgaaaggaaaagatcaataatgaattttaacccaagatttcaggctagagatatcgttgtaaaacctaatcaaggattttatgttttgccctttgaggacgggcctgaaaatgcaatgcaagcgattaaagatgagattagtaacaacaagcttgaatgtgaattgataaagtctgaagatcgatttgatccaactcgtggtaataatattatcgaaaatatttggcaagatatttgcgcttcaagttttattattgctgatattagcaatcgaaatcctaatgttttctatgagcttggaatatgtgacactatcggtaaaagcgtgattacattatgtagtaagaagagtttagaaactgattacaaaaatcatttaccatttgacatttcaacgcaatatacgatcatctatgaagaaaattacaacggatacaaaaagatgacagaggaagttatcaatagaattaaaaaaattttgcgcatagataatggtgttaataaatgatttataagctagcaggctaatgtttgctggcttttttgtttggaggattaaaatgtttcagactaaacggtttggcttggtagcatctaggcaggaatatcaaatgctgtgtagagccgaacgacacatgaataaaatacaaaataaaaagccgacaggtcaacgcttgtcggctaaatttatactcaaaaagatttgatttgctattgtttcttatatgttaataaggtataataatagatgtagatgaggtaaggagtcgcgaccttatcaatattctacagcgatccggcgacagcctttctatccggatggaggcgagttcaatggatgaaagagtttatctggaaacctgaggatgcagttatcgttaatgctctcgtagcaatatcagttgcaagtatcaactttgcaattgcatatgcgataataaaaaaagctaatcgcaaatagcggttagccagcaaactcgtttttctggatcgcaaagggacgagaggtagcagctcttgtccttttgcatatatagtataccatattaatgttagaaggtcgatgttatggttagtgaagcacaacaaagagccaagaagaagtgggacgataagaacaaggataagaatcggatatatcgttaccgttcatatgctcgtaagtttatccgtgatttagctactgatgacgacttgaaagaattagacgaactaatacataaaagattaaatgattaaggcgatagcaaatggctaccgtcttttattttgccctcatacatattagaaaggggatgagtatattgaaaccaaccaagctaacctttatcaatgggaagccaacactggtatcctatgacaagatagttcgcaaggataacgacaaagcatataatttccatcgtaatgttgaagagaatgattacgttaagttctatcactcaacagaatggaagcataagcgacaagagatacttgaacgtgattatggattgtgtcagcgttgtggaatggatgcagaactggttgaccatatcatccccagcaaggacgattggagtgatcgacttaataatgacaatctacaatcactctgtcggggatgtcataagattaaaacgaaacgtgaatggatgaaacatcataaaggattggaacgttatatgaatatcaatattgtttgtggtttgcctgcaagtggcaagacaacatatgtaaatcgacacatgactgagcatgatcttatttatgattatgatgagctaatgcatgcgttatctggtttaccaatgcaacaaagcaatcacgacatccacgattacattacactattctttgatcagatgttacgaaagctaaaggcagaacagacattcaataatgtttggatcattaagacgttaccagataagcggattgatacattgcttagtaactatcatcgaatcaatcatattgttatcatgactgatccaaacgtctgtgaggaacgattatgtgaacggaaagaacaaatttcatttcagaagattttgaatggcttcaaaacggctgattttaccggctaccgggtcgtcaagaatggataagccccccttcattttgaacgggggttagatttttcaaaacgctggaacgcacatcgacttttttgcacgataaattccaacaatttttcatttttaggcccgatactaaaaaatccccaagctgttaaaagcttgaggatatgcgtttcttgatgcttttatcatagcacggaggtgagctttttggcaagaaagcaaaaattattatcgcagtcaacaggccaccttagagtggttgaacaagaagcaaaatataaggcagaatttatggctgccgatggtttacctgagttgcaaaagactccgccggcacatttagataaggtggccaaagcggaatatcggcgaattattggttctatcggaaagctgccattgcgtaacttggaccggagcgaattggaattgtattgtacctggtacagcatttataaagatgcttccgttcaattaaataaggaacagtccaagaaaagaaagaacattgctaaaatcaataacgcaattaagacaattgataaagcaaccagggcaataaagggtcttgcatctgatcttgggcttaatgttaattcgcggctgcagatgaacatgccacaaactgacaaggaagagcatcaatccttgcgtgataagtttaggatttcatgatgaattacgctaaagattatgctgaaaaggtcgtggccggcaaaatagttgctggtaaaaaggtgattttagctgcaaaaaggtacttaaatgatcttaaaaaggcggataacgatgactttgaatatttttatgataatgaacgtgctaataaggttattcaattcatggaaatacttccggatccaaaaacgatgcgggcgtatcctttagcagattttcagcgtttcattattgctaatatgtatggctggtggaaaaaagacaagccatctgaacggcgcttccgaaaaggaatgttatcaatggcacgaaaaaatggtaagtcgatccttatttccggaattgcattgtatgagttcttgatgggtaactcacctgaattctcccggcaaatattttgtaccgctaacgataaaaagcaagcgaacatcgtttttaatatgattaagaaacgcctcaatgctctacgttccagtgatggtgatacaaaacgtgggacaaaagttaatcgtgatttaattagtaaccttgatgattattcttatgttcggtctctttccaaggaaacgggaacggttgatggttttgaacctcatgttggaatcctagacgagtatgctgcaagtaagaccactgaaatgatggaattactagaatccggtcaggccttacttcataactcacttatcatgattatttcaacagccggctttgatttgaatgttccaatgcatacaattgaatatccctatgcaacgaaggttttgaaaggtgaaattactgatgatacttattttgcctacattgctgaacaagataatgtatcagaagttgatgataaaagtacctggattaaatccaatccaattctgagtgtcccggctttgcaagaccaggtatatggatatttggcaaagcggtggaaagaagctaaacagaaagggacaaagaattctgttctagttaagaactttaatatgtggcgacaagccgaagaggatagttatatggatattgatacttggaatgcagctcaaattgatccaattgacattgatggtcaacgagtttggtttgggattgacgttggtaaatcatctgacctttatgcaattagttggttaattcctcaagaggggtattggtatgcggattcttatgcgtttgtcggtactaaatatggtttggaagcaaagattaaagcagaccggttagattatgtccggttgcaagggatgggccagtgtgaaattacgaagcttgaatctggagttattgatgttgaacgggtatatgaatggctggatggctttgtcagagaacacaatcttgatgttcaggcaatttgttatgaccccgcacaatatggaaccttgttaactcagattgaaaaaggtcatccggaatggcaacagatatctgttcgtcaaggaacactaactctttcaatgccaaccaagcaatttagggatgatattttagataagcgagttcgacattctgacaatgaaattttaactggcgcaatggctaacgcgatccttaaatcagataacaatggtgtccggattgataagaaccgttattcaaataagattgatgctgccgatgcattgctagacgcatatgcaatttgtttccgtgaaaatattgatgattatttaacagatgaggatgtgtttaatgatgactttggtttctgaaaaagataaatttagccatgatattaagcaactagatgaatatggcaacgatagcaactggaccacctttatcactaaaaatgatgtggagcacctattaaaagggaagatcatcaatgactgttcagatggagaatatttccatccattggccttaactaaggaagcaattgaatttatcaaaggaatcgaggaggaatagacatggctaagtatctatacgacggtgaagaaggaatgaagattgatgtaactcccgcacttaatgaaatcaagggacgattggaacgactgagaaagcttgccccgtatattgagaaatttgagattacggatgaagacttgaaatttcttctccgggtgatgccatgaaattctggaaactaaacgaaccggttttgctgttcatattagcttgtatctgtttagcagttacaggctttttattttccacgaagattggcttactaattatttcaattgaattattcgtaatggcttttatctcttatgaaagggggtgaagctgagtgttatttcataccgagaaacgcgaatgggcacaagattatattgaccaggggattcttccggggtttagcaatatgccatcttatagtggaatcggtgctcttagaaactctgatgtgctgactgcagtctctcatgttgctagtaatgtagctcgatttccgattgtcattttggatgatggtaaaaatgcagtaaagaatatcaaaagtgttgattatttgctgaataagcacccaaacgatatgttatctgcttatcattggcgtttcctaatgacagttaacgcaattttaactggggatggtttttcaagaataattcgtgatcctcatacaaaagcaccgttagaaatacaatattttccaccatcgcaaacctatattgatgattctgatgtaacgaatattaaatacgaatttacacctatcaatcaaaaaggcggtggtcaaacaatcgttgtgccggctgaagatgtaattcattttatgttctttacctacgatggtattcatggccggtcgccgttgttgtctttggctgatgagattggattacaggatgatggaattaagactttacggcggttctttaagtcaggtcttaaaggtggattactaaaggctaaaggtaagttaagtccggaagcgcgtcttaaaactagaaaggcgtttgaatatgcacaagctaatagcaatgccggtagcccaatcgttactgatgatacattcgattactcgccaattgagattgataccaatgttttgcaactaattaacagcaacaactattcaactgctcaaattgccaaagcgttgcatattccagcatataaattagcagttaatagtcctaaccaatcgattaaacaattaaatgaagactttattacttctgatttaccttattacttcaagccgattgcaagtaatttggaaatgacaatgctgactgatcggcaacgtcataactgccacatcgaatttgatacacgcaaagaaacagggatgtcaatggacgatgtacaaaagggagttacaaataacgtcattactcctaatgaaggacgagttcggatggggttagtcaaatctgacaatccagacttagaccgtttccaatcaaccttgaatactgtcttccttgataaaaaagaagagtatcagaaacaatcaacagcgaagggaggtggaatcgatgacaagcgacttggaaactcgacagttaatgatgccaattcagatgagaacggcaactgatgaagatgatgaaccagtaattgaaggttatgcagccaaatacaataagccatccgaagttttgggtggctttactcgctttattgagcaaattgctccaggagcgttcgatgacgctgatatgtcaaatgtagtagcgacgatcaatcacgatcctaaccaggtactgggacgatcaggggtgaacatgactttatcttctgatgcaattggcttgaaattcactgttaagccaactgatacatcatttgcgcgtgatttgatcgccaatatcaaggcaggcgttattaatcaatgcagctttgcttttacggtggccaacacagatgaggcccaagattgggaagaatctgaccaggatggagttgattatgaacgaaccattcgacaaattgatcgtttgttcgatgtatcagtagttacaacacctgcttatccggatacagaagttcaggtcggtcagcgttcgatcaatatggttaagcaaatgcagagccaagaaaatagagatgctactgatcagaaacgtaaaaagatgttacgtgaattagaacgacaagaattattgaagacactcgaaggaggaaattaaatgtttcgcgaaaaaattaaagaattgcttgctcaaaaagaaggtaagcgagcattaattaacgaaaaaactaatgaaatgcgccaactgctctcaaatgaagacgcaactgatgaagacttaacacgagctaagtcattacgttctgaaattgaagctgctgaaaaggaagttcggagtattgaagatgaccttaagctttaccgtaaagcagctaagggtaatccagctccagatcctcataagcgttctcaaaataacgaggacgaaaatgaagaaaaacgtaatttcaacgcatatcttcaccaagaacatcgtgatggtactactggaattacttcttcagacgcaagcgttactattcctgaatcaatcatttacaatcctgaaaatgaaattaaaacagtaactgatcttagccaatttgttcaagtatttaacgccacaactgcttctggtagttatccaattcttaaaaaggcaactgctcaaatgcatactgttgaagaacttgcaaagaatcctgatcttcaaaaacctgaatttcttaaggtagcatggcaaattgagacctatcgtggagcaattcctatttcacaagaatcgattgatgattcagcaattgatttaactggattagttgctcgaaacgcaaaagaacaatccttaaatacaaagaatgcggctattgctacaatttttaagggattttcagctaagaccgttgatggctctaatgcaatcgatgacctaaagaaaatttggaatgtcgatttagatgtggcttacaataagatgattattgccagccaaagcttctacaactggcttgatacattgaaagataagaatggacgttacttacttcaagatagtatttctagtccgtctggtaaagcggtctctggaatcaacgttgctgtaattgaagatgacttatttggagcaaagggtgaagctcatgcctttgttggtgatccataccgtgcaattattttagcaaatcgaaaagatctccaggtacggtgggttgataatgacatttatggtcaatatctccaagcggttcttcgtttagatgtgaagaaggccgatgaaaacgctggttactttgttactggtccatcagcagcgtcaaaataacgccgtccgacaacggggcggacgttaaaccgactagtgctgatacggtagacacaatcaaaaagtacttagatgatcatggaattgcctatacttcaaccgatactaaggatcaactgttagcaaagctaggtgagtaggatggaaacagaccacactttctcgagtgatgaacaattctttgccaatctaaaaaactactgcaaaattgaccaggactttgatgatgaaattcttaaaataattgttgatgctgccgcattgatgattgcaagggcaattaaatgggagagtaagcctgctgactactctgacgaaccgcgattcaaaattgcacttatgaagcaggtgaaagaagacttctacgagcgaggaattactgcagatagttaccgaccagttctttcatcaggaattgatggccttattaatcaaataagtagtgaggtgaataccgatgaaactacggaacatgacggaacggataacattttactcagtccaaatggggatcaatccggaaactcatcgaccgatcaaggatcagaaagttaaggaatttaccgtgtgggcagaagttcctaagctgtcagtccgtgaatttgtccaaaacagttcaaacgtggggttcagaaaagaatcacccacgtttttaattgctttcaaaactcgtaaggaaattcaatcgaattggttaattaactggcgaggaaaatggtatgaaatcacgggaatggatcctgattatgcaaagcgagatctaacaaaaattaccgcccaggaggttgtccaaaatggcagtgaccggtgaagcagagctgattgctaacttaactaaacttgaaaagacggaagaaaagaaggcacgaaaagcaacccgtgatggtgctaaagtctttcaagaagaattaagaaaatggacgcctgtggcttctaaaggctctgatcattcaggcaagactcctttaaaagatcatactaaacacggtaatctcaagactaacggtggagattattctgtcgatgttggttatgacaaagataaaggatggattgctcacttccccgatgctggaactgctaagcaagatccacaacactttgttgaagattcaagaaatgctgctaagaagaaaatattggctaaatttattgaggacttgaaagtatgaaaactccagagatgcaagtagccgattatctaacgaatgatgagtgcctagtcgtgatgatggatgagttgcgacaagataaattatcatatgttccaatttttactagtacgcctgatgatccatttattaaagcgagttcagcaccgtggattcggatcacccccctacctggggatgatgcaatttacagtgacaatgctcgcttttttgaatacccacgtgtacaagttgatttttggattcgtgaagagaatgatgaccggctaatggatattcaagaacgaatatatgaaaccctccacagtcatggctttgaacgttactacaagaattcttatccggatccggacttggataattgcataatggtcacagctaactttgaagggtttgaagaaaggaatgatatttaatgggaacaccaaatgcaaaagttgctaagtttggggcctctaattttgaatatggggtgctagacgagaacgaaaagattaaagatacccgaaagatgagcgggttaagtgaagttaagctggagctgactaacgaattaaagacgttagcagccgatgacggcccttacttggttctttctggtggaattaccgaagctaaggaaaccatcaacctttatgatattgattccatcatgaagaaagacttgtatggaattgatattcagaacggtacagaagtttatactaagaatcttgtaccaaattatgttgctactatgttccggacaaagctttcaaacgggaagcattgttgggttggtttaaccaaggggatgttctccttaccaggtatttcaatcaagactcaggacggtgctccagacccagaagcagatgaaattgaaggtaatttcgttccgcgtggggatgcggatactggaaccatccttttaatcggtcgggaagataatgaaggatttgattttgctaagttccatgcaatggtctttggggaagaagctccagtaactgatccaaccaatacaaaagatactaaaccagaaactgttgttgataaagggtaactaattaatcagacagagacgagttaagtgagacgatgaggaggatatggaaatgccatataaattaaaagtaaaaacagatggcaaagaaacaatctatgaacgaaaagaagccccaatgcttgaaaatctattagatgcattaaaggttcaacgtcaagaaatagtgatgtactctgatcccaaaaaattgccaacagataaagataatgaacgattattaagtttacgggctgagtttgctgctaatttttggaagaatggattgactaaaaaggatgttctttcaggagttacggctatagaagggttaattagcattgttaatgcaattaatgaaactctcggttctcctctaagtgaagatgacttagaagagaaaaaggataacgaaaagccaaaaaaataactgttgagatgattgatgattcaatcaagagtctcacagatttcattaaaaataaaatgcgcgatggatataaatggaatgaggtcagtaagctaacactttcagatttgaaattaatgaattacgtctttgaagaaaagcagacaaccattgataaagcattcccattcttattctaggaaaggaggttaaataatgacccaatcattaggacatttggcagcaactgttagtttggatattgatccgtttaaagcggctaatggtgttttaaaagcgcaaattaaatcaacagccaatgctttgcgtgcgcaagaagcggcactgaaagcatccggtggaagtattaataatatgcgtgctgcttatgcgactatgagtcaacaaatgcgcaattataatgcgcaactccagaatgctaagaaagcaatggatgatactaccaggagcgagcagtcacgaactaaggcagcaacccaatataataaaacgtctgcgcaaattgaacaattacgtggacgaatgcaagctcttaatcgtgatattgaattgcagtcgaataagtggacacaacttgctaatcgcactcaacattttggaaatgtggccaccaatgttggttctaaaatatcaggtgtcggtcgagggatgtcgacttatttaacagctccaattgcggcagggttaacatattccgctaagaaactcgttgacttccaagatcaaatgacaaaggtcaagaacgttattcgaacttccggagaatcagctgcagaaacgaatgccgcatataaaacgatgactgcagatgcccgaaagtattctgacgagtacggtgttagtcagcaaaagattgctgccgggtatcaagatctagtaaagcgtggttatacatctaaagcagcaattggagtaatgcggaacgaacttaaagcatctgtggccactggggatgactttaatgatgtaatcaaagttgcttcgcagacaatggaatcttttggactggctactgataaagcaggacgtccaatcaagaatgctacagtcatgcagcgtagatctactaaaacattaaatgagttagcctatgctgccgatgccacatcaactgattttcaatcacttggtgtgggaatgtcatatgttggctcaactgctcatcaagcaggttttagtctctcagaaactgctagtgcaatggggatcttgtctaataatggtctagaagcagacaaagctggtaccggtctacgaaaggttatcaattcactaattacgccaaccgctaatggtcaaaaagctttagcaagtattaatttaagtactaaagattttcttactaagagtggaaagttaaaatcaatgtcgtctatttttaagacgttaaatgaccatatgaaaggcttatctggtcaccaaaagaatgatatttttcatgcgttatttggaacaactggacaacaagctggggcaattttaaccgaaaacgctaatcggttacgtgaacttaataaagaagttcaaaactctgccaagcgggattatatcggcgacttgtcacagaaaaaccttcaatctcctaaagcacaattagcaatcttcaaggaatctttaactaacgctggaatggatatggcaaagtacgtcttaccatctattattccaatggttcaaggcctttccagacttgcacatggctttggtgatttatcaccagctgtccagaaggcaattgtaacaactaccctgttcactgctggtgcaggcccgttgttcctagcattgggtaaactgactagtggtgctgggaagacagttcttgcctttggaaaaattgcttccggaatcggccgtgtacaaactgcaatgaaactaggagccagtgggttagacgttattggctcagctttttcaaaatcaacatttcaagctgcaaagtttggaacaaccatgactggtgcaggtggtcgggcggttcaagctgctaacggtgttggtgctgcgactgtcgctttacaaggtaccggtgtagctgcaggtgaagcaggtgctgctactgctgcggctggagtatctttaggaacagttgccgctgttgctggagttgctactttagccattgccggtggaattactgtttgggagctttggggtaagaaagctgtcgaatcatcacaacgaacgaatcgttggggatctgatgttggtgcagctgctgataaggctttatcaaaaatgcagtcgacttctcaaggaattcagaacactctgtcagatatggatgttgctgcctcaacttcaacaaagaaattagctgctgattttgaccgtgagtttactaatattgaaaatagtgcaaaacaacattttgctaatgccaaaaaggcagaaaaaggtctgtctccagaaatatctaaagctattgacgatgagttagaaaaggagaaaaaacaatataattcatatgtgaatgatgcagataatgccaatcagcgtgttcaaacaattctatctgaccacaataaaaaagtttcacaattaaatgatactcagcgagtcatgttaaagaacaaccagcaggaaatgcttaacgatgagatgaaaattcttaaattaagtggaagtaagcgtgctaaagcaatggctgtccttaataacgatattaagcatatgtctatgcaacaacgctcaacaaaaatgggagatataaccagtgaaactgctgaaatggaaaaccaatacaagaagcagtcttcaatgcttgctaaacgctacggaaaagattctgaactgtataaggtcggtatgcgtgctaataagaaagcattaacagattacacgaataaagcagctgccgaatatattcgcctggcccgtgctaatggtgaaagtactaaattaattaagaatgacctaaaaagtatgggacttagttataaagatggcactgatgagattaagcggcaatccaaagctgccgaaacaaacctacaaagcttagcggtaaatactactaaattaagtggaaaagctaaaaaagccgctgatatgtggaatgacttagttttcgatcccaaaactggtaaagttcggactaatgcccaggaggaagttaataaggctgttaattctaaagatcaatggaaccaaattaaacttctgaaaaaggaaggtaagttaagtaccaatgctcaacaaatggtggcagctgcattaatcgaaaatggtaaatgggatagcatgagttggaaagagcagaaagcttggttgaaagacggctttagtgaaacaattgttcaagctttagagaagtcgggagaatggaataatcttgatcttaagaccaaagaagcaattgttaaggctaaaggtaagcaagaaatggccgacattctgcttgaatccggtgcatggaattccttgtcattaaaacaacaggaagcagtaattactaataaggcaactaagccaatttatgaagccttgcaaagttccggacagtggaataatttaaccttaaaacaacaggaagcgattattgacgctaaaggaactccacaattagttgatgcattagtgcaggctggtgtttggaatagtctttcgtttaagcaacaacgtgctttggttactactcagggtgctggtcgattaatggatgcgctcaataaaattggtcgctggaatcaacttagtcctaagcaacagcaagcaatcgtaaatgctaagggtggacccgaactacagcaactgatcactgattatgggctgtggaaggggatgccggttagtgctgcaaaacaaatcattgctgatgataaagctagtggaaatctaaaagctgctaacgatgcccttcaatcttggcgtcatgctaatccgggagaaccaaagaatgcactggcaattgacaatgctagtggtccgatgagaaatgctactggtggtgtcgatgtttttgctagttcaaatcctggcgctcctaaaaatgctttagccgttgataatgctagtggaccaatgtatagtgctcgcaatggtgtaaatgcttttgctggatcaaatacgggaccagcaaaaattgcaaaagctaatgataaagcttctgggccaattaaaacagcacttgatgcaatccataattttatgagtatacctaatactattgagaaaacagttaatgttatttttcataaatcaaagcatgctcagggaactaattaccataaaggtggattgatggaagttaatgatcaacctggccccgtctttcgtgagttagttcaattcccaggtgaaacaccatttattccttatgggcgtaatgtagtctttccagcaccacgaggaacaaaagttgttaaagctagcgatactgctaagatgtttaagcacttaccacaatatgctaatggtactgatgatgctgtttcggtattaactaactttaagcccaatatgcaaagcacccaagttgtaaataattataataacggtggccaaagtaataatggaatgcaaaaagagatgttagatcggatggaccagatgctcaaccgctttgggacaatgctgggcttaaatgcagctcaactttctgcaattaaagccggcgcctttgacaagaaccagttttatgggattgaaggaactgatcaagcattatttgataatcaacatctttaggaggtggtcgtaatcgctgtaaacattctttacattaaaattgatgatcaaaaagaagtggccagcacagatattactgaccacttaacttttcttggcttaactgaatcgcctagtgttattaataattatcgtgatgattcccaacaagatggtcaaatttggagttattcccgttatggccaaacgacgatcaccgctaagttcttattgcagttctttgatcgaaaagattttaagatggcaaagcatgagatttatcgcgtttttgcacaaaaaggaatctttaggttaagaacaggagttgagccggatattgtccgttactgtcgggctagttcctttgagattaaaagcgaaccagaagaagttaactattgtacgtttgaagtgccttttgaaaatccaagcggaatgcgatttagtaaattgcatacggatgagatgaaagatgaggatttcttagacttgaatatgaacatggatgaggaaactccttcataccatttcaaaggccagaataagttttctatccttaacgatagtgatattacaatcgatcctgttgaacagcgtcatgatctaaaaattactattaagcataatggtggaaaattcacagtaaagaatacaactactaatacttcttggacgtacaatcaaaatctatctggaaacgatactctcttgctaaagggacggcgaacatttaagaataataacccagacagtgccaataccgattatgggtatattactttagcgcctggaaagaatgactttgaagttactggtgcagatgatttggaaattacattcagtttcccatttatgtatcttggttaggaggtgaggacaattagtttagtattgatgacacctcataaagagacaactaaggagccaatcggagacattattctctggccaacaatgcaaagcgagtggtctaagaattcgacctttcaattgactttttcagtatttgattacgattcagcattgtatgatccattagatgttgaaagttcgattgtgcttgagggacaggaatatattgtaaaaaattgtgttgaaaactttgatactaatacgaaaaatatcactgcttggcatgtctataatgagattagtcgaatttataaacgaagtgaccttaccttaaataacaatcaggatagtaatgctagtaaggatcagtcttatggagttgaggacttactaaaggcttggattgatggaaataagctaggctttagctatgaagttcatggtaattttgataagcagtcaacttctaagttcgatagcggcagtggtaaagagatgcttagtaagattactgagttatggccaagtgcagttatatatccggataacaagaagatacgagtttattcagaagatgagttctataaggataatggtcgagtgattgattttccaagggatgcaaagtcagttaaaactactcgggacagtcaatcaattattaatatgattcgttgtgttggtggtaagcatgaggttcagcacactgtttataccgggacaggtggaactaatgctaatggaccaactgagccagtcaacggtgattggacaccagttattcagtatgctgctagcttttatggaataaaaccgaatgctcagcagcttaatgttttacgggcacaaattcatttggaatcaggtggaaacgagacgattccgcaaccaggaactgatcccgatggcgatggttctggtccggcgcttgggttacttcaatttaagcgaggaacttttaatacttattgtcgggagccctatacaaatatcttaaagggttttgaccagttaattgcgttcttcaatattcctaatgcactaggacaaattaatggtgttactggttggagtcctcatggtgccccaatcacgaaagataaattgatcatttcaccacctaatccgtggggatggcctttcccagatgttggagaaggtcatttttcattggggcaaacttttggaacacaccctcaagatggagtggggcgaactaatggttttcacgatggccttgattttggttctgtcgatcatcctggacgcgatgttcatgcgattcatggtgggaaagtccaggatattggatacattgctggactggaaaactatataactattgtgtcgaatgattatttaatttgctaccaagaagcatttttgaatcgaggagatattactgttcaagttggccaagaaattaagacgggggatgttattggccaccgtgatactagccatcttcatattggaattactaagcaaaagaatttaatgactgcattgaaaagtgcctggtcaaatgatggaacctggcttgatcccttacaagttattcgtgatggtatcggtggtaaagaaaccaatgatactgtcggaaatgatacaaccacagaatcacaggaagagtattattttcaaccgtttatggtagttgatcaaaagtcaattgacgaatggggagaacatcctggacctgatcttgttgatgaaagatttcaagatgcggatgcaatgcgtaaatatgccttaactactcttaaacctgatccagatttaaatattgaagtcacgcttcagggaaattcatttgtacctgttgctggtgaaattttaagagtacttgcgcgagataaatattcaggtagttataagactgtcggttatacgatatatccggaagctaagggacaagataatcaaataacgttaaataattcaaaaacaactattttagattatcaaaatcagaaagctaaacgtctacaagaagctcttgaagaacaacgactccggattagtggattagcaaatagcatggatcagcaatccaagtcattaacgcaagtcgtgaatgataagaaagagacggataagaatatggaagcagtagaccagaatatttactggatgcaaaatggccagcataatttggtaactatgatgactggcggaactgtttccagcgaaaaatataatgacagtccagtaattgaagtagagcaaggcactctcagaagcaatgaatttaacctcaacggtgtctcctccatctcaagtcgtctcatggctaagttaaatgcgaccgataattcaagttccgctactacttatgtcgagttcttgaagagcgatggtagttctgccggcaaatcgaatattgtctatatcgtcaataatggcgcctggcaatccgccggcacagttaacattaaaattccagccggcactactaaaggaaggctggtttttaatgtttccggatctgataaagcatacgtatcacgggcccaggtaaatctaggttacagagtgacggattggagtagtttgaagtgaggagggggatggtcatttggatttagaaactaatctagatttgcagagtggaagaaaattccgccagcaattaataaataatttaacgataattcaaaatgaggataacaaagacgataatctccgtgacaggcagtataaagaattgattaggctactcgaggagattaatactcgtctcgaccaactcgaacaagaaaaagccacgcgagatgaactaaaagaggctcaagaagcgtggaaaaagaaaattgagcatgtggctttagggaccgactatgaaacggttgaacaagctgtcatgcagattttgaaagagaaaggaatgatttaatgtcacaaactttaacttatgtgatcggtcaagaccggcgtccgcatgttgacaatgtacaagacttcaaggttaactttgatggcagtaatactaactgggtccaagcgcgtcagtatgagcgaagtatgcgtcaagtttttgtcaatattaagaacgaagacgggacaccactagatttaactggctgtaacgtctggtttgaaggattacttcctaagaattccgccggcgacttccgagtaattgatgataaaggctacgttgcccttgacccaaccgccggacgtttccgtttcgacatgcccggccatgcctttacagtcgctggttcctatcgccaagccttttttcgcatcctcaaagacggtaactctatcactaccttggaattcgacctcgatgtccttgctgataaggtcattgatggcttggtaccacgaacatatatttcacccgtcgaagagttaattaacgaaatcgaagccaagtaccaagacagtaccgacaagctcaccaagatgaccagtgactttattgataagtttacccaatcaatgaacacgctcaaagctcttggcgttactgttcaaaatggtttagatgcactagacgctaagattaagcaagacaatttgtttacccaggcggaagcagaggcgtttaagcaggaaatgatgaaggcaattgcgattaactatgcacatgtgtatccaaatgtagctgccatgaaagctgatagtgctttaagcaaagatatgtgcgcaagaactcttggctattatgaaccaaatgatggaggaggagggcttttttatgtcacagatacaacaactaaacatgcagaacaattagcatcaggactattagcggaacttattgaaaatgaaattatacctgaaacatggggagcacatggagatggtaaaaatgatgattaccaaatccttcaaagcattctaacctatgcagttgataataataaaagtgttcatgggaatggatgttatctaattgaaagtccattagctattgacttgaagcagtctcatatttcgttgaggttaaagttaacaccagcactaaacgtggatcaaattgcattcaaatttagaaatggaaatcaaaatgatattcaaattatgctagagcgaggtgcagctaagtatggggtttcttttgataccatgtttcatagtaatatttcgattaaagggtattatttcagaggatgtatattaaacgtaactggtacagatgcagataacacacataatattgggatcaaaatcaaactttggaactataattgctatcaaacattgtatcagcattcggtatcgcaacaatccggtttcggtgaatattcttttgtgtgggaggaaacgtttgatatagcagacaatgctattggatcagtgattgattcaacttacgatctaactatcaaacattgggaaagccattttgttacaaataaaagtggacaagctaatctaaaaattatgctatcaaagggccacattgattaccttgcacttgggggaaaatgcgatcagttgctcactctgcaaactaacgctgagtttacagcaaacgagattatgctaggagctgaaagagaaagcatgaatgggctatatattgggcctagtacgactggaacatatctagatgtggatcactttaagttaggtggaaaggcttttaatactggagttaaattttacgatcaaaactcagcccattttcaagctgggagaatttatgctgataaaacgccaacttcgctcattagtttaggcaatacatcgctaggaatgagtttgcaagatcatcaaacagattacaattctaatttaaagacgattactaaatttatagctattgatcaacttaattcgcaagaggtcaagacacttccaatggatgctatcaataaagaacttggagttactgggaaaatacttaactatgttgcagaaggcgaccgctggcaattgagtgtttcagaagctggaaacggcgatggattaatcgttagaaacattgataactcagctatacaaaatacaggggtaactgtaacagtgttttatcaaacaaaaatatactaaggagagctttattatgaatgatagtcaaattcctgtgacgattatttcgcattcaaacgggaataccaatcaacaaatcactattttgcaagcaatgattatgcaacagaaccaatcaaatgcaaaattgcaggctactaatgctcaacaagcaactcaaatcaagcaattacaacaaatgtttatgactgttaatcagcaacaggcagtcgaaaaatctaaggaggtaacggcataatgatgacacaattacaaatgcttcaaatgttttggaatgactggggtaaccatgatttagaattctacaaagtttatgtacgatgcggagcgatcactaaagatgaatataagacggtaaccggtcagaattacgaaattcaaggagcataaatcatgacaataaaattatttaagttattgtttagtagtctaaattagtgatactctataaaatagaggtggttatcttgaatatttcaaaatcattagaagatattgttaatactgcttacgaatatgataatgaattgtgtaacaatcccaaattaggtgggtatccattagcagcatttggtttaaaaacaaatcggattaattcacaggaacagtgcattaaatgggaagcctattttgaccgaaaacaagatggttatactcctaaagaagcaaaaattattgaaaaaaataaattatataggaaactgaaccataaactttatataggttattatcgaaatgtattctatgtttctgaattgtcccaagaagatgataaatttactcctgctaataattttcccaatgaagtaaaagcgtatcagggattaattactaagattcgcttgtatcagattgaagataaagaaaagctaaagaaaatggctaataattaaatgaattcttagcttaacggtaattacttatagtcgccttagaaatacacaatacataaataagcctcactcaaacgagcggggcttttattatgggcggcattttattaaaattttgattccatacttttgtaaattaattattagcctttggtttttcttcaatttttcataataatatcataattatttcaattactgatacgataatattactaaacaattaataaggggaatggtaaatattatgcaacattatactatgaatagtaaagacgaggagtatgcaattagtgaaacttatctgttatgtaattttactattattgctattaaaaatatatataataccaaacatgaaaaatattataaagataatatgatttggtataatttacaaaatattgcattgtatacgtcagatatagctaagcttctatggggttctaactctaaaaatagtaatgatcgaaaaaaggtaagggaaattttgaatgtaactgatgatttctatattaatagggtcgaaaatgaaaatttaagaggcctcaggaatagtttagaacatattgatgaaggacttattaaatttaaccgacgtcagcacataatggttgaaaaacaagtaattggtaatttgtatcaaactataaaagttggagacaaagtgttcactcctacaaaagatgaaactttaagagtatacgatcctcataagcatgaattttttatatttggttattcatttaatttagataaaattttagatgatgttgtaaaaattaataataatgcagttcaatggttatctgataataatattccatatttagtaacagcgtaatataacacttttattttagcggtaaggagatggggataaagtgaatctcaaacagaaatattctaacgaaatagataatattaaatctttgactgaagaacttcgtcaaggaaaaatatatgaaattactagagtacgaggtgattcaagtgcgtataagctagctaatgatattgataataaacttaacgacttaataattaaaatcaataataatgaagatggaaattgggaatcttttaataaaaattaaataattttaaacgtcctctacagggcgtttttattttacccttataaggaggtgaccactataaatgcacttactactgacacaaccgccacaacacgttctatacattcaatattttgccagcatgattgacaacgtgctcattgaatggttagtttgggcgattgtgattgatattgtgacaggttttttcaaaagtatcattacgcaccgaacaacttctagtaaaggaacgggtggacttttgaaacatgctgcagttattattttgactttaaccgtttatccaatgttagaattatgcggattaggacaggcaggcgactcgcttgtctttttctttttcctattttacctagtttcgattatcgaaaactggggccaaatgggactaccattaccatcttgggtaaagaatcatatttacaagctcagcaaagattatgtagagaaagaagagaaacaacatgagcacaatcattaatgcaattccaacctatatcatgacggccgttatctcaacggtcttttattttgccttaaagcaaagccagacatttattcacgctaaagtcactcatgccaaaacagaaacttctcgtgctgcttggtcttgtgctgaacgacttgcagataatgccgttgcttccttagttggcaaagacatggctggtcatgagaaatttcatcaagcaacaggtattgttcaacaagcacttcaaaagcagggtattaagaatattgaccttaacgctattgaaacgcttgtgcaatcagcttatgaaaagtctgcattgacaccaaccgttgatccgacatcacaaccaactaaacccgctactattccagccggccaagcaccagcaatcgatccaatgaaaggggaagaataatatgcgtaatcaattcatcgatgtttcaagttatcaaccagatactgttgcctttttccaagctgctaaagctcagggtgcattaggggtcgttgttaagttaacggaagggtccgaagatggttcggcttatgttaatccacgtgcggccgctcaaattcgtaatgccttagcggttggcttgcgcgtttcctgttaccactttgctcgttatacatcagtgactgatgcacaaaatgaagctcgattcttcgttaaaatcgctaagcaatttggtatgtatgacgatactttgatgattgatgatgcggaagttcattcaactgcagattatcaatcagtatccttagcctttcttcaagaagtagaagctcttggttacaagaatactgggatttactccatgaagtccttcttcactggcggtattcttaattcacatggctttgattcccggaagatttggattgctggctatggtgtgactgaactggggattgataatgcaagtgcttggcaatattctgatcatagcatcatgggaattgatactagttatgactttgacggtgcctttacgactggtttagtatcaggcaatgttccgcaagctgttattccagcaccacagccggttcaacatattggtcacccagctactggaacctacattgttcagccgggcgatacattgagtggaattgcagaaaaatacgggactacttatcagaacctagcagcaatcaatggtattggtaatccaaaccagatcaatgtcggccaagtcctcaaagtcaccggaaaagtatcaaacgaaaatacttactttgttcaatcaggcgatacgttatccggaattgccaccaaattcggcaccactgtctcagacctcgtaagccgtaatcacattactaacccgaatgtgatctacgttgggcaaaaactctacttagccggcaacggacaatccaatgcttatactgtccaagcaggggacacactaagcggaattgcggctaagtttggcaagacctggcaagcattagctcaaaagaatggcatcgcaaatcctaatatgattttcattggtcaaacaattcagatttaagtgaaaaattatagtaataaacaccctagtagccgattaatggttgctagggtgttttgtcatatagtaatctaaattagatatatcataaaaaggagaaaaccatggtgtctgaaaagaaaaaatacaagatatttgatttatcgactcatgaaatggctgaaagatcattagaactatataaaaaagatgaaattgaaaatgcatatttttaccactttacaacttgttcttcacagcaaaggaactatttatatgatggattaaaaccacttagcaaagttataacagattctagtaccttgttaggatcatttttagaaaaaaataatattcgtttctactgtaaaaataataatccttttatttcatataatgggcactcatacctgattgaatctggtggaagttggaatgatattgcagcacgtttggaaaatgataacggaattagtggcttttttataccatatcattttgattattcttgcatttataagtgtcctgaaattttaaggtaccttgatagtgccatatatgaattagataatattagaagtaggccattaaaagggcctcttcaaacaagatgggaacaagagcatttcaaaacttacatattaaaatgtttagtaccgatggacaaaatagaagaaaaaaggcctaatttttttaaggatgctgcagaactcgcagctaataaagatttcaatgatattgatgatatgtcagaattcgtctacgttgaagataaagattgtaatatgatagaggttaaggatgtaaaggaattcaaaatttaatagagtaacattaaactgaatagttactaaggtaaaaaaataccatgactatattcttaaagtataataaaaaacagcgatagcaaacactaccgctgaaatagcatctcgcacatttcctatcagaattaaccaagtaattcatcaattagatgtttgagagcctttttgattacaacctttgcataatgcatcagttgcttgacgagcccgttcggcacgatcagaatgagaagtataaatgtcacggggaattcaccccttttgcgtgatagtttgggtcgttactcccgacacgcattaattattgtatcataaaataattatgttataatttaaatatcagatgagaagtatcggcacgcaaattggattcagttcgttacttgatccgtaccggtataacgtggggcgccctgataggcgctcttttttattttagttaagttcgcacacgtttggcacactaactccttcaaaacgttgatatatcaacaatcttctatgctcgggggacgcatttttttaagattgtataaaaaagaagctccgataaaatgctgatataacggcattttaccggagcttttgtttagttaaaatggtatgaaatggtgaaagtttgtaaagctggggaacatcggcaatttttgtgcaccaaaaataatcattgccgtaaacttatttgatttaattgagtgtgcgggtgctttcaatagaaaaatttttgattatggaatatattttaatagtagtaaagctatagcaatcttgctataattagtaataaataagctataataaaggaaatagtgcatgtatgaagtagttttttacgaagataaaaatggaaatagtgaaattggtgattatttcgagaaaatttcgcaaagtaaacaaaagcaagataaagcaatttatttaaaaatgcgccatcaaattaagatgttacaagctcttggtcctgtgttgcatacaccacaagcaaaaaaattaaagggttataggcatcaactatgggagttacgacctatgccagaaagagtattttatggagtatggaagaaaaataattttgtattattaaatcattatgctaagaaaaaggatgaaacagatcctcgtcagatagaaagagccttgtcgctacttgacgattggtacgaaaggaagggtaaataatgagaaaatgggaagatatagataagcatcagacggctgcaacaaaagaagaattatcgattgttgataccttgtcttttttagaagtacaaagaattaaacagggcatttcgcaaacagaatttgcaaaaaaaatcggtatgacacaacctcaattggctaaaatcgagaatttagattcaatccctacgctgcctacattaaataaatatgctgctggattaggtttgcaaatcaagttgtctatttctccattgatggaagccaagtagataaatattaacaatagttgcaccgtgaaaaagtaatttcatggtgctttttgattttgtcaataatgtgaaagttggattgttattagtttgctttttagtagtaaaggcaagaaatgatctatggccgggttaaatacttatctaaaaagtccatcacaattttaaatacctgtggttgaaggaattttacatccatgtgacttgcaccttcaatttcgtataattcagtaggaacgttgttttcaactaatacatcataaagcttttcactatctttgattggaacaacgacatcctccgtaccatgaaagataagaaagggcgtagaagtagaatttacatacgtgaggggatttgcagcttcaggttcagcgccaagcaagttacggtaaacaaaatcaaaatcgtttgatgcacttcctgttttagcggttaagggatcaactacaccataaaaaggaaccgctacttgaacatcactggagtaatctaaattagcacctttgtcgaattggttaagaccattagtaacacctaacatacttgccatatgaccaccagctgattctcccatcgcaataaaccgattaggatcagcttgaaagcgcttggcattagctcttatataacgaatagcagccttagcatcttccaattgcccaggaaactgaactttattgctatcacgatattcgacaccaacaacaatataaccatgccgagcaaaatcaaccaaatttggcagatgaacattgtgatcagtatccatccagccgccaccagcaaaccaaaaaattactgggtaacgtgtatcatcattagtttgaaaatgccgaatgactgaaagcttcaaatctcgcgttgtattaccaagccatccaggaacttgcgtatacgtaatatctgaatctagccataaaccgtcacgtacttgatcaactttaagcgtatgtttcatgataaaaactccttttaaaatacttttgacatagacttcatcaatagtattacataaatcttttaaaacataaatcaaaagtattagttttgtttagaaaaagttttattaaagttaaaaataagcattaaataaattcttttgagaaagctaaaaattgatattctggggggaattttaaattcagtcgcattaaaactataattttaatgacatgttaattttaaaataaatcgttccctctttacgtatttactagcaacttcgcttattttatgattagattaaattaatatatatttataaggagcgatcatctatggaaattcaatactgggctgatattgcgtgcccatattgctatatgggaattacacaattacaacgggcgcttaaagaattaaagattgccgatcagacaccattaaaatttatgtcatttcaactagatccaacgttgccaacaacaactgatttatcaatgacagaatattatgcaaaaactcatcaactaactaagcaagaagctgttacacaaatacataaaattgatcaacttgctgccgatattgatttaccaattaagatggaaaatgcgattcctgttaatacattagctgctcatcgcttaataaaatacattgagagtttaaatgaccaagcattacttaataaggctgttaaacgtctttatcaactttattttaatgataatgaatcaatcgcggactatgaagctctaactgttgcaatgaatgaaatcggactacctgttgctgatgttaaaaaagttcttgaatctaatcagtatgaagatgaagttcgaaaaaatgaacggcgcgcatttatgattggaatgccaagtgcaccgctatttgtgattaataataagtattcaatcactggtgcacaaccttatgaagtatttttagaagccttgaaaaaagtaaaagatacaactaaataagatccaatcaaatcagaagataatttctggtttgattttttgttccccctgctctatttgtaaatagaaaaactgtaattctttataaattctaatcatccgggtagaataagacttgaggaggttttgggaatcctaatcctgcaattcctatttatgccggaacagccgaattaattgtttcgctattatatctggcatcaggaatcgtctatatcgctacttgtggtattgatggtttaggtggcgatattgctggattatcgatgatgctaatcagttgggttttaggcttgttaacgtgtactatctatcttccattgcaactatgggcatggttggcgttaattattggagtcggcttctttgtctggcatattatgttacgacgtgaataaattatgctaattattgggcaatccaatgatgttcgcttttagcctacgttattagattgcctattttttctaataaaaaacagcgagtaatttttactcactgttttagactaattgggctagctggattcgaaccagcgcatgacggtaccaaaaaccgttgccttaccgcttggctatagcccaattatattaaaatgttgaacaactattaaaattgttcaatggaggatacagggctcgaacctgtgaccccctgcttgtaaggcagatgctctcccaactgagctaatcctccaaaaatgacccgtgcgggatttgaacccacgataccagcgtgaaaggctggtgtcttaaccacttgactaacgggccatattaaattaattaaaagcgggtaacgagaatcgaactcgcgacaacagcttggaaggctgtggttttaccactgaactatacccgcatatcagcgacgaatattatattatcaagttatcctataaaaagcaatacttttttcaaaaaagtttattttatttcaaaaaactaattaatggctgcgttagtactgcttgtcggaaacgtgtaggccagatctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagctcatggttccgactactacggcccatagcggactttcaccacctagctaatacccatgccgggcgcactaaaaaaatttttagtcaaccataccagttgacagatatccaaaaaaacagctaagaagattacctcttagctgtttagccagatcgggaaaacaggattcgaacctgcgaccccctggtcccaaaccaggtgctctaccaagctgagctatttcccgaaatagtgccgaggaccgggatcgaaccggtacggttatcactaaccgcaggattttaagtcctgtgcgtctgccaattccgccaccccggcataatagaactggctaagcggaagacgggattcgaacccgcgacccccaccatggcaaggtgatgttctaccactgaactacttccgcaaaagtgacccgtgcgggatttgaacccacgataccagcgtgaaaggctggtgtcttaaccacttgactaacgggccatttttaaatatattaaacaatttttctcaaaattattaactcgtctttcacaacgttattaataataccaactgagctataaaatagcaagaactttttagaaaaaattaaaaaaagttcttgctattgttatgttttccttctaaaagacagcaaaaagactgaaaaaaactcatttctcagtctttaaaatttatatttttaaatcaaatgtacccccttatcaacataaatggtgtcgccagtaactccagttgataaatcgctcattaagaatgcacacacattcccaatttcgctaatagtcacatcttctccgtcaacagttcttgcttgggacatctttaaaagttcatcatgacctttaatacctgtaactgctaatgtcttaaccgcgccagcagagattgcgttaacacggattcgtttttgtcctaaatcccgtgctaaatagcgaacactagcttcaagggcagctttagcaattcccattacattatagttagggatagcacgttctgagccaaaataagttaaggtaacaatacttgcaggattatttaatagatttaactcattagcaaccttagcgacagcaataagggagtaagacgaaatatcttgcgcaattgcataacctttgcgactagcaccaaggattgaaccagctaattcttctctttttgcaaaagcaattgcgtgtacaattccatctacttttgtaaaacgttccttgataatcgtaaaggcttggtcaatactttcatcatctgctacatcacattcaattaattgatcttcatcatctactaaccgttgtaagctttttttcattctggaattctgataagtatagataacttgggcaccttgttcagccatcatttgtgcacatccccatgcaatagaacgcttattagctactcccataacaacgatcttttttcctgttaatatatttcccatattatcctccttaaaactttcgataacgtttttttctgtttgctagaagttggtttggcggtaattcttgcagcttgtttaatcgctttagtaaaacctgctcgatatttttgcaagttttacgatgctcttcgctttctggaataattccttcgataatcccttgttttaataaagcttgcggcaccatttgcattaattctgccgctttatctgctttcgtactatctttccacatgatggaggcaaacccttcaggagataaaatagaataagtactgttttctaacatccatacttcatctccacatgccaatgctaaggctcccccactacctccttcaccataaataatcgtgataattggaatggcaagctgacttatttgtaaaatgttttgggcaatcgcacttccttgcccattttcttcggcttccttgctaggaaatgctcctgcggtattaacaaaacagaatacaggtcgcttaaatttaactgcttgcttaattaagcggagtgccttgcgataaccactaggcattggtgagccaaaatgctttatgattttttcttctgttgtttttcctcgatcagtggtaatgacggtaactgcttgctgatggaaagtagcgattccaccaacgattgcaggatcatccccgcctgcccggtcgccgtgcaactcaacaaaatctgggaaaacattttgaataatctccatccccgtaattttattgtcattgcgagcacgtttaacaatctcgcttgctgataattgttcattcattagcaacgctccctgtttttaatagccattcaagcagctttttttcatcttgacgttttacaattcgatcaataaatccatgatgcaggatgttttcagctgattggagatcaacaggaatttgctgatgaatcgtctgttcaataactcgacggcctgcaaagccaacaagtgcatggggctcagcgagaataatatctccgtccattgcgaaactagctgttactccaccagttgttggatcggttaagatcacaatgtataaaaggccggcagcagcatgctcatttattgcttgtgaaatcttcgccatctgcattagcgacataattccttcttgcatccgtgccccgcctgaagcagtgaatagtactactgcttgacgatggatagttgcatattcaaataagcgcgttatcttttcaccggtaacagttccgagggatcccataataaatgttggatccataatacctagtgaaaatagctgatcattaattgaagcttcaccagttaggactgaatcattcagcttagtttgtctttgaagtttgctgattttttcttggtatccaggaaaatgtaacggattctttgtctggagatccttatcgaattctttaaatgaatctactaaccacgagagtcgatggcgggcaggtattcgtaatccatagtcacaattgggacaaacagcatattgtgttaactgcttggcgaatagtaattgatgacaatgtggacaccttaaccacatttgatctgggaccctttcatcagcatttttatctgctttgatgtgccgttcacttaaagtattattttgatcatataatttcacgctgtcagctcctttttccattgtggcaagaagaagtcttcaagaaacgttgttgaagctgttcctgccaaaaatttaggattgtttaggattgctaaatggaaattttgattggtcgttacgcccgtaattaccatttcatttaaaagtcgtttgattttttcaatagcttcttggcgatcttgaccaagggcaattaccttagcgatcattgaatcataataaggagtgatcttactgccaggataaatagcagtgtcaatgcgcatccccaaattaccgactggaagatataagtaattaatcgtcccagtcactggcataaagttttgtttaggattttcagcatttatccgacactcaattgcatgtccatgaacctgaatatcctgttgggtaaagggaagtggttcattcgcagcgacaataacctgtgccttcactaagtcgatcccagttaccatctccgtcactgtatgttcaacctggatacgagtgttcatttccataaagtaaaagtgatggtccttgtccattagaaattctattgtccccgtattatggtagttaatcgcattaatggctcgcattgcaatttgtcctagcgtttttcgctcttgttcatttactaggacacaaggactttcttcaatcaatttttgtttattccgttgaatcgagcagtcacgttcaggaaagaaaacggcattgccaaaattatcacgaaatacttggacctcaatgtgtttaacattctccataatcttttcaaggtacattcggtcatcattaaacgaaagtcgggcttcgttttgggcctcgctaaatatttgccgcatctggttatgatcgttaattcgtcggatccctttaccgccaccaccagcagctgcttttaacaaaattggatacccaatcttgtttgcgacctcaacagcgtcattaacattggtaatatagtcatcgcttccaggaatcacaggcacccctgattttttcatttgctcccgtgcatgctccttatttcccattaagtcaatcactgaggcttggggaccgatgaacgtaattccgcattcttcacacattgtcgcaaattccgcattttctgatagaaagccaaagccaggatggattgcctgggcacctgtaccaagagcagcttctaaaatgtttttcgcattcaaatatgaatcttgggcccgggcagttccaacgcatacagcttcatccgctagttgaacatgaagactttcgcggtctgcagttgaatagatagctactgtcttaattcctagctcccgtaatgaccgtattatcctgacagcaatttcaccacgattagccactagtactttggaaaacattaaaccacctacccaatcataaaagttaattcggctgtacaggcttttttgccatcgaccgttgcaatgcctttaccaattccaatatttttgtgaactttttctagtctgacttctaaccttaacgtatcgcccggacggactaccttacgaaattctgctgaccgaattccaccaaaataggctgttttcccttggaactcttcttgagataagagagcgacggcacctgtttgcgccaatgattcaacaatcaatgctcctggtaaaactggattttcggggaaatgaccattaaaaacctcttcattaatcgtgacattacggtgtgtaatggccttcttaccagggattaattcatcaacttggtcaattagcaacatcgggtaacgatgcggaaggattttttgaatttcagttatatctaaagttttattaggcattgtctttatcctcctgaactgagaaaagcggttgttctacttcaactaattcttcattgcttacacaaattgaagtaatggttccgttaaaagggctttttatctctgtcatcattttcattgcttcaatcacacaaacaacatcccccttttttacgtggtcgccacttttaacatagggatctgcatcgggggttggttggagatagactgttccgactaggggcgcagttatattttgcgaaggtaaagttagttgttcgtttgcttttttcttagctgaagtcgtttgctctgttttttcggttgttataagattttcatgcttgtgggtttgcttatttttgcttaaatagagctgaaaggaatcttgatttatttctaattcacgaatatcagaatcttcaaaattttgcattaatgtttgaatttctttaaattccaagatagatcactcccatttcttaaaggctaaaacagcattatgaccaccgaaaccaaaagaattgcttattgcgtaacgggcggttgaggcgttcctattttctgccgtcacaaggttaaccgagcattttggatcttgattaaagcaacctatattcaacggtaattgtcccttttgtaaagcggctactgttaagactgcctcaattgcgcccgcagccccaagcaaatggccggtcattcccttcgttgaactaacgcgaacattactatcggaaccaaatacctgattgattgctttggattcgccttcatcattagcatgagtagcggttccgtgggcattaatataggaaatttcgctaggactaattccagcttctttaattgccagttccattgctcttgccgcccctgcaccagttggatcaggggatgtaatatggtaagcgtccgaggtagcaccataaccgacaatctcaccaagaatgttagcactgcgtttttgcgcatgctcaagatcctctaaaacaagtgttgcaccgccttcacccaaaacaaatccttgacgtgccttatcaaatggcaaagaagctttaagcggatcagttgcttgtgataatgctgttaatgccgcaaaaccagcaatcccgatctcattcaccgaagcctctgatccaccagcgatcattactttagcgcgacctgctttaacttgacgaaaggcttcaccaattgcattagttccagtggcacaagcagtcacaatcgatgtacaaatattttgcgcattaaagtgaatggaaatattaccggctgccatgttagcaattgacattggaacaaacattggtgatacccgtctaggacccttatcatgcattttgataatttgctcttgaatagttgtcaaaccgccaattccagatccatagataacacccatgtcgactggcttggtatttgtttcgttaatctccgccatttccattgcttcaatcgcactttgtaaggcgtattgagaataaagatccattcggcgcgcggctttccttccaatgacatcattagggtcaaaatcgtcaatttcacctgccacggtaattcctgtcgacttggcatcaaatttcttgatcgctttaattccaactttgcctgcaaaactattacttataaattcttgaataccgttaccattaggagcaacagcacccattcctgttattacaactcttgtcatttagttcctcctaaattgtcatgccaccgtcaactacaatggtttgaccagtcaaataatcgttttctgctaaaaattttgcggtcttagcaacttcttctgactgtcctaagcggttgagggggatgcgactgagaatttgttcttttactcgctcagataatttttcagtcatatcactagtaatcattccgggagcaatcgcattgcaacgaattccacggcgtgctccttcttgggcaatagatttagtaaggccgatgatacctgccttgcttgccgcataattagcttgtcccgtattaccatggagacccacaatactagcaaggttgataatgcaaccgactctttttttgagcatcttcttaaaaataggttgcgttaacataaatgttccgcgtaaattaacattgatgacctggtcaaaatcgctcgctttcattcccatcattaacttatcattcgtgattcccgcgttattgataagaatgtcgatcttctcgtatatttgccaagccgctgctgctaattcactaactgattcttcatttgcaatatcgcccttaagatagtgataatccgcccctagtagatctagcttttctttaaacgtttttggtaagttatcctgccgcccattgaggattagccgactaccagccttagcaaactctaatgcagtagccgccccaatcccgcgtgtgcttccgcttataaaaacgactttatctgtcagttccatctttttgctcctttataaatttttcataatcagcaagattttcaatgtgttgggtatttaagtgctggtcaacttggtgagcgaagcgagataacgtctttccaggaccaatttccaatattgtgtcaattttcgcgtgcttgactaattccttaacattagctccaaagtgtgttggaacagctaattgtttttcaagaattcctggaagatcctcacaatgaaacaagctgttagtagtattgctaataacttcaatctgtggctcatggaagtcgactgcttgtaaccggttatgcatctgttgacgtgcaccgttaaagaagggagtatgaaatgcaccattaactttgagcaggatcgttcttttagcaagcttgtcctcttcaatctttttaagggtagcctttaaagcgtttaatgccccgcccactacgatttgtcgtggtgaattatagttagcaatataaactcgctgaccattttcttgttgagcggtgattagttcttttatctcttgaagttgaggatcaaggacagctgctaatgtacttatttctctatccgcgtcttgttgcataaagtgagcacggtccgcaactaatttaattccttcttcaaatgaaagtgcattactagcaattaaagcagcgtactcgcctaaagataggccaatcatccctttaattggtagttgaggtaaatcccgttttaacattcggtagattccataactaactgttacaattgctggttgaacatatgctgttttattcaactccttatgctcgtttttcataattttgagcaaatcaagttcacaaacagcgcttgcctgactaacaatccttgaaaaaagggagtcggccataagctcgactcccattcccgatcgctgtgcaccttgaccgctaaataatattccgtagtacattatttttcatccaactgtttctttacgaaatcaacaacgtcactaatagtctcgattccttcatcggcatctaattcaatctcaaacttatcttcaagctcattcataatttcaaaaacatcaagactatcagcatcaagatcatctttgattcgtgcatccattgttacacgattttcgtcaacatctaattcatcaacagtaatagtttttacagtattaaaaatttcctctttagtcatatccattcttctttctctattaatagtttaaaattattgttcctgtacttaacccgccaccaaagccactcattgcaataatgttacctggtttaatcaattcatgagcaatagcttgagtcaataaaattggttcactagcggcagctgtattcccatattcactaatattcattggaaactttgtaattggttgcgccagtctctttgcaatttgggtaattatccgttcatttgcttgatgtaataaaaaataatcgatatcgtctaatttcaaattagcttgttgaacggcagaagtgattgatcgtggtacttcatgagtggcaaagcggtatacgtcacggccggccatcgtaaatggtgaaagggatgttagttgtttagggaagccagttttaggcgttgtttttccggcaataattttatctcctaagtcaccaaatgtatggagatcacggccgagaattaaaggggttgttgtagttgtcttttgaagtaacactccgccagccccatcgccgaacaatacggcagtacttcgatcttgccaatcaatcagttttgataatacttctgcaccaattaccattgcatttttccaatgagagcttttcaacattaattcagctgtattaatggcatagataaaaccagtacaagctgctgagatatcaaacgcaattgcatttttcgcacctaatcttccttgaacaatagcagcagttgaaggagtataggcatcaggagacatcgttgcaataatgattaaatcaagttcagttgcctttaaattggcattagtcaataactgggtaccaacattgacagctaagtctgaagtattttcagtgttgctgatataacgttgatgaattccagtccgcgtcttaatccactcatctgaagtattcataatagttgataattgctggttagtaattttaaggggtggatgataactcgcagtactagtaattcttaaattttgcaatgtttgtcaatccttatctctaagcatgctcatccacaaaatcttctaagttttgcaaggcttttttaacaaccttcatttcttcatcatccattcctttaagaaaacgttcaaccatcatgttatgaaaggcccggtgcgcacgatatagtacccggcctcttttggttaaacataaccgaacaatgcggcgatcatctttatcacgaattctttccacatatccttttcgaattaaacgatcagccattgaagtcattgttcctggagttagatgaagcttttctgctacttgagaaattgtttgatggttatacatcgtaattgcatcaattgcatgcatctctttaattgttaaatcattgaatgtacttttccgcaattcattttcttcaatccatagaattccggaataaactttgattaatcctttattaattttttcgtaatcattatctttactcataatatatttcttcccttcaattttattctatagcccgaataatttgattatcaaaatatattataaatgataatgattcaccgtgctaaatcttttcttctcgttcagcaacgataaagacaagctccgcactacaagctaatttgccgttcacaagcgcttgtgtttctacaatccccattgatgatcgaacttttttcataacaacgtttagttttaatacatcaccaggacggaccatttgtcgaaaccttgctttatgaattgcgccaagataagctgttttcttataaaaatgcggtgattttaatatcaaaattgaagcagcttgggccaatgtttcgataattaaaactccaggcataacaggattattaggaaaatgaccgcgaaaaaatgattcattaattgtgacattttttgttgcggtaatcttttcttcaggaactaatttatctacataatcgatatagcaaatcggatatcgattaggaattaattccataatctcctgcgcattcattattgccaaaaagattcacctgccttcggaaaatatttcgagtatcaaaatattcgataatcaaattatattcaaaagtattttgaatgtcaaattattttcggaaaggtatcttttataactagtcgaaaataaaattatttatcatcttcattagatgctagaaaaggatttcggttaatcatgatttttttgcaattaataggaattttactattatgtcatttaatcattaactattaatcactttaaattaaaatattcctttactaattaattgagaattggtagaataatatttgttcgttattaacgggaaatagctcagcttggtagagcacctggtttgggaccagggggtcgcaggttcgaatcctgttttcccgataggtttagagagtcgttgaaagttttctttcaagcgactctttttagtatcaaggaggatataaaaatggaagcagataaatatttaaagctaattcaagaggagcttcagaaccttcctgattatgttaacgagtattatttagggaccaaccatgcagtcacaacaacctatcagtacttaactgaaatccgtcgattctttgattggttacggtcaagtggactcgtctctgttaattctaataaggacttaccaattgatacactggcgaatctacggcgtagcgatgtaatgttgtatatcgattatttgcagcatactaccaatgcacaaggacggttaaattctcctacttcaatcaatcgatctattaatgcattaaggtcattgtataaatttttaacagttaccgcagataacaataatggtgaatcttattttgaccgtaatgtaatgctgaaaattgactcccttaatgatacaaaaacattaaattatcgggctcatacgctggcttcacacatgtaccggggacaaatgaagtttgattttattactttcattgaaaaagaataccctaataaatgtgataaaagagctctcccctcttataaggtcaataaggaacgagatattgcaattattgctcttattttaggaacaggcgtccgggtatccgaggcggcaaatgtaaaccttggtgatttaaacttaaaacaatcgctgctagatgtaacaagaaaaggtggccagagggattcggtaccaattgctccttgggctattacttatatccaaacttaccaagcgattcgtgcacaacgataccacgctttaaaaaaggatactgctttcttcctaaccgtttatcacaagcaaactcgacggatgacagctaatgcaattgaaaaaatggtcaaaaagtattcaaccgcatttggccatcctcttactccccataaattacggcacacccttgcttctgaaatgtatgaggtaacgaaagatcaagtattagtggcccaacagttgggacaaaaaggaacatctgctaccgatttatatactcacgttgaccagaaacagcagcgtgatgctcttaaagaaattagtgaaacttcatataaaaaaacaaatgaataaaagccttttctataaagataatcttcgctataatgttaaggggtgtataatttttttatggaggagaaaattttgggctttattacctcactatttgggaaaaagcaatatgtttgtccattttgtcatgagcactatactttttctgcaatgcatgcacggaagttagctgacaaagatgggcaaatccactgttattactgtcgcaaggttttacaacaattgcattaaaggattaacgaggatttgtttttttcgataataaaaactttcaaaataaaaaaccgttaagctgaatttaaggcttagcggttttattttaaagtatttagttaactcgacgtttgttaattcctgcaagaccaaacatactaagcaatgttcccatacctaggccaatcatggctttattggcgttatttccagtttgtggtaaacgattattagtttgggtttcaggttgcttaggcgtttctggagttaaaggaacttccggagtattaggtgtatcgggagtttgaggtgtcccaggattttcaggagtctttggtgtttcgggagtattaggtgtctcaggggtttctggtgtagttggcgtttcaggatcatttggtgtagcaggatcatgcggttttaatccataaccaccaattaaatcccaatcaattggtttaccaaattccccaggtaaagcagctgtttgaatgtttcctaacatattattattgttacttgattcgtcccaaatccaatccccttggttagttactttagctaataccatagttgtatcatcaggattaatttgcacaataaaacttggtgcccatgttgaattcataccttttccagcaacttcgcctctatttgtcatatacgaagtaatgagtaattgattttcttttccttctactggaacagcatagtaagaataagtagcggtacgccaattggcaggaacagaagctgtcactacaacccctgaaccatttaatggtttatatggacctgtaagactatcggctacgtaaccaatcattgcaacattatctccgacaactttattagctttattaagagtatcgatattagttcctctgcttaaacgtgtagccgagaatagataatacttatctccaagtttaacaacattaggacgttcaagttcatcactaaccatatttgatgtaactaatggagtatatacttcttctacttgcgggttcttttcatcattcgttagtttaataattccaagtgccccgttagcaaagatagcttttttataatcaacatcactacttaaaagatgaaacaagctttcaatattaaagcgatcgttaccaccataatttgaccaattatataattgatcttcaccttgataattttcagttccagtatttccttcaaatactaaataccgatcaccatttggcatttgtacaacatgtccatcccgcaaagtgtagttgtcagcaaaactatttgcagctttccattgatcataagtttggtaatgataaccatcacctgcaaataccacatgattattctctacattattaatatggacaccatcattgtcggctgttaagtacatagtagcacttgctaatttttgatggttaatagcattatttgtatcattgatagtataaaagagttgaatagagttgtcagaattaacaatagcagacccggaccattcttgtgttagtggagattcattatatccaaatatagatcctgcatttcgccagtgtgaaaaatcattatcaccatacttattataaagtaaataaatatgattatcttcgtgatgaggccgtcccatcatagcgatcacaagttgatagccattccaattagaaacataaccagtcactggatcttgaactggccatgaatcccaaatatctaaatcagcatattcacctgtttcagcatccctagtatatgcagcgggcatattctttatttgacttgcattaaaataaggaatagcgtatttaggatcttgatcaactaaagcctcaccaatctttttaaggtcattataagtcatttgtgtaccagactttgcagctttcgagaagttcatcttatttaatgtaatgctttaatctggtcatcagttaaactattaggatcaatccacgccttttttacaacgttttcagcatccttgtttaacttagcggcagtattctttttactggattgttgatcatcgtttttggcagctgaagaatcattagtgtttacagctggttcttttttggcttcagaggattcgttagcgggtgcagctttttgtgtatcatcctctttggctacattagtattttctgtagctgctttactatctgtgttagttgatgaagatgctgaacttgtagatgaagctgttgcagcagaacttgctacttgactgttagaattttgtgtattagcggcagaagaagcactatttgcattagcagaatttttagtcgcatcactagctgcactaacctgaccactaccaagtgtcacacttttaacagcaatatcattatcccctgttgtaacctgtacagtagaagaatcattgttttcagtattcgtgtctgcggatgcgtttacagttgttacaccaaacaccagtgcagccgtagaaagtgtaacaactgcccaatttttaccacttttatacattttcttatgttccttgcgttctagcatagaaataaccccgtttctttaccttttttgctaaacgtttaacaattaactgtgcactattttattatgattatcttaaattatcaatagtttcttcataaaaagttcatatttaaatatttactgtctatttactcattttttgatatcaatatgcgtttttcttctgagacgaattgtaacgacctactactcatcaaaatgaatttcagttcgtctgagaggcaaaatccgtttttgcccctacttttgcgttatttcaaaatcagtaagactcttttgataaaagagtcttacggtaaccgagaataaacgttgatataacaagcttttaaaatcctatattttcgtgtgagactgttgtataattttattgaaaaagtgtctcactaaaaattaggtcatttttgctatttttggcggacaaaaaggagttatttcattttatgttatataatgcagcattagttttagaaggtggcgcattccgtggacaatatactgccggaattgttgatacatttctcgctcaccatattgaatttcgaagtgtaattggcgtttctgctggttcactttgtggagttaatttcgtctctaagcaatacggacgcgctgccaatattaatattgatcatcggcacgatcgccaatatatctcgatggctcgcgtatttaaaaagcaaataattaatcttgattatctttttgaagatcacggatattcttggcagaattttaatgaagctgcatatcgacggtcagcatctcatttcacagcagttgctacttctgtgaaaacaggaaaaacagttttatttacggatcctgttggtgaggagctaaccaatgccctcaaagcttcctcatcaatgccatttctttcagatccacaggaaacttctcaagggccttgccttgatggtgggatcacagattcaattccatttgatattgcacaacgacaaggctatgacaagattgttgttgtacggaccagggatattaactaccgaaagaagccatctagttctgctgtaaagaagttgtacgacatggtatataaagattatcccgaatttgctaaagcggggattgatcgtccccttctctacaaccaacagactgctgaaattaatcgtttgtcttgtgaaggaaagatctttaatattgctccctctaaaccaattaaaattaagcggattgaaggaaatattaagaaaattcgagcactttatgaaactgggcggaaagaaggagaggaaatcgtccctgctttagttgattacctcgcaaattaacaaaggaagaaatattatgtcaactaaaaaacgagtttatattcccaaaaataaaactaatggtcaaatcaagggtaaacggaaaatatgggtagaaaatgttaaattcttgactctcgaagaatatgatcagttacgtgagacaattaagctgcattcgcgtcctgaattggttaaccgaaacctattactaattgcaattgcccttaataacggattgcgagcatcagacgttgtaacgttaagggttggtcatgttctaaataaaactaaaacccgtgttattgagcaaaaaacaggtaaggctaaaacgctcttttggaataattgtcttgccgaaattattgattatcttaatgacttgaattataaagacgagaatgattatcttttccctgggaaacaagaaggtcatttttcagtacatggcttttacgaaatgttgcaacgaatggctagaaaaacggaaaataataaaatcgttgctaaaattggaacacactcttttagaaaaacttttggtcgacaactctataagaaaggtgttaacgttgaaatcatttcgcagttatttaatcactcctctgaacgaaatacgcgccactatctagggattgaacaagaagaccttgataaagttgttcaaaatttcaaatttgaatagttattattctgaatattatgtaaactaaaatatttaatcgttttcctaatagacttaggaatataattcattagaattaaagtaataaaaagtattggatgtgattaaatgaatataaaaagtgtaccaaagaagcaactatggggaattgaattaaatctgatttctctcctatttagtagtattagtccggttcttaataaattttcacttactagcttgagtccggttgttgggggaattttcactagtgcgtttgctgcaatttttacttttgcaacaatccttattactcgtcagcatgtttctttaaccaaccttaagagcctgtggttatggcttttgggtggaacaaatgcaatcggaattattcttcaatatattgctctttcaaccttaagtccaatcactgttacccttatcgctcggatgtatttagtttatgttttcttcctatcttatatcttcttaaaggaaaagattacaaagtgggattacttagcaattattctttgcattctcggttctttctttatttcaggaagccgacttcaatttagtgataaccttcttggattgatttgtgcattcatctacccactaatgtatgccgccaacaatatcgtggctaagtatctagttagtgatgaagagccaaataatgtcttgttctttaaccattttacttcggctcttttacttttctgctatgctctcataacaggaacgtcatttagccatatttctagtcaagcagtcgcatttaactttggcggagcattctttaatggtttcatgtcactacttcttttctatactagcttgcagtttattacagctggtaaagcaaatattgttcgtgcacttggtccagtaattgttattatttactcttcatttttctttcctgttcaggtaactccttctctagttttaggagcaattttagtaattttagctagtgcaattgttacctttacaagaacaaatcacgaataatcgtaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacatataaaagcatcagaatttccctgtaaagaaatctgatgcttttattatatcttcttatatattaataaacccttgcgcgtcgacgataaacaataaaacgacggaaaatatattgccaaggtagcgttaaagcgtgaaccaaccgggtgtatgggaagtaaccaaaaattgctaatccacaaagaacatgaattttataaattaatggcactgaacgcatcaattgccattgaggattaagaacaaatagacttcttgcccatggactaattgttgtccgataattgtaatcaataaatgcacccgtaatagtacatgctagacctaatgcaattgtaaccaataaagcccagtcgacaataatatcattgatatcacttgtcttataaacacgagaacaagtcattcgccgataagtcaaaattgcaattcccacaaatgcaaggatccctgctggaattcccatcattaatgaaccaaagatgtggtacatgtggtcagtaatgccaaagtaagcagtccaacttgctgggataaacattcctaagcagtgaccaaagaaagctaaaataattccaatgtggaaagtaacacttccgatcattagccatttcttttcaaaaagttcacttgatttggcagtaattgagggatgaaaatatttaaatctagcaaatgttccaatgaaaaatgatgccaacattatatatggataaataacccataagaaaattgaccagccattatgcatcttcttgcacctccattttaatacacgaaccaattaatgaacgtgtaagcctgattaactgaatatagggactatcactatctgtcactgcattttttaaaagggtataagttccatcttcaatcacacttaatgctaattggatatcctgacgacgcggatcattagtataatcgccatatgctagaaattctaacaatagaggcaaataatcagaaagttcactggtcgcctctgatataccaaacatctcatatagcattttcaaccgtgctaaaatggtccctcgttcacgggaatcggtcatcttatagtatgacatataaagagtataacgtcggttcatttcaaaaaggtgagcgtatatctcttggacttcgattgaagatagtgcggctaattcatcaaaaaggcttaataattctccccgcgttgctgttgataatgcgttatctgtaagtaataattgacgaatctctggtgaaaacgtttctgtatcaggatagtcaatcaaacgggaaagaacggcaaatgtatcctttaaatctgtcaatcgtctaaaatcaatcacgccaaatccctccatagaaactatcagcataaatctgattagttgatttgccagcttctgccttcttaaacatactcttgtgttggggagctaatgcacagccttcacattcatcatagccaagactaccttgttcggtttgtgcatcttccatttctgccttttggctacttggaataacaaagcggtcttcatatttagcaattgccagtaaacgataaagtgatgttgcccgttcttctgttaaatcaactcgttctagtttactgctatcaaaatcccgaccactagtcttagcacgcatgtatagccgcatcattgcaagtttatataaggctttcttgatgacaggaacgtttccagcagttaatagacttgccaagtattgaacaggcacccgcatttgatcaattcctgggaagatcatttcaggattctttattgagtcccgtccttcaaagtaactcataactggtgatagcggcggaatgtaccaaaccattggcattgtccggtattctgggtgaagtgggaaggcaatcttttcttttactgccattttatagatcggtgacttttgtgcagcctcaatcatctcttcagaaatgccatccttgagtgcttgcttgacaacttcaggatcgttgggatcgaggaataagccaagttgtgcttcatacagcttactctcatcaggagttgatgctgcctcttctactcgatcagcatcgtatagaatagcaccaatatatcgaattcgaccgacacaggtttcggcgcaaactgttggttgaccttcttcaattcgcggataacaaaaagtacatttttcagccttatgagtcttccagttaaagtagaccttcttatatggacatccagtcatgcaaaaacgccatccccgacagcgttcttggtctactaaaacaatcccatcttcatctcgtttgtacattgcgcctgatggacaagaggctacacaaggtgcattcaaacagtgctcacataatcggggaagatacatcataaaggcctgctcaaagttatttttgatatccccttcaattttttgcatgttaggatcctgttggacatattcagttgatcccgctaagtcatcatcccagttaggaccagtggttaattccattccttcgccagtaatttgcgacttaggacgagcaacaggttggtgcttttgttcagggccaaataacgtcttataatcataggtccatggttcatagtagttatctaactctggcatatcattattgtaaaaaatcttaccaagagcgattttatttaatttgcttccagcacgtaattttaatttaccttttgaattaagggtccatcctccatggtattgatcttcatcttcccagcgttttggataaccgacacctggcttagtttcaacattattaaaccacatgtattcagcgcctggacgatttgtccatgtattcttacaagttactgaacaggtatgacaaccaatacacttatcgaggtttaagaccatgctgatttgtgctttaatcttcactccagttcaccttcttcaactttcttacatttgcataaagatcacgttggttcccagttggtccatagtaattccaaccgtaactcaattggccgtatcctccaaccatgtgtgttggcttaacgtggatttgcgttggtgcattatgtgatcccccacgattaccggtaatggtagaaagaggttcgtaaatttcgttatcttgggcatggtacatgtacattgacccctcaggcatccgaacagaaacaaccgcccgcgcagtaacaaccccattacggttataaacttcgatccagtcgttatcttttaccttaatcttatcggcatcttggggactaatccaaatagttggaccaccccggaataatgtcaacatttcaaggttatcgtagtacatcgtatgaatattccatttaccatgaggagtcatatatttaagtgtaacttcatcttttactggtggaacatcaatatctcctggggccattacaactggtggtaaggatggtttataagttgccatattttcaccaaattcacggaaaatttcatgatcaatgtagaaatgctgacgacctgtaagagtaaatgtaggaatatttcgctcagtcattaatgagaatggtgtgtagcgagccccaccatgtttagcagaagttccgattggtgttggataggcttcttgtggttgagcagtgatttgcttaaatgacattgaatcatcagcatgaccacggccaatatctgttaaatattcacccgttcgctcttgcttcttttcccaggctcggtcagcgagtttaccattggaagcagttgacatccgtaagattgcatcacatactttttcatcttcatcaagtaacggacagcctgcaccaatgccttcgctggcagttccatttatttcctttaaataatcatattgatcatcgactttatagccatagttattcactatattaggtccaagggtaatgaatttatcgtaaatcttggtgtaatcacgagtaactaatttcaaggaaggcattgtttttcctggaattggttcagtttcaccattcttccaatctttaatttccccgtatggttgagcgatttccccttgagtattatgtcctagtggtgcgctcttaagatcatagaaggttcccggcatgtatttctttgccatttcagaaacagtttttgctaagagcttgaattgttgccagtcagactttgattcccacattggactaactgctgcattaaatgggtgaataaatggatgcatatcagttgatgaaaggtccttcttttcataccaagtagcagctggtaggacaacatcggagtacattggtgttgaaaccattcggaagtccatatcaacaacaagatctaacttaccaattgctcctttatcacgccaaatcatatcctggggcttaactcgatcattaggtttagcaagcaatccattttcagcgcctaataaatgtttcataaagtattcggcacctttgccagaagaagcaaataagtttgaacgccataagaagaacgctttaggttgattttggttagcatcaggatcttcagcagcaaaatgtaaagagcccttcttcaattcatcgacaactttctttgaaatttcattaatatcagttgtattgtaatcttttgcaaaagataacggattacgatcaaattgtgggtatgatggtaaccatcctaaacgaattgccatttgattataatcagcattatgtaagtaggaatgtttactcttccaaacaggtgatttttgagcttggttatcaatttcttcataacgccattgatcagttgcaaagtaataccaagtagtaccttgcatttgacgggcactacctttttcccagtcattagcaaaagtaatatttgcccaaccctcttgtggacggagcttttcttgaccaacgtagtgagcccaaccaccaccagtcataccaacacaaccacacaacatcagcatattaataatgtttcgatagttcatatcggcattgaaccagtggttgactccaccacccatgattaccatactccgcccttcattttcggccgcgttttgggcaaattcacgagcaatttgaataacttgctctgcttttactcccgaacggctttcttgccaagcaggagtaaagtaactctcagcatccattgcatctttagcagcaagttcatcattaccagtccgattaattcccatttgagccatcatcagatcataaacattagttaccaagtgttctttgccatctgtgaatttgagctttttaactggtaaatgacgttgcacaacgctgtttccgtcattactaaacgctggaaaatcagcaataatttgttcagtttcgccatcttgatcattaatagaaagtgccggatcaatcttattaccattttggtctaataattcaagattccatttttccttagcattatattcttgtcccatcgttccatttggaacaacaatcttgtggttattttggtcataaacaactgtcttccatgctggattgacaatcgtatcatcagcaactaagtcactaatccggacgaagcgacctggtgtatagtgatcaccatttgctgtacttggttccaattcaaccataaatggtaaatcagtaaatcgcttggagtaatcaatgaaacgtttaactgggtgcttttggtagaattcatctaaaattacataagtcatcgcttgagcaacagcagaatcactacctggttctggtgcaagccaatcatcagcaaatttcacattttcagcataatcagggctaactgccacaatctttgttcctttgtacctaacctctgtcatgaagtgcgcatccggcgtccgagttaatgggacgtttgatccccacataataatgtaagaactgttataccattctgcggattctggaacatcagtctgttcaccccaaatctgaggagatgcaggtggtagatcagcataccaatcgtagaaactcatttgttccccacccattaaggcaatgaaccgtgctccggcactaaaactcatcattgacattgcaggaattggggtaaaaccaccaatgcggtcaggcccatacttcttaattgtgtataagcaagcagctgaaatcatttctaatgcttcataacgatgaacacgaattaagccaccgtgtcctcggaccttcttatattttttagacttttctggatcttcgacaatacttgcccacgcatctaagggattttcatgttctttcttggcagcagtccaaagctcccataacttgccacgaatatatggatacttaattcgaacgggactgtattcataccaagagaaactagctccccgaggacatccccgtggttcatatcctggaatattaggtccgcatgatggataatctgtggcttggtgttcccaagtaataattccttgcttgacataaacattccaagaacacgagcctgtacagttaactccatgagttgttcggacaactttgtcatgcgcccatcgctggcgataaagcttttcccaacgacgactattttcttcaagttgtgtaaaggttccattaaacttatcaaccttgttaaagaaccgtgacttcatcgttgattgacctcctttattgaatggcttaccaatattaaaaataaagtaagtcttttccctaatgtaaagattagcaccataactgctatactacgactagggaaatacctatattttgaactaaatgaggtgctaatatccatgaatcgttatgatcgtcaagaaagggtacatcaaattggtagtattggtcagcaaaaaattagccatgcaactattatgattgtcggtgtaggggcattgggaagttatacagccgagcaacttgtccgtgctggagttaaaagacttatcttgattgatcctgacactgttgacgtaactaatcttcaacgtcaatcgcttttcaccgaagaagatgctagccaacaacggcttaaggtagaagcagctaaagaacatttacataaaattaattcagtatgtcaaattactgcgatcccagcgccgattactgctgaccttattgacgaatatcagtttaccctttgtttagactgtcttgataattatcaagcacgggatctattaaacaaattagcaatcatcaaaaactttgattatctgtttgccagctgtgcaggaacctatgggaacgtaatggcgatttcgccacaaaatcatccctgcttgaactgtctttttcctaatattaatgaattaaaacaaaacgattgtgatttaattggggttaatactgctttaatcccgattgtggcgggactacaggtatctttagcgcttcattatctggttgacaaaacacaggttaattttaatgaattgatcgcggttgacaattggtcaatgcaatttagtaagtttgctattaataaaaattaccattgtcccgcctgtgctaagccaagcagtatttctttagaagaagaatcagcaccagaattacatatattatgtggggaaaatgcatattatacgatcaaagagaaacctattaattttggcagacttaaagaatttttggctaaaaaagagctcttaatcaacgcaaatcgattgtttcttcattttaaatgggaaaatcgtccagtaagtatattcaagaatggtaagattgttatgtatgacttacctacttcggcgattgcccagaaacagtttaagtcgttaaatattttgatgaaagaagacctattatgaaaaaaatcgcaattttaacggttagcgatagccgaacattagatagcgatacttctggaaaattaattgctataaagatggctaacgcgggcttatcagtagttgatcgggtaatcgttaatgatgatattgtcaatattcaaactgcctaccttcaactagaacaacaagctcttgatatcatcattactaatggtggaacaggaattgctcagcgtgatgttactattccggctatccgtccactcctcaaacgtctaattccgggttttggggaagcgtttcgccagatatcttttgatgaaattggtactcgtgcgcttgcatcacaagccctagccggatttaatttccgcaatcagcttacctattgtttacctggttcccagaatgcctgtcaaacggctctaagtaaactaattttgccagaatatgaacatttattatttgaaagcagttctcaacgaaaggaagttcatcaccatgctcactagaagaattccaatctctgttgccgaggcacagaaaaagattaacgaaattccccttaaaacagctacagagacaatcccgttatcagaagctgaccaccgtgttttagctaaagatgttcatgccaattatgattatcctcattttcgacgggctggaatggatggttatgccattttagccagcgatgatcatgacttccctcgcgaatttaacgtccgaggagagattcaagctggagcaacttgggatcaaccattacaatcaggggatgcggtccgaattatgactggtgcatatgtcccttttgatgtaggaaaagtaattcgaattgaaaaaacgcggcccgctaaagatgaaaataaggttcaaattattacgactgaaagcaagactaacattacggaagctggtactgatgtaaaaagcggtgatatcgttttagcaaaagaccaggaaataaatcccggtggcctagcagttttaacggcttttggtgttcaagaagtaacagtttataaaaaaccacggattgcaattatcgccactggaactgaattattaggacctaatgccacgattgaaccgggaaagatctttaatagtaatggtattatgttaaaaaatctggtagaagaaactggtgggattgttgattttgaaacccaattaccagatgatgctgatcttatcaagcagactcttgaagaacaaatagcaactcatgaaattgtaattactgatggtggtgtttcagttggtgattttgattttattggagatgaagcacgtaaagctgatgaattgctttttaataagattaaacaacgaccaggaagcgttacgactgcctttgttcaaaataatacgttaataatggctctttctgggaatccaggagcttgttttactggtttttacctttatatggaaccgctgattcgccgttatcaacaccaagccagccgaattaagcaagtacgggcaatattagcggccccatataataaaactaacggctttgatcggtatcttcgttgtacttatgaattcaaagataatcaattttatgtttatccaaatggaatcaacagatctggctcattagctaacctccagacgacaacctgtttagcactgattccgcatagtactactccaatgaaggtcggaacggagacagacgcatggctattacccttcaaataatcggtcataaaaaaagcggcaagactcttatcacgacgactttaatcgaaaggctctcaaaagaagggtatcgagtagctgctcttaaacatgatgcccataatgccgcaatggatgtgccaactactgacagtgctagaatgagtagtgctggagctaaacaggttattttacaatctgcgactgaatttttctttcatcaaaaaagtaatgttccgtctttaacggaaatggttgaattattaagtaccgataatgattttgtcttgattgaaggtcataaggaagccactcaatatccgcaaattttattattaaagcctggcgaagatcctaccaatgttgctcatactccccctcttaaaataggtagtatctttaatggaacaaccgctgacttattaggaaaagatgcaattgtaaattggtgctatgactacttaaaacaagtaaagggggatgcaggatgattggattagtatatgctggtggtaaatctacccgttttgggaaagataaagctacttatcatgttccaggattaccagctaccaatatagagctagcagtcgagaaattaacacccttttgtcagcaaatcgttgtttgtgctaatgaaataaatcgagcgcatatattaaagttggttggtcaagaaccggctgtgcagattatctgtgatatttccccttatgatcatcatggtcccctttcagcaattattgcttgtactagtcaattttccgttgttcaagactatttaactttggctgttgattatccatatatcacaaaagatgtacttgctgttcttgctcgtacgtccaactcttatattgcaacaagtcagcacaatcactattcattagctcatttttcagttagcaatgaacaagttactacttgggttgataataatgatgactggcgattacgtagtttcatcactaataagtgcgtctgccacccccttaagtatcgctcaagtaacgaattttcaaatttaaactatcgtgaggtcgatttaaatgaaaagtaaagattcaatgacaaatcctgattttcaaaagctcatttcccttgttttaaatgacttaacaattagacgaacaatgctagaaaatcgggaacaagaagtaagccaacaaatgagttcgctggaaaaagatgcggagttagaacaactggacgaccaaattcaacagattcaagctgattttgatcattaccgcgaatttcaggatccgaaatttgattttagtgcaactaagtatttccagggaccatcgatgggattaccacgacatccttaaaactcagacggcagggctaaagaagcagagcttttcttagccctgccttttaagtgggccagcgttgcttctaactcgagaaaacgttattatataaaataggaatattataaagacaattaattggggaggaagcagatcgtgcttgaaactgctaattggatacaaaaatattttaatcaatcaccagatgcaatcttcttatttaaaaatgatgatcttttagttagtaatgagccggctcagcggttagtaactatgcttaatttagatgttaattacctactgcaaattggtaaaaacgcttggtcacaactagaaaatgatgattgtgcttcatgcttgattaaaaagcggttaacgggagctaccgttccgataacgtttcactccaacgctactcatccttttcatttttcaatggtttatcgtcctcttgacgataaagaaagtgtctttgccctgactcttgaaaatcgtgagcaacagcaacgcctttcgcagattgaagagcaccgaattctcaatcaatatgtcaatgaagcacacgaaaaggaacggcaaaaaatctcacaagatcttcacgatagtgttgcacagggaatctacgccgcaataatgggcgttcaaagattagcaacggtgcaaaagcaacgaaatactgagcaatttcaatcaatgagtgctgcaatcgaaaagcaattacaaacgacccttaaagagattaaagggctcgcacttgatattcgcccctcagttcttgacaattttggcttaattccggcaatcaaagctttggcgaaacgtcttcaaaatagtacaggaatcacaattgatgttatagcccttacctctgctgaaaaattacaaaaaaacattcaaaacgttctttaccgcattacacaagaggcaattaataacgcaattaaacatgctcattcaacagaaataagtattattgttacggatcacaatagttaccttcagttagagattcttgataatggaattggatttgatattgatcagcatagtggatttaatgggcattcacttggattaatgaatatgaatgaacgcgttaaggcatataacggagcctttacaattacatcaaaaattaataagggaacgacagtcaaggtaaagtttccctataataatgctttaaataaggatatggtgagaacaaatgtataacgttttagttgcagacgaccacgcaattgttcgctcaggaatttcatacttagtcgatcttcaaccgaattttacggtggttgatgggacagcgagtggaactgatacatatattcgagttgaacaaggcggaattgatatcttaattatggatttaagtatgccccctggcgaaaatggcctaattactactcgtcgaatccatgataagtttcccaaagttaaaattatcattctctcgatgcatgaagaacaggaatatatcaacaaggcaatggcaaatggcgcaatgtcttatattttgaaaagttcaccagatagcgaaattgttaatgccctaaaacatgttataaatggcgagaaatatcttgatgcaaatatcattgttagtaagacagatattagagaaataaatgcatctggtaataccttaaaattaaagggctataatagtctttcaaaaagggagaaagaagtctttccacttattgctttagggtattcaaataaagagatctcacaaaagatgtttatttcaacaaagacagtggaagcccataaagcaaatatttcacgcaaacttcacttacatggacgggttgaactagtacaatatgctattcatcaccatttaattgacctttaactaggcggggattcttaattaggaagaatccccgattttatttacgtcgatgtttttctacaataaagaaaatacgattaaaggagtggattcctaatggcgacaaacctcagtcgagatgatgaattacgaggaattcttagtgatattgctcgcaaacgttttactaatagtcgacaagttaatcccgtttccaacctgtttttaacaactaaatatgcagttgaaaaccaatatatttctggagcagttattgacgaatcatttagttcaacattagcagagataaatttaaaagatgctgctttaactgatcgcggccgtaataagcttgcacaacttcttgctcaatcaacaaaggagaattaattaagatggatattcaagataagctaaaacgagattacgaaaataaatcgatctatactgcaggcttttacgcagatccagataatgaacttgcaaatcgtagaaaattatttgatgccttaaaatcattagtcgagaatcaagaaacaaccaccccgtttgccttacaaatcatgcttacaaatggtgaaattaatgtaatgcccctcggccttgttgatcttgatgaacttaaaaattatgaaaatgagcaacggtccaagcacggtctagatgaacataacgatgatattcctcttctaattcaatatgcccctcatgtagagaaaaaagaagtggttaaaaaaagaataggcaccgttcaagatcttttcacaaactttaatgaacaaattgaaaaaatatggcaaactgttaaggaatttatgcaagataattttgctttactaacgattatcgaaaaggatttgattgcagataatcagaatgtgatgcaagagtatcagatcactttttctaagatgactgaggcggaacgaaaagaaaagctgggatttagtgttccagaaaatgaaattaatcaattctgccactatatggctgatatgcatgaagttcaagcaatcgtattatctgcgggagcctttgctaaccatgagcttcttggtaaaaattcctttactgaaatgataagcgataatattcgacggagcaccctcttttgggttcttgataataccttctacgaaatttattactatttctacatgagcaatgacaacgagaagctacataagcgacttaaacatcaacgagaagctcttatcgttaatatgcgtaatgatgcttttcaccgtgcacaagaatttactgagaagcaagtaaaaaatgttgattttaatgagtatttcagtgatatcttcatccccgttgctgaacaaataattgctgaagtaaataaatttaaggactgatactgtgaatttaacgccagatgaacggttggtagatgcattaacaaccgttatttatcaatatccaccaatggttcgcgaaatgattaacttgagtactggtgaagaagaacggcggctaaggttgtcgctttttgaggcttttagttatttcaacgaaaaagatctcacaattgatcaaattacagctgctcaactaccagaactattggcattagcaactcatttgaatcctccttcttttcagccaaataacctaactcctgggaaattcgctagtcaaaaagcttattcatatgttgcgagctacttaatgaatcgctttgtccgttcactaagtactgtaggtaatcctccacaaataattgaggagttgacaactgacgctggagatgtgatgcttgcacagattcgacggctacagtttaactataatcagcaatttaaggtagctgactatttagcagatgttaaagcacgatggggattacttggaacaatgactgcaaaacaaagtgccgtccttagcggagcaaaaagggaaattgtttcacttgcaggacagattggtcaagcctttggtactgctagttatattacatatgagtttcaacaactcagtaatgatcccgactcatttgtaaagatgataacgagtggtcagtatcccctggcacttttattcgcgcgccaacagaatccacaatggtttagtgatttcttcgcttcagatcatcgtccttcacaagcgatgtttaagcaagcccatcaattagcacttgaacgaattgatgatgtcaagcaactaattgatgatatcttctcccagctaatccttgatattaaagtgttaccagctggccaaactcaggatgaattgtttcgattagttgaaaaattaaaaaaagaataatttaaaactaaaaatggagattagggaaaaattaccctcatctccattttttcaatgtattatttaacgatgtgaacatcaccatgaatgtaatgtttccatagagcaaaccagcaaattacaccggttaacgctaagagtgcaattccaagctcataactacctgtccattggtaaatataaccaataattagtggtggaaagaaacctcctaagccaccaactgctccaacgaaaccagtaaccgctcccgtattaccttgggatacatatggaaccattttgaagacaaccccgttaccaatccctgcagaaagaccaaccaaaacaatccctgcgataaacatgaattgattgtgaaaactaagcataatccaaatagcaaaaataacgattgctacaaagacccattgtaataatgccatggggcgttttctatcagcaaggtaaccaccaaatggacgaactaacgtacatacgaaagcaaataatgctgaataaaggccggcagtaacaggagtataatgaaacatccctgtcaagaatgttggcgttaagtttgtaaatgcaacaaataagccaaaagtcaagaagtaaaatagtgatagataccatgttccactgtccgcggcaacagacaatgcgcccttaatcgttttacttttatcaactggcatttctttacaaaaaactgcgaaaagaacaccaaagatcactgtaagaataatcaaaaagtagtaaacactatcaaatcccgctgccttggaaatataaggtaaagtcatggcagccacagcattccccatattccccattgaaacgattcccagggctagtccttgctgttctggcggaaaccaaactgaagcataagaaaccccaacggcaaatgatgttcctgacatcccaacaagcaatgcggcaaagagcaacattccaaatgaatgaacatgtggaatcataattagtggaatcaaaataaaggccattaagatcaaataaacctttttcccgccgtaacgatcacttaagatccctactggaattcgcataattgatcccaaaaggactggtgtcgctaataacaacgttcgctgcgatacatccaaattgaacatctcagcaatttgggatgcaagtggcgcaaagttagaccacgacataaaacaaacaatcattgcaagcgtggagaggatcaatgcagtataagcatttcgcctactcccatgagcaacatctttaacacttgacataatcaagtcctcctcctatgtaattctaactatcttctagagtaatctagccaccactaaccggcggaatgattgcgatttcatcatcggcctctaaggtaattatatctgcgttaacaaattcttgattaattgctatccgcgaatttgctaaagttgacgtcagttgtggtgcccgctggctaatttgcttaagaaggtcatctactcgaataggattagcaacatcaagagtaatagatggtcctaactgatcttgtaaaaacgcaaataatttaacgttaatttccattagtttccccaccttaccttatctgtatcatattcctttttccagattggtacttcatgcttaagtgtatcaatcacatgttggcaccatttgaatgcttctgcacgatgcggagccgccacacctacaaataccgcgatatcagtaagcgtcaattcgccagtccggtgagcgacaacaacgcgtcctccttgttcttcaatcggtgctgcaattttttctaattgtttttccgccatgggatgataagctgaatactcaatcttagtagtctcgatctcgccagtccattgacgaacagtgccgacaaacatatcaattcctccgtattctggagcaacaagctgtttatacatctcacttacatcgatgggctcatcgcttattcgtaaataatgcaacaataatcacccgcctttatcatgcttattattacacacgataatggccctttagaattagtcaaatccctaataataggattttaagagacttgttatactagcacctgaatgaaaggacgattaatcaatgaatactttaattctctacgatacactctacggtcataacttcgaattaggaaactttattcaccaaactatccttccgtctgccatttttctttcttttaaggaggccttacaagtaaaattggatagtattgacttgcttatcctttgtccctgtacttatggcgaaggacaactcacagcctctgaagaaaagttctataattatctttgtcagttttctgtcccgaggctggtttattatattgcaggtgtaggagataaaaattttggtccagcaaaatttgctaacgcagtaaatatttttaattaccaattgcgtcaacatggtgcttcaccattagcgtcttcattaaaaatcgactatgaagacctgccaaccgctcagcaaacagttactgatgaaatcactaatttcttaagaaaaggaagagattctaattactaagcatcattatcatctaacactttttactgcaattttgttggttattgttacaatcgttctcgctctttcttgtgggcggatctattattcaccaatcataatctttcaaacgctacttcatccccaaagcaatccagccgcagcaaacattatttttagccttcgtcttcctagaatcatcggtgcgctgttaattggtgctggtctagcaatggctggttgttctttccagagtgtttttcataatcctttggtctcgcctgatattttaggggtgtcgtatggttcggccgccggggctgctagtgcaattctcttaggctatggcattggacttactcagctttttgcttttgttggtggaattattgcggtcagtttaactttattgattgcccaaatccttcatcagcgcggaaccttaattctagtattagccggaattgtgatttctggttttatgcaggcattagttggattactaaagtacattgctgatccggattcacaattacaaagtattgtctactggcaactaggcagtttagcaaaagttgatttttcaaatattatcgctgtccttccctttttgcttgtaggtacaataattctatttgtccttcgctggcatatgacaattctttcacttggcaaccaacaagcgcgcctagaaggaattaatgtggatatggaacaactactgataattaccgccagcacgtttttaaccgctgcaacagtttgtcttagcggaaatattggctggattggacttgtaattccgcatattgctcgacttttagttggggataatacaaaagaaacccttccccttgcagcagttattggtgcgctatttttgttaattgtcgatacaatggctcgatccctatcggcaggggaaatcccgttaagtatcctaactggcttcatcggcgcacccttatttgtttatattctaattaagaagaaggtgcaattaaattgaaagtcctcgaagttaataaccttagttttgcctattcaaaaacacatccggtctttcacaacgttaactttagtctcgaagctggagaagtatttactatccttggccctaacggtgtcggaaaatcaactcttctccactgtttagtcggacttttgacaccaaatgaaggaaccgtaatagttaacggaaaagagcttggaaatttgaagcacaaaacgcttgcacaacaagttgcctatgttcctcaggattatcatattaattccaatctcacagtacttgattatttattaactggtcgtgcaccttacctttcttttctccaaactccgcatcagaaagacgttcaacttgctgaaacctatttacaacgttttcatctttcaccttttcgtgatcacccctttatctcattaagcggtggtcaacagcaactaattacgattattcgagccctacttcaagaaccgcgcttgttaattctcgatgaacctatggctgcccttgatttaagtcgacagtacgaaatattaaaactaattcaagacttagcccagcaaaaaatcaccattattcttactactcaccttccagaccatgctttaatgctaccgactacaatcggtcttcttgattcaaaaggttccatggttactggatcatgtgaagagttaatgtcaactaaacagctagaaaggatctatcatgttccactaactcttacttatctacctgatcttcaacgatatacttgtcaaattaagctctaattaaaaacatccccttgctttggataattaatatccagtttaggggatgttttttatgctaattttcaccagctaaaatttgctttgcttgtttaactgttaaattgtagtggtagtatttttgataaaatttttgaacttcagagaccatgttaatattcttcatttcttggggatgaagagtcttagctgcccataagacttgaagtgcttcttctgcactataacgatcccatgggaaggtcccttgaggatttccgtatactttgttttcgcatacagccttcaattgacttagctgactgttagcacgtaacgcttttcgcgcttgggcagtagatgtactaccaacgataattacatctggattcgctttaatcaattcttcaggcgtaactgaaatttgatttccctttttagaaatagcattctttccacctgctagtttaatccattcgttaacaattgttttttgtccgtcaaccttggtaagatctgttgcattaacaatatgaagaaccgttggcgttgattttcggctcttcaaatgctgcttaacaagattaatgttgtttgttaattctttattgtattgccgagcaatctttggagaatttccccctaaaatttctgcagttaatgtaaccgacttctttaacccagcaaaatcagtatacattgcgttaactgttggtaattttgcttgacgggattcctttatttgagcttgatcggaagcaattacaacgtccggttttatttttactaattcttcaacttgaatttgattgcctgctaatggcgcagcaactttagcaatttttggatctaccattgtgaaccaatgttgtttcttaacaagaggagtagtggcaactagcttattttgtcctcctaataacagcacaacctgattattagcatgccataagtcagcaacgcggttaactttctttgggatctttattttctcccctgtcatatccgttatggttcttgttgaactagccatcgccgaactgctaataatactactaaacagtaaaaagattgctaaaagcttcaataattttttcattatagtctcctctattttatttatatttaattataggcgagttaaatacaaataaaataagggtttttatctaattccctaatattttcttactctttttcgtattaaaatcaaagaaaatggaggaatattttatgaagcgaaatcttaaatcagcagtatataaacacctaaactttgctaatgattttcaaaatttctttgattttccggattttcgtgaaatgagaccaatcatccgtgaagcagttcagcagcttgctaaagatagcttttcgcaaccagtcttgcctgttaaaattgagcatcaggcccttgcaattgagcaacaattggaacgggaaactagaaaatatcagcaacaaaacggtttctaccctaatcagcagtctgaactccataatttaatccggctctacacaaacctcttacaaaagattagtaaacgtgaaataattgatcaagagattgaagatgttatttatgccgccaaccaaactcgtgaaagtctccgtaaactaaaaaagcttgaaggttccggagatttatatgaggatagtcaagataaggaacttgtgccaggaaccttttatgatattgtaacgcgacagctaatccgaccttacttgttaaatccacagggaaagatgattccgaaaaacgttaattacgagggacgccaattagtaatccaaatgattacttattgctatcgtgactgggattcttatcttacccaccaatacgatgagcaatacaacattaaaaatgaacgtggcctgacaagcagggagtattacgataaattagaggaaaacgaactgaaatatgctgaccatgcctatgctgaggtgattgcagatacgtttaacgaatttaagaaaattcttgtccccaaatatcttgccgctcttgatattatgtcaactaacattgagaaaatcctcatccaatatcctcgtctccgcctgcagttcaatcaggtaatcgcaaacaatttcaagcttgatgcccatgggaaaatgcacgtgatggacgccccgctccaagatataagaaataagtataactactaccgtgaaaactttagttaggagattttagatgatatgaagcccaaaattacaccggaaatgaaattagggatgagagagtttgaaaataccatgtttatgctcaaagcaatcccttgtgaagaaaatatcaaccgttttgcgcttcaaggtaacctcaacccagaacgattagataacattgcctggttcttaccggcatatctttcagccgatttcaacctcttctttatttttgctccaaacgtcaataatcgttgggcaattagttgctcacaagttcatattgagaatgataaccaaattacagcaatgagcgaaactgttccaactggtcttggtttgaatgcagtaaacgaattaagtcctagttccgcaattgaattggtagcttatctaaaaacactcgaagtaaatggattaggttattttgacgaagaagttggcaaagaagaagatgtacgttttcaataaacaatatatgatcgataattattagagagccgattttttatatacttattattaaaagacacccttcacatttgtgtgaggggtgtcatcatctatttgttactaagccgacaattatgttcacaaagcaatattaatctctaaacatatatacaactctctatattcgaacttttattaaaaaaccacccataaattcaaatcatatgatgattcgaatctctaataacgagctttattataaataatcaaataaaacaagtattcacgaagtaatttttgatggagtaccttcaaatccattaaaaaacttccctaatgaaatttagacctctttttatcaactataaataaaaatcaatttagaatgtaactttaccgaaagtaattttgttaatgtagcgctattaatcataaactactttatattaaaactaacaattattttatacgcatattacaagttatttagtacggtcgaaggagtatatgaactgtattcaaatactctaaatttatttttggggtaaacgtattatcatttaagaatggagttaacattttaactaattggttattttatagcattctctaagaatatatgatgtcaaaaaagcctatatcaattcattttacccgtaggttttctaataacgcggtttattacattttacaattatcattcccattttgccaattatctttattaatattcataaagaataatttgcggtatactaaatttattgcattaggggtgcccatagtgctgggctgagatatgcagtgatgcatggactctagaacctgtaagttaacgcttgcgtaggaaaatgcaccggactttaatactcaaagtaggtgtatctcctaccttgagtattttttatttaaggagctaattttatggtacaacgtcaaattaactggtcactgatcgatcgagttcgtactaaaaacccgattgtccttaatctcgccaatttagtaacaattgataaagttgccgatgccgttagtgctgtcggcgcgtcgccaatcatgtctgttgagcccactgaagcagatgagatggtggcactagccaatgctctttctatcaatctcggaacaatcaatgagcatcaggcgacacaaattaggacggttttgcgagctgccacgccactcaaacccctcgttttagatccggtagcggtaagtgcgattccatctcgcttagagtttgcccactcattgctaaatgattttcattttgatgttattcgtggtaacgccagtgaaattgctgctttagtagaagctgacaatactagtcatggaatcgacgctggtaaagttcctaatcaggttcaaattgccaaaacgtgtgctcgacgttaccattcaattgtagtcttgactagtgaaactgacataataactgatgggcaagtcatctatgaaaatcccttttctgccgagatgttaacgatgaatgtgggtagtggcgacatgctttctagtatcatcgctgcatttctagggatcacttctaatacttgggatgcttgtattgttgcaacggttttggtatctgctgctggagtattagctaaccgttattcagtcggactcggttcgtggcaagtacagttttttgaccagctttcgattatggatacgaaagcattactagaattctttgaggaaagtgaggaagattaccttgattaatgattatccccaggctttaacaattgctggaactgatagtggcggtggtgccggtattccagcggatgtaaagacgatgcaaatgcgcggagtatactcagcaatggtagttgtcgcagtcactgcgcaaaatacattaggagtgcaagatgccctgccaatgcctgaaaaattaattaatgagcaatttgcttcaatcgctggtgatttgaaaattagggcttgtaaaacggggatgttggctgaccctctccgtgtaagaacggttgtacgaaatttaaagaaatatgatttaggaccgcttattgtcgatccggtcatggtagcaaaggggggcgcaaagttacttagtgatgatgcaatttcaattgtaagagatgaacttatccccctcgcctctctgattacgccaaacattccagaagcttgtgagttgacgggaatcacaataagggataaaaatgatattaaaaaggctgcccgcgaattacaaaagcgtggagcaaaaaatattctcataaaaggtggccatgcagaatcttcagacaaagctgatgattatattttatttgaagatggcaatgatatgtggttaactgcgcctcgtgttaatactaaaaatactcatgggactggtgatacaatttctgcatgtattactgcggaaattgctaagggtcactccatggaacaggcaattatgattgggaagacatatgtcgaaaagacgattagcaagggtattaatgttggtcatggtcatgggccacttaatcactgggttaaaattgaaggagacgatctaaaatgatgtttgatccaaaaatgttacaagtatacttagttggtggaacacaagatgtccataatgacgttgttaaatttcttgaaaaagtagagctagcaatgaagagtggtatcactgccttccaatatcgagaaaagggaaactcgaagttacggcctaatgaacgagtagacttaggactagaactacggaccttatgtacgcgctatggaattccattgattgttgatgacgattatgaattggctcagcaaataaacgctgatggagttcacgttggacaaaatgatactaaaattgaacaagtatctgtcgctgtaggtcatcagatgttcatcggctattcctgtaatacaccagaacaagttgaacgtgctaatacaatggactttgttgattatattggttgtggtcccgttttccctacaaaatcaaagcctgacgctgatgctgctattggtatcaatcgtcttgaacgtttaaacatgattagcgaacgtcctgtagttgcaattgggggcatcgatgaagaaaatatgaaagttgttcatgacactggcgttgcagggctagctgttatttccttagtctttgatagcaaggatcttgcagcaactgtaaagaaaatgaagaatttgtataaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacataaaaaatagcaaggttggaagaaatttcagccttgctattttattagagaatgtttttactaaaggttattttgtccttgcttttgcttcctgcatccattttgaaattccaattgaaattgcgactccaatccccaacggaagaaaagctgtaaagttaaggtgacaaacttcaaataacataaataatgccattaacggtgcctgctgtgacgctgctaaaaataatgaggccccaataactgcacactgcgttaaggtaacaaccgggaagaagtgcatataaggaataccgagaaatactccaataactgctccagcggcaatcgatggcgtcagtgttcctccatagcccccacatttgattgtaaataaggtaactattactttagcaactagaccaaacaagagcgctcctaggacctgagaattgacggtggtcgtattcatggctaattgagcaagtccccgcccgtttcccataatttgtggataaaaagctgcaattgctcctgccgagaacgataaaagtggtaattgccagaaaatatttttacctgttgcccgtttactagaagctgctttaactccttgtttaaaccaggttccggttactccaaggattaatcctagcacaattgctaatggaacagatagcaaagagaaatctcgactcccaacaatataatatggttcgaatccttttaaaatcgaaccaatcatcgttgcgattactgacatgattaagctaacggaaactgaacgggcattaatgcgccgatataaaatttctaaacagaaaacagttcctgtaataggtgcaatatagacccccgcgaatccagctccagcagcagcggcgattaataaacgtttatcctcatcattaaggtgcaaccaccgataagaattaagcattcgagaccattcctgagcgatagcagcccctgcttctcgtggggctaattcacgaccgatggaattcccagtccctacgaaaaagatctgggtaaccacgtgaataaatgtttttcttaacggcatctctttaccattcagggcattcttaatactaaccgggtgataatgacgttgaagaaagtaccaaataattgtagcaattatcccccctattagcactgagacaaatcgatgaagaggaaaaatattaatattaactggaatcttatttgtctcgttaaagtttaaaaaatagtgctctgttaaatctagaatagcgctaaggatcaatgagctaaaaccaacgactattccaagaacaaccgttgcaacagctaatggagtgttctcttgcgtttctttcatcttctcgtctcctcgtattatataaatcagtccttacggattttgatactttactacttgctttctggtcactgcatgataacctctaatcatcattggcgttggtcaactggtataggttatcgtctcctgtagttttaactacttaattagtctgccgcccaggcaatcagctaatttacgaactcacatgctgtatcgattagtgaatcaactaattctgagtaggattaggtgcagctttgattcgctaaccaatgaaatactgatacttgcgaggatgtctttagcgattgtaattaggggttatcatgcagtgatcagattaagaccagtaaattttaatgaaaggaggccattccaatgaaactatttgtcggtattgacgttagctcaaaagatcttgtgacttcaatgatttccgaagaaaaccacgaagttgttttccgaggtaactttgtcaatgatttgaaaggcgcaactgaattaaagaaacagattattaacacggcgaattcaaatcaaattgaccaagttattatcggaatggaagctactttcatttatagttttcacccagcaatgttctttcaagaagacattgatctgaaagcttttaatactcaatcagtcgtcgttgatcccaagaaaactaaacgttttcacgatgttttcgctgaagacaaaaatgatcaaattgatgcttattacattgcagattacttacgtgttggtcattattcgattggaattgttcgtcaagaaaattacattgctcttcagcgcttaacccgttctagatatgagattgttcaaagcctggttcgagctaaacaacactttattgaaaacttatactataagctcaataagcttgttatctctgatgaacttaatacttctatatttggttcaaccatgatgcagttattaactgaagatctgactactgatgacttactcaatatttcaatcaatgatttaaccgactatttggctgaacacggtcgaggtcgcttcgcagaccccgaagctttagcgaaaacgattcaaaaggctgtttggtcttcgtaccggctagataaagtcgtagctaattcggttgacgcggttctctctgtctatgctgaagagattaaggcatttcaaaagatgattaaggatctcgataaatcaattgagaaagtcgttaaagtaactgatgatgaacaaattctgcgctcaattcccggtatcggaccagtctatgcagctggtattttagctgaaattggtcaaatcgatcgatttgacaacgaagctaaattagctaaatatgctgggctttcctggagagaaaagcaatcgggaagttacactagcgataacacaccgttaaagaggactggtaatacctatcttcgttattacttggttgaagctgccaacctagttcgaacgcacgatccagtctttggcgagtattatcagcgtaaatacaaagaagtaaaacacactccttctaaacgagccctcgttcttaccgcacgtaaattaatcagggtgatttacttcctactcaaaaatcaccaaatttatcaagaaaagaggtaattggtataggaagataaaatgatttttgacgcttagttttaaaatcaccttggaaccaaggcttatttaagtacgccaaaaatctggtcaaagcaatcaagccagtggtaattccatcttgacttattaccacatgactataaaaataaatcaacttccagtgtatcacggatgaatgtaaaaagataacaacaatctctcactatgttgaatattatgtaaactaaaataagaccgaagaattagcactaaacttcttcctcggtcttatcttctatctcagattattgttggacatatgtttgtgtttggggattaaattcaaatgttaatttttgatcatttaattctacaaagatcttccggtaatttttatcataaccattatgagccatatctattgttactctattttgagaagccttgatttgataaaggttgtattcaccactttgataagcaaagtcaaggccgttatcttggtaatgagtatatgaggcatgttgtccatataagcggaaggtcattgtttcattaggttcatcactaatatgacttacttcagggccccatggaataatcgtattctttttaacgaatagtggtaacttatcaattggcgcttctactaaaattgaccgcttacctgcatattcaacaccgttccaaaagtcaatccactcccctgctggcaagtagactgctcgtgtattttggccttcttgaactactggagctactagtaattcatcgccaaccatatattcatcgttcattgtccgaacagtaggatcctgatcgtagtttaatactaacggacgcattattccgagcccattctttgtctccttgtaacaaagatcgtataagaatggaataaaacgatatcttaactttaaatacttccggtagattgagagcgttggttcaccgaatacccaaggttcttgttcacgggttcccattgaagcgtgattacgatagagaggactaaataaggctgcctcaatccaccgtgttagcatttcggccgtggcatctgcaccaaatccaccaatatcagttcccgcaaaggcaaagccactcattcctaaattacataattgaggaatcatcatttgtagatgaggccacaaactttggttatcacctgtccagacggttgaatacttttgcgttcccgcataagcagcccgagtaatgacataaggtcgtttatgactgtatttctttaatccattgtaagtagcctttgccatattatgtccataaacattatgcaatttcttatgggtagaaggggattttccgtcactaaagacaatattatcagggatttcaccttcaaacgatgctggttcgttcatatcgtcccaaattccagctgttccggtatcaacaaggtatttacaattatcagcccaccattgttgtacctcttctcggccaaagtcagggaaaacagcatcgccaggccaaaccttattaacataaacggtcccatcaggattcttaacaaagtatcctttcttaattccttctttataaattttatactttttatcttgcttaacaccggggtcaataatcggcattactctaaatccttggtctctcaactttgaaacaaatgcttgaggatcagtaaacttttctttgttccaagtaaatactcggtaaccatccatatagtcaatgtcaaagtggatcacgtcacaaggaagatcattttctcgtagtttagtcgcaatctcttgaactttttcaggacttacactatatccccaacgcgattgctgataaccaagtacccatttttgtggcaatggaacgcgcccagtaaggtaagtataatttttaacaatatcgctcaagtgcggaccaccgataatgtaataatcaaggttaccggcgactgcggaataaaagtagtaattagcattttcttttcctaaatcaagatggctccgataaggattatcaaagaaaagaccgtatgggtgaccgttcttcaagcctaacatgaaaggaatagatttataaagccgggtaaaactttctacttgaggtgctggattatcagtattccagttatcgtattcgtagccacgtttattcaagtacccagttttatcaccaagaccatatatctgttcatcagtggctaaagatttaattacttcaaaatatgtcttatcttggtcacttccaccagcaatatcatgaccttcggcagcaactaattttgcatgagccttatctaatccacggtcaatcggtgttcgcttaccctgataatcaataactaatggatgaccctccttgtcatatacattcattttctcgttgtcgtatatttttacaattaacgctgccgtagttaattcaagatggtcaccatgatctaagactgtaaaattagttttaattgttttattgccttcaatagcatatgatgttcctttttcaccgtgatcttgaaatactcgaatgatttcaggcgtaataactgataaaacaatagcactgttttgataattaatcgtaatcttttgatcaacaattgcatatccacataattggttattcattaaaatcgtccttcctcttttttacttttattgtatcgcatttattttaaatgtaaacgttttcgtggagagaggataactttttaagaataaatgggatataattaaatgtaataatgaatatgaatgaggcctataaataatgcataaaaaagcacaaatcggattcggacttttttgttggattttattcggagtattactctttaatgttttaactaaatctccatttgttcgtttaatcgatgcaggtggctttgatctgactgccccagtgtctaagtttaagactactatcctgaccgaattaacctttatgggtgacccagttacagtcggcattataacaatcggcttaatgctcctgttatggcgtcgcggaagagcaactgatagtgtttggtatggcatgttacaatttattggttactgtttagttatcctcatcaagtatagtgttactcgtctccgtccttcctttcggttaattgatgttagtggatatagtttcccaagtgggcataccttttcaactgctattttcatttttacgatcctagccctccttttaccctattgtaaagttaagtggcagagggtaatcttaggaatcgtcggcgctctatggatcattattattatgtattcgcgagtttatttacgagctcattttacttccgatgtgatcggggccttttcattagctagtggatggtggttattagctaatagtcagcgcgctattttctttcattggttacaaaaaccagtcaataaagtctaactatcaaaacactgagctgtaatcaatgagcaattatagcttagtgttttgctgttttattactatttctgggtcaactaagatggcctttatagtaagcagtcaataacagtacgtctagctctagctaccccggatcttctatactgagactatcatcagtaaggagattttttatttatgacagaacaaaatgaaattattaccccagttttcaaaaacaagccaagtaatttacaaaagcattcttttacggcacgccctgccgtaaaaattaatgtgaatgaagtcgaattaacgattttcaaggggactaattctgttttagcttcggatatcgttaaaatggttattcgttatgctcgttaattggcatgacccagattatatctatctagtctgtggaaaaacagacatgcgaaaaggtattgatgggctcgcaatggtaatcgctgagaactatggattagaatttaattcgcttttcttattttgcggcggacgtaatgatcgctttaaaggattgttttgggatggcgagggctttattatgctctataaacggtttgaaaatggccaccttagttggccgagaaacagtaatgaagccaaagaattatctgctcaacagctcgactggttattgcaaggactgaacccattaccaattcgtaaaattcaagctgttcgaccaggaagtttttattgagttacctctatttaaaagaagaattctttgatataattaccaaagaataattcaaaggaggtgacgtaccatgaagcaaacagcggaagaacaaatcaaagaacttaaacaacaattagctatggccaatgaaaagattgctcaattaacagctattatcaaacttcaaaagaaccaaatatttgggaaaaaaactgaagtaatggagcccgtcgttgatggacaacaatccttatttagtgagcaagaaatggatcaacttcaagatcctgatatttcagtcacggaagtgactgaaaaaaaataaagcaagtggtgcgtcaccggaaagcaaaacgatctggtcagcggaccacttttttagatggtttaccacaggttgaagaagttattccattaaaagatactaactgcccacactgtcatcaactaatgaaaaaagtgggtcaacatgtatatagtagagaagcacggttaaaaccagctgaattatattgtgtgaatttgattcaagaaacttataaatgtaatgagtgtattaattctaatggtagcgatgtacttgtcagtagtaagatgccacagagtcttttaccccatagttacttttcgagtactattttagctaaagtagcagagttgaagtttaatcttgctttaccgtttcatcgtcaaattaagttttggcaagccgtcggcttacgagttgatgctcgattattggcgactaacatcattaaggttagtcaaacctaccttgaactgttatatgattatttacaggaattaatcagaaaagaatcggtaattcatatggatgaaactccattcaaggtaattgatgagcctaatgaaactggctacttttgggtaacgcgatcaacaaaagaattcagtaagcatcaaattatcatgtttcattactataatacccgcgcgggtaaaaccattggtcaaattatcggtcatcaatatcgtggaattattacgtgtgacggttatggtggatatagtgatcgattatatccccaggcaaaatttgggtcatgtttagttcatattcgacgtgaattttatcacattacatgtttattgaataaggagcaattgaagaactccaaagcataccgagttttacagctaatgcgaccgatctttcatgaagagaaacaattaacatattccaatcataaggaaaaactagtgcaacgtcggttgcacgtgaagcctttgatggataagttatatacttatttagaaaatatcagttttcctcaaggacggttgaaagctgccattaataatgctttgaagctaagaaagcgagtatatcaaatatttgaagatggtcgagtgccgttaacgaataatccggttgaacaagcgattcgtccatcaactcttattcgaaagaatagcttatttgcgaaaagctctgctggagctcaggcaaatgccattttctatactttggtggcaactgcaaaccagaaccatttaaatatctacaaatactttaagtatctttttgatcacttaccaaaccgcaaggacgcaggacttgaggcttatttgccatggtcaaaagaaattcaagcagaatgccataaataaaacgggatcatgaattatcattttcggtagctcatgatcccaattttttcaatccgtactgttattgactgcttgcccttagacttctttcagattccacctcacggtggacacccttgtcctcagctcatggttccgactactacggcccatagcggactttcaccacctagctaatacccatgccgggcgcactaaaaaaaggacatgcaccgttaaaacgatacacacccttttactactgcgcggcaacgtcctatccttgcagggagcgatcccccaactactttcggcgtgttgaagcttaacttctgtgttcggcatgggtacaggtgtatccttcaagccatcatcaccacactctttgtcccttcggacgagagcttgtgctctcaaaactaaatcctatctattctcttccaataaaccttaccgctccttggttaagtcctcgaccgattagtaatggtccgctccatgcctcacggcacttccacttccatcctatctacctcatcatctctgaggggtcttactttcccgaaggaaatgggaaatctcatctcgaggcgagtttcacacttagatgctttcagcgtttatctcgtccatacatagctacccagcggtgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccacacggaaccaccggatcactaagcccgactttcgtccctgctcgacctgtctgtctcgcagtcaagctcgcttgtgcctttacactctgcgcatgatttccaaccatactgagcgaacctttgggcgcctccgttaccttttaggaggcgaccgccccagtcaaactgcccacctgacactgtctcccagcacgttcagtgctgcgggttagagtggtcatattgcaagggtagtatcccaccagcgcctctgtcgaaactagcgtcccgacttctacggctcctacctatcctgtacaagcagtacaaacactcaatatcaagctacagtaaagctccatggggtctttccgtcctgtcgcgggtaccctgcatcttcacagggatttcaatttcaccgagtctctcgttgagacagcgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacttcatcttacgattttgcagaaacctgtgtttttgataaacagtcgcctgggcctattcactgcggctggccttgcggccagcaccccttctcccgaagttacggggtcattttgccgagttccttaacgagagttctctcgctcaccttaggattctctcctcgactacctgtgtcggtttgcggtacgggcagttaactactccttagaagcttttctcggcagtgtgacatcggcaacttcgctactttaatttcgctccccatcacagcttgtcaacacggatgtaaacatttgactcacatcctgacttactgcttggccgtactcttccagtcgtacggtttgcttagcctcctgcgtccctccatcgtcaaacgcagttaactggtacaggaatctcaacctgttatccatcgcctacgcctctcggcctcggcttaggtcccgacttaccctgggaggacgagccttccccaggaaaccttagtcattcggtggacaggattctcacctgtctttcgctactcataccggcattctcacttctaagcgctccaccagtcctcacggtctgacttcgccgcccttagaacgctctcctatcacgtgcacatagtgcacatccacagtttcggtaatatgcttagccccggtacattttcggcgcaggatcactcgactagtgagctattacgcactctttaaatggtggctgcttctaagccaacatcctagttgtctatgcaactccacatccttttccacttagcatatatttagggaccttaactggtgatctgggctgttcccctttcgacagtggatcttatcactcatcgtctgactcctgagtataaatcaatggcattcggagtttatctgaagttggtaacccatgacgggccccttgtccaaacagtagctctacctccacgattctttacctcaaggctccccctaaagagatttcggagagaaccagctatctccaagttcgtttggaatttcaccgctacccacacctcatcccagccattttcaactgacacgggttcggtcctccagtgcgctttaccgcaccttcaacctggacatgggtaggtcacctggtttcgggtctacaactacatactccttacgcccatttaagactcgctttcgctacggctccggtttttccaccttaaccttgcatgcaatcgtaactcgccggttcattctgcaagaggcacgccgtcacccattaacgggctccgacagcttgtaggcacatggtttcaggaactatttcactccccttccggggtgcttttcacctttccctcacggtactggttcactatcggtcactagggagtatttagccttgcgagatggtcctcgcgggttccgacggggtttcacgtgtcccgccgtactcaggatcctgaacagagagtgtgacgtttcgtctacggggctttcaccctctatggcacagcttcccaactgttgcgactacgtcgcactttggtaactctaatgttcagtcctacaaccccaacaagcaagcttgttggtttgggctcttcccttttcgctcgccgctactcagggaatcgatgtttctttctcttcctgcagctactaagatgtttcagttcgctgcgtctacctcttgctagctatgtattcactagtcaagtaatcagcgactaagctgattgggttgccccattcggaaatctccggatcaaagcgtacttaccgctccccgaagcatatcggtgttagtcccgtccttcatcggctcctagtaccaaggcattcaccatgcgcccttcataacttaacctaaacaatcaaagattgtctgattaattgagttagcgattataattcgttaattaaaactcaaataacgcggtgttctcggtttattgttttgttaataaagaaattagatagtatttagttttcaaagtacaagctctgagggtaaacccctcaaaactaaacaaagtttcttcgatgtgtaggttccgttttattccttagaaaggaggtgatccagccgcaggttctcctacggctaccttgttacgacttcaccccagtcatctgtcccgccttaggcggctccctccataaaggttaggccaccgactttgggcgttacaaactcccatggtgtgacgggcggtgtgtacaaggcccgggaacgtattcaccgcggcatgctgatccgcgattactagcgattccgacttcgtgtaggcgagttgcagcctacagtccgaactgagaacggctttaagagattagcttactctcgcgagcttgcgactcgttgtaccgtccattgtagcacgtgtgtagcccaggtcataaggggcatgatgatctgacgtcgtccccaccttcctccggtttgtcaccggcagtctcactagagtgcccaacttaatgctggcaactagtaacaagggttgcgctcgttgcgggacttaacccaacatctcacgacacgagctgacgacgaccatgcaccacctgtcattgcgtccccgaagggaacgccttatctctaaggttagcgcaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagcctcagcgtcagttgcagaccagacagccgccttcgccactggtgttcttccatatatctacgcattccaccgctacacatggagttccactgtcctcttctgcactcaagtcgcccggtttccgatgcacttcttcggttaagccgaaggctttcacatcagacctaagcaaccgcctgcgctcgctttacgcccaataaatccggataacgcttgccacctacgtattaccgcggctgctggcacgtagttagccgtgactttctggttggataccgtcactgcgtgaacagttactctcacgcacgttcttctccaacaacagagctttacgagccgaaacccttcttcactcacgcggtgttgctccatcaggcttgcgcccattgtggaagattccctactgctgcctcccgtaggagtatggaccgtgtctcagttccattgtggccgatcagtctctcaactcggctatgcatcatcgccttggtaagccgttaccttaccaactagctaatgcaccgcaggtccatcccagagtgatagccaaagccatctttcaaacaaaagccatgtggcttttgttgttatgcggtattagcatctgtttccaaatgttatcccccgctccggggcaggttacctacgtgttactcacccgtccgccactcactggtaatccatcgtcaatcaggtgcaagcaccatcaatcagttgggccagtgcgtacgacttgcatgtattaggcacaccgccggcgttcatcctgagccaggatcaaactctcatataaaatatataagaacttgaatagctctaaattatctttgttattaagcgaattgacttcgcaaatgttttgcttcaaatcacatcgtgattgaagaccctacacatttgattcgtcgaaactttgttcagttttcaaaggtctacctgttggctaattaagtagccacccaacacagcaattataacatatatcggattggcttgtcaagaataaattttaatcaatttcgaattcctttagatctataactcaatcagcaactttattaatatatcatgttgtcgatgggatgtcaataatatttttaaattattgttgagactttgcaactaagttaaataaatctaagaagttacaagcgattatctatctcccatcgctgacagggattttattatatcctatctctaaatcctttacaagcatttattttattttttatgcatatcattcaaaaattgttgaaggtttaactcttcattaactttttggaatgtttcggtattccagccattactacctgtaacaactaatttattattatcaagcgttgcggtaaggggattagttacgtcacgatcttccaaatttataaggtagtgttctccttctttacgccatgttaagctatcatctgtatccggattattcttatctgcataaacatactgacctgttccattttcatttaaggcaatagctgcaccgtcttgatcatctcgatacgatccaacaatctttgcagtctttgttattttaggcgaatctttttttactactttattgtcacgaactgggttaagttgcttactagcaaaccgtttataatttacccctaaaattcctaacaagattaccagtaatatagtaaatataattaacccaatatgtgatcgtttctttttagtacttttcaccatcatcaccccatccctcctagtattatctcatcatttcagtaaatctgtcacatcttttttagctgatcttttcttcaagttgaataaattctcgaaggtatttaaatggaaaaggaattactgttaattgatgaaatcgtacaaaattcaccatcatcagttgaagaaacttcaagatattttcggtctcaatcgtagcgaaaccacgctcatttaatttaatgttaggctgaagttgccagatgtgtgatgcctttgcaattgatatattcatatttttactaatggttcctacattatagtaaataacatcctgatcgccgttatcaacgaaataattaatatcggttaatccagagagatgcttttgaacatgggattttatttttggtttcactttcaaaactagtccatattgttcatataattcatccaataacaaattaattgcaattggacttagtattttatttttcttaataaaattaaattcatcttttaagtcattgatgttaaatgaatttagctctcttttattaatgatagaaataagattttggtatttagttctgtaattagggtaacttttacttaaatcattcaaagcccgtttaagttccgcttttgttactgatgaacaattttgatgactaatcatctcgttgatatcgccaaaaagctcagcattaggcaaagtaaagatatttttcctgtttaaattgtagaaagtattggcaggagttttaattaggtactgaagatctgtatcatcagaattaataaattttgagctttcttgtaaatctaaccgtctcacctcgaactcatcactattaatcattttaaatagatagactgcttgggtaccataagcttcctttgcaacttgataaaactcccatcccactattgaatctagttaatgatacagacttaagcttctttctttcaaatctttctttattatcaactcttttaatgaattaattaacgtacttccaattgtcaaatgttgcactattgcctgctgatagtctctcgcataattatctttaacatcttcatgagtttggaaataccgcttattattaatcaccactagattatatccaaatttatcttcaacggtcggtctaatattgattttaactgttggtagaagctgaaccaacgcgatcttgatatcttctatcctttcatcccttgcgatccgattatcgattaagtttaactgattcgtcgcaaagaattcttcgatatgcttgtctaaccaatccccgccatgcttcatctcgattctgtcggttgggagttatgtagataatgacatcagattccttacttttcattagcatgtccgttacccactgcagggcacccgttgttttcccagagccaattcgattttcaaataatgctaaacccggaagctgcttttcagtaatttctccaaacagcttaaccgttaagttttccattggtactatctcccttccaaaaaaagactccctgatttctgatcaaagagtccccaaataataattcgataattgcaaaaaacatatgtgttgctgaaagataattcattttacttatttgctgctattttctttcctttatttacatagtgaagcgtaccaattgggccatcaacgtgaagtttgccattcttataaacaagcttggttactgccgcattctgcattggcttcccatcatattttttagaaatggttgaaagatattcattaattgacattcctgaactaacaactaaaacattgccaccaccctgtttttgagttgtttttgcaatgtgaagcaattctgaattcatccgtttttgcacctgagctgaactttctgcccgatcatttttagccaacttggtattttgtgaattgtccatatcaagtttgtggtaggcatcttggagcttattccagtaatctttgcccgttgcttgctggaactgcttgccatcttgataaccataaacattagcaatcttctggttatcagcttcaatactatctccttcaaagctaccgtatccgccttcacgtaacattggtgtggtcgtaatctttgtatttggattggcagaatacttcaatgcttgttgcgcagtaacttcttgacgtgttaagttacccgtgtaagcatgcttaaatttaatcccctttaatccatagcccaaatcattagcaacggtaattccatttttggttaatggaaaatcactcgatccttgtacccgttgcattacattaccagtagtttccccgtgacgtgtaagatagattgtcacctgcttatcattagaggctgcataggtagtagctggaaccaccgtcatcgccgagctccctaatagtaaacctgataaaacagcacacattactgttaattttttaaatttcattaaactttccccaattcttatcagattgtttcagcaacacccttattttacatatttttgtaagcgcattcaataatatttttgtcaaatctaaagaataagcattacattagcaattgctcttttctttttccttaaaagaattacaatagtcgtgaggtgatgaggatgaaaattcttgtaacgaaaaataaagaagtagcaagccaaaatgcctttgaatttctccaaacagatattattaacggtgcccaagtacttggccttgcaacagggagttctccactaggcctttatcaaaaaatgactaatagttctgttgattattctaaccttatttcgattaatcttgatgaatatgtcggtcttaaatcaactgatccgcaaagttatcattactttatgaaatatcatcttttcgctcaaaagccatttgccaaaagttttattccggatggcagtaatctgaatgccactgaagtaattaatcactataatcagattttggctacttaccctattgatacgcaaattttaggaattggtaataatggtcatatcggttttaatgagcctggaaccccttttgatagccaaacccataaagtaaagttaacccctgctactatcaatgccaacgcgcgtttctttacttcaagcaaggatgtaccaacagaagcctacacgatgggaatcggttcaatcttgcaagcaaaacatatcatcttactcgcttttggtgagcaaaaagcagacgcaatcaacaaaatggtcaacggtaaaatcacgactgctgttccggcatcagccctccaacagcatccaaacgtaacagtgattcttgataaacaagcagctagtaaactaaattaaccagcacttttttgtaatgccatggtcttggcaataataccgacatctgattggtttaacccggcaatcatttccgcgttgtctgctgggtaatcaattacctggccatgatggagggcaattaactggataaataatttagttgaccgcccatttccttcacgaaacggatgaatatagttcaaatcatttaagagagcagcataatcctcaatggtaggctgctttttcttattcaatcgcccaatttcatcattaatatacttaattgcattatcaaagcgaccatattccaaaaaatcaaaacctgcttttgaaatgtagtagttacgtaactcacccgcccagtcataaagccaaccaaaaaggaatttattaattgtctgtaaatcttcaaagcttttaattttcggttgttgttgcaggagagccacttccctttctgccacaccacgatactcgattaaacttaattcatctgcatttttaattgcaaatttattgctaagcgttccattatcatataaaaattttgcttgaagttcttcatcagtcatcttcatcaccaaatagctgctcaatttccattaaaatttcatcatctggattttcggcactctcttttaattgtcttacctctgttgctgtaggtttccatccctctaaaacattactttcaacggcaaaacgaacttgttgataggaagaaggtgtttggaactgcacgtgctgaatcgttaattgatcatcgtcagtatggaggtaaaaatcaaagtcttgaatccgatctaataattctcctggacgctctcctaaagcatctgcaagtgcattaagaatctgaattgaccaagttgcaacgggccgtttaagtgtttcgttaacctgcgcaacgtcgaggccgctttcttgagcgacaaacgcgacggtcatattattggtttttaaaatattgatgatattttctgccatgttcttaccccatttttactttatcgtttccattatagcgagaaaataaaatagtgaaaaatagactgctaactcccaaataatgaaagtaacagtctattttaagtaattaagcatgtttgcgcttgcgatcaataattgtcaatccggttactgccattaatgagcttccgagaagaagtaatgcaagatcctcatcgttaccagtttgtggtaaagctgcttgctggtcagctactttttgtttttggccattgattgatgtaggcgtcaaattaattaattgattattagcagcagctacggtttgttgcttaggttgaccgtgtaatgtaacagtttcggctggttgaccagctgttgttggcaaggttactgttggagataccggttggcttggaacctcttgaagctgatttccttcagtctgggaattagcatcgttttgagtgttccgattagttcctgtttgtgactgtgaatctgagtcagcttttgctaattgttcagcagtcaagtaaatcttacggttcattgttagtgcggtaattggtttaccatcattagtcatatcagtaatataatcaataaacgcgtctgtatcttgaccaacaatcccgacaactttggtacccttaaatgcagaaaagccatctccgccacctgctaaaaagtcattaataacaacattgtaagtcttattcatatcaagcggttgattatgttggtcataaacttgaacgaccttatatggttggttaggatcgttttgatcagtataagtataacgaagcccggaaatttgtaagtaataagcttgatcttcgtcgtattgttgattcaaggcttcaacgatttgtgcccctgtcatttcaactacccgcaaaatattaccaaatggttgaaccgcttgggcactcccccatgtaatggaacgatcaggattaacatgcagatctgcacgaacgccgcctgtattagtcatcgcaaaatctgctagtaagcccaccttatgagcagcatataattgaccatcgacaactaattcaccaacggcattttcacgagtaggggtattatgtagtcgtccaagaatatcgcctgttgtagcagcttcccctattttcttattaataattggtgctactcgattgttagcatcttcaacaattgctgtaacatttgcatctgttttgatattaggcgcatccttttcagatagtaccggaaagacatgtgaaacgagactattgggcgcaaaatcattagttgttggatcgatgtaaccgataatatcatcgtaagctttacccgtgtaaatggcttgcactaattttacacttccaacagtagcattagcatattggtgggagtgaccggcaatataaaggtcgacagaattatcagggtcaatttggtaaagcctcttaataatatcaacagcattacccttagtgctgccatctttattagttgaaacccctatatgggcaagaactacaattgcgttaacaccttttttgcgtaaaatttgatcatattttgcaattgtttcagcctcatctaaaacatcataatctttgtaattatcgtataaggttaaaattggtagggaagtagtttcaatcccaataaagccgatccgggcaactttaccatcactagtatgaatttctttaatcaagtatggttgcattccaaacgggatctgaccatcagacttattcacaacattggcggtaataatattaatccctgttttcacatgaggataggccatctcagctttattatattgtttagtaggttcatcaccattaacaatccgcatatactcagctaagccttcatcgaactcatggtttcccaaagttcctatttcaaaatgcattgcgccttgttgaaagcgaatcatcttcagaaatatcatcgagcagcagtagtgaggaaagttcagcagttaatacaagcagcagttcaactgcgccatcgaataacggtgatatgcgaaccgatcaggccggtatgatcgttggtaatgctcgttcaaaaatctaccatacgtctgatcaacaaggctatcatatgaattcagcaaatgcggtttactttaactcagaagcagaagcgcaagccgctggatatcgtaaatcattaagataaataatttcaaagtcattattgccctccccacaataatgacttttttattataagaaaaagctaagaataatttcctagcttttgaaatgaaggccgatttgactgtggaagataatatggagttaaagagcattaaatgcattttttaggccttcacttaaatatatacggaaaaagataacatttgcactttttatttaaaaaataaagatctcctatctggtggttcgtaaaagagcagataagagatctttacattgagatttgtgggagaagaaagagagcgagacaggaatcacctgttacttcgttttttgactcaaacctagcctttggaggccacgcaaacatcaatagtcaccaacagctttgccaagcgatgatagaccattgttgtactgcgctgtcacctcattatgaaagcaacttgactcatatcacagctcccattagggaagtgattgcagacgaagacagcaaataatggggaaaggagtctatgaacgaacaagtcttcatctcgcaaatcacctcccctataaatatatatacgaaaaaaactaatttttgcactttttatttttaattttttatctaatttcatcatcgcaaatttaaatactgttttgaacttatatttcatgctggtatgcgacataactacggccatttcttgatcgaacaattaactgatctggaatttgctcctcaagttcagtgatatgactgataattccaatcatccggtggccttcgagttcttgaagggaatgaagagcatcttcaagagcttgctgatcaagggaaccaaatccttcatcgataaagagcgcatcaatcttaattcccccactttgctcttggacaatctggcagagagctaaagcaagagcaagtgaagccataaaactttcaccaccagaaagcgtccgggcacttcgcgttctaccagcattatcatcatatacattaacttcaagtccactccacttggcaccagccccatgactttctgttgctaattcaaactggtagcgaccattagttaaccggtctaactgaacattggctgctactaagacctcttgaaaatatgcctgtaatacataccgttctaagctaacatggttttcagtattaccagtcacaacatctgttaatgtttgtaattcattaatttcttgatcaagttttccggttttttcgactaccttaataaccttttgatccgtttcttctaattgcttatactgagcagttaactgacccatttcttgctgatattgccgaagttgttcacgctcagtattaagtttggtctgcgttgacgtaatatctggcatgggatgattattgatggccttagtcaaccgctcttgttgggactgattatcctggacttgattctcaaaggtcgttacctgttcacgtaatgatgacaatgttgctacttgttcactagcttcttgccagaaattccatttaagttggacatcatattgggctaaaaggttcacaagatattggtgtaagttatcctgttgcgtcgtttgggtggcaagttcttctttagtctggtcgatccgactatttgtccctgctaatttttcggcattttcttgtcgttgttgttgcaataattcaagctggttattaaaggctttgatcgttagttgatcagtttgaatttgcttgtcagcagcttctttagtaggaaattttgctggtaaagcggctgttttttctttcagaatagtctgcttagcgattaaatcctgtttgcagcggttcacactttcgtctattttatctaattcttcttgagagaacttggattcttgttccaattcttcctcttctcggtgccattctttaacctgttgttctattctatcgaggtcagtcttcatttctgctagtttttgagcgtgattttcaatttgtccttcccaatcactcggtaattcattatcccctaatagttcggctaaatttacctgcttggtttctacccgtgttgttaagttagcaatttgggaaacgctttggcgaacttgctcttttaactggtcaaacgtactacgattttgttgaactttaacggttgctgctttaacttgtgcttccgttaccaattcaccatcatctgctaaattcgctggatggggatgatcaagcgatccacaaattggacaaggggtggctggctttaatttttgagcaagaatggcaatttggtgacgggcaaagcgatcattcaagtcatccaactcaccttgcgatttttgaacgagtttttcagcatccccctgcttttgctctaatttcgcgcaatttttcttttcagataaaagttttgtttctaattgctttaaatcttttccagcagtcgttaatttttcctgaaggccttcttgttttgctatgtgaacttgaacctcacccaagttttcatgctcttttaaattattagtaacaaccgtcaattgctgttgagcgtcttgcaacttcttctgggaagcagcttgctgtttttcctgctgctttaagtgtgtttgtagttcatcgacagctgattttagcttatctcgatcatcgaagaatgggagtttattcgtcaagtcggcgacctcagtttgaagctgatcaatttcttcttgctgcttactcgtttgttgtaggtcggtttcaattgtttgctgttgcttttgaaggttgcgcaggtcctcatggagaaatttattgtctaacgttaatttttggagacgtttttcgccatctttccaccgttgatattctgtctggtgttcttggtaccattcaaggacttttacttgctgctttgtttcttggatctctcccgcttgagcttgcagtgtttttccagccttgataagttcagctaactcctcaatattcttcttcaactcttgctcagtatgaagttgggcatcaagctgatcaactttcttttgctgttgctgctcatcatcgcccaagtgttcaagattagcttttagtcgggataagtaatttttttcttccgctaaccattctttagttgttaattgcgcatcaatcgcggttactgtttcctttaatgattgaagttttgtttcttgggtcgtcaatgacttcttctgttcacgcaaatcattttttagttgcgttgcccactgctcataacgggacgtattaaaaaggtcacgcaaaagagcttccttcgtattgctatctgaatcgagaaactgccgaaactttccttgagggagaagaacaatctgcttaaattgatcacgggttaggttgagcaggtcagtaataaacgtgtctgcttccttaattttagtaatttcatggggatgatcgctttcaagcgggtaaataagatcgacggcttgattatgttcaactaaattgccgcggcgtccctttaaaacctgtttaggacgacgcataatttgatatttaaggtcttggtgttcaaaggtaaactttaccattgtttcttggtcagctggtgcgaaatcagaacgtaaagcagcagccgaccgatcacgatcattggttgtttgaccaaaaagtgcataacacattgcatcaaaaattgtggttttccccgcaccagtatttcctgctaccagaaataaggaatgctctatgaactgcataaagtcaatcacttgatgctcatacggcccaaagtagtgtagttcaatcgttaatggacgcatcctattcctcccctttcatgatttgagtcaaggccttttctgcccacttcttttggcggtcagttaaaccatttcccatcgtttgggaataaaaatccgcaagtaaatcaaggggtgattcctgagcacgctttttactaaggttgagttgaacctgcttggcctgatgtgtccggtgaaggctgacaatcttcggataatattcgcgtaacttgtttagtacatcggggattcgttcttggtcggtcaattcaatgtcataaaaatcttcccgtaatgcttcttcaggttttgtagccagttcagtaaaactccctttcaaaaggtgaatatcatgagctggcgatagtggaacccattcggccttaaaaggtgctgtatcaacaatccaaacgcctttttcttgcttggcttccgatactgaaaacttcattggtgagccactatacttaattttttcgtcatttaaagcattgcggttatgaaggtggccaagagcaacataatcaaagggagctaaaacatctgtcgtaactgcactcaatccaccaacctcaatcaaagtttcagaatcagccgttcgcttacttccagccgcaaagaaatgggcgacaaggacatgccttttaccaggggcaaaatgcttttccatctcagctgtaattcgtgccatcgcatcattgacatttttaatcttgtcgtcattaaaatagttgcgaacttcttgaatcccaaagaatggcaataagaaaaactgggtatccttgattgtgaccggggtaaaagcatcattaatgttagtatttaagaaaaatgactggtaagcaaaccaatcagtccccgtactcaaacggaccgctgagtcatggttcccactgattgccagtaaaggaaaatgatcagtcaaatttaattcttgcagcatctggtttaaaagtccaaccgctgcttcattgggcacggaccgatcatataaatccccggcaatcactatcgcatcaacttgctggtctttggcaattgcttcaatctgcttaaaggttgctagctgatcatcaagcaagctaaaatcgtttaatgtcttgccaatatgccaatcagccgtatgtaaaaaacgcataagttcctcctaaaaatagtgtctctaatattatatatacgcaaaaaatcgttaaatccacttaaaatcttacattttacagaagggagcgagacagaagtcacttgtgacttcgttttcgagcccccgcaagcaacaataggccttcagcattcgactttgccggacgctgaaggccattgttgtactgcgctatttatcttttacaaaagtaacttgatttatgtcacagtctctgaactaatcttagttttttaaaataacccaaataatttcttacgttgctgaaccttcttaatctgatggcgaccaatttcatccccattaatgatagctcgcgcattatcttggtattcttgggcaacgtcagcgccaaattcacgcgataatttgtcaaaggcttgtcgcatttcatattttcgtcctggaaggtcatgagcatcagaagcaaagatatatccttgaccagccgcaatcaggttcttactgaatttttcgacttttttaccaaatgtaccaacataggaactagcagtgatttgtgataggcaccctttttccaacatttgataaagcaagtccggttcagccatgatcttggtattccgttcagggtgaacaaccactggcgtaatcccccgttgttgaaggttaaaaatcatctgattagtgtaatgagggacatcattgtctggaaattccaacatcatatactttccactctcatcagcaaatagaatatcatcattatcaagagcttcaattagctgaccattaattcgcacttcttgtccaggaaagacagttagtggaatattatttttctccagttcttcctgaaattcttttgttcgcgctaaaacatcttgtttatggtttacatagtgtccgttcatatggtgaggggtcaaaagtgcatgggtaaccccgttttctgttgcttcttttgcaagtcgcaatgaaatctccatactttttgaaccatcatcaatccccggcaaaaggtgacaatgcaaatcaaccattaccattcttctcatcccttttttcacatattaatattttaagtatagcaagttatagcgggattttatagggacttaggacaaaacttcacaaaacctatattatttgaggatgttaaggagtgtctccttgttgatgacggcatttgctagctcatttcctgaaagaatagaattagcaagagctgcttttttctgttgcatttcaatgattttctcttcaattgtgttttgtgcaatcattttataaatcgtcacgttattcttttgaccaatccggtgagctcggtcagtcgcctgattttcagccgcaatattccaccacgggtcaaaatgaatgacaacatcagcactcgtaagatttaaccccgttcctcctgctttcagagaaattaagaagacggctggctgatcataggaattaaattcatcaacaaattgtaaacgatctgctttctttgtctttccttcaatcacaaagtacttaattcctgctttagcaagtttttcttttaagattgctaatgccgatgtgaactgcgagaagagtaaaattttatgattatctgccatttcatctttaattaaattcatagttgccttaatttttcccgaaggaccactgtaccccctatctaacaattgaggactgcaacatagttcacgaagacgagtaatttctgccaagactgctaatttattctgctgaaactctttatcattctgtttttgaatctgtcttatcaatctttgagcacgtgcctgatataggcgttcttgtttaccaaccatgggcgttaaaaatacctgttcatttttcatcggtaaatcattaaggacatcttgcttcaaacgacggagcatgaatggttgtaccaaacgttttaagtcgtcctgagcttgctcatcctgatttttaataatcggtccttcatactgtttgcggaactgctggtaggaaccaagtaaccccggcatcaagtagtcaaaaatactccagagttcgcttaaccggttctcaatcggggttccggttaaagcaaaacgctgcttagcattgatcgctttgaccgttttagcggcagcagtttggggatttttaatgtattgggcctcatcaataacttcaatattaaagagatgcccttcataaaaatcaatatctcgtttagcggcatcataggaagtaataatgatatcactttctgtgctttgtgcgaactgtttccgccgttcagctttactaccatcaaggacggttactttaagatctggcgcaaactttttaagctcgtcttgccaattatagataactgccgctggagcaacaattaaattctgtccgtttccttgttcacttaacagaacagtaataacttgcagggtcttccctagtcccatctcatcagctaacagtccaccaaaatgatacttcattaaggttattagccactggacaccatcatattggtagggacgcaatgttgcatgaagatttgccggcaccttaaaatctttctgcggagttttaacatcagtaactagctggtgcaattctgaagtagtacgataattcaatgcttcttggtgggataaaagatcatcaagataaagagcacgatacaccggcaatttaagttcttccgcagtaaaatcacgtgatgagattcccattttgcgcaatgtctcaactaattcagttagcgaaggttcatccatcttcaaggttttcttgcccaattgatagtactgtttatgcggccggaaatctcttagaatttgcttgatttctttagcagttagttgatcatcaccaaaatcaagctttaaaaggccagaatcaacggagataccgacacttaccttagtaaacggctgtttgtataacccattaaatgcaggagtagccttagtaattcctatttcttgcaattcattgacgccagttgctagcaaatttgttgcctcatcaactaacagaactgctctagtcccggtttgattaaacttggtgaaatatttagctagtacctgttcaactctttgcatcaaaaattgcggaaggtcatcaattttcttaattttttgtgtttttccatcaatttcagttgccaagtcacaataaatttgttcgtcatgataatccaataagaaaactactgttggtaatggaggtaaaaactttgataaatcgcgatcttggggcatctcgactgaaaacatcgactgaatcttgggtaacacatagcggtaaaactcagacatagtatcaacaccaaaaacaagatcactggttactggaaaaacagggtctaacttatcaggggctattcctgtaaaagcagtccaggtatggtcatcaaggtggtaataggctgcctgtccacgaataaggtcagccggaaggtcaacactaacatcaaggtaacgacttggatcgtcatcagcaccatttgctttaattgaaactgctgcttttaatgcacgttcttcccgcttaataggcactttccaccgattataaagcatattaccggtctttaatatttggtcaacttcatccataatcacgccagccaggggcagctcattttttacggatgcttcgtaatacccatcgcgcgttaaatcagcggtcgaggatagcttgatgatcaagtctaaccattgtttactatctttatcaaggttttcgggggtaatttgctgatcaaagaactttcctaaatgaagccgctcaccacgggcaatcccatttgttaaggttgtcaagtttggaaacttatacatatgatctggtacacctgcccggaagtaaaggtattgaccaccatcgtagtattcaccgatattagcagtaatgatcgtctgactatcaggatcgcgatcaagaaaattagctagcatttgccgggctgcttcattagtattctcttcaatattatgttgatcaaggtaccttaacaagtaataaagggcaaccatttcagcaatctgttgtccttctcttgtctttataaagtctacctggacgtccacaatcatttctcgattaaaagcaactagcactgaaaagtaatattgtttaaaacgcccagccactgaataattccacttagctccaggaattgtgaaataagcatctgcagctttaattaggatttcagaaataatttgaacatcgtcaagattagtaaagacatgttcaatcagccgtagcggaaagacttctttacttagaaaactttgcggatcaactggtaaacggtttggcggaaaagctgattgaaaaacctcccctaatgatttttgcggttcaatatttgccgaatcatcatcaatcgcctctaaaaccgcggccatatgtttacaacgatggttatcctgcgcatagggacaatcacaatgaagttgagaaaactttccattatggtatctaccagttactttataagcccgatttcccttaacgattgcagaaaaattatcgtcttcatcgattattaagtttttaactttatcgcgatagtagtaatccctaccccgttcataaattcgttgtgcaaatagattacgccagttactcatgtgtcgatcctttcaaatattgtattttcattgattatatagactagcatgacgaaaaacaaatttattcgtaccgtttaagtgttgccccaattcctactagcccaataatagcgccaagggcaataatcggaagtgaagattcatccccggttcgtggcaaaatattatttgttgttttattcttaaaagacttagctaatgaaggctgggtaatcttattctgatctgcctgaccttttattacctcgtttggtcggacggtatgttgcttggtttgcgaagtcaccaatatttctggtgctgaggtttgattatcatcattaacttccactacctgggcagaaagatcattcgcacgcatattattttcttgtgtactatcaattgttttctgtgcaggcgaagtttctttattagcgtctgcctgtttttctgttgcggaaacagtaacttgctcgctagttaaaactaccgatccatcaggaaaaacaatcaagacatcttcagtatgctttccgggacgttgaaggtcggtcgcaactttagcatcatctttccacactacctttgttccctgaggcagcttattttcttgctcatcgccgggtaaagtaataacagctttattttgatgatcattctcaactgcaatcgctgtcgtaactttaggaagaggagtttctcctggctcaattgttaatggttcaaggttgattagcgaactgtactttaaggcatcagtttgcatcggtaatttctcttttgctgacgctaacttttcttgtgaatttgtcttattgagaagtgcttgtaagagcttcgtttgcgcattgattgcttgggattgagcattagcacgatctccttcaatttgtgataagagtacactatcttgccaagctttccgtcttgttgaatctaaattacttttagcatatgtaagcttttcttgtgtctcaataagattgttagtcacttcttccagttgtggcaaaagattcttagaaacacttaaatagtaatttcctgtttctaattcttttttcgcaattggcaatacttcagcagccttcttttgatcttcttctattattttatgatgccaatcaattatctcttgaatatcactgatatccgcagattctaaatctagccatgaacgcgaacgatcctttgtaatccaatcatgataatgttgatattggttaaaagtaccctttttcttttcaatcattatttgattaagctcagttaattccttattaactgcatttatttcataattaatggtacctaagttataataagccggtgtatttttataatcattgtcaacaaagctctggtttcttctaataacctcttttaagagatcaatattatcctgatatgctttgagtttaaaattcttttccgcttgtgcattctgccctttgtaaccatcatagtttgccaagtcaaatactaaaggtttgtctgaattcatcatagtatttaaatagaatactggaactttcagtattcgctgatactcttgttgatactttgttaagtcactttgaacattatcatattcttgctgagcattattaacagcctgatttgaactattgcttattttttcctgtacctttgcttgagaatccgcgtctgccaaattttgattagcaatattaagatcattatttgcggttgctacatcagcattggctctattcactgcgtcttgggctgtactgacatttcgctgagcttgttggttcgtatcaggcagcgtttgttgaatagtatttttactattttgtactgtatcagctttagcggaattactaatggccgtcacccccgttgtaacagccattaccgtcgcagttgttgctaaactcttctttaattttcttttcttcataaataaaacccacttaattatatttaaaattacaaaaggccagtcaatacataacgttgattggtcttaataatctttatcattttagcatactttatactactttcgtgaacgtcctggtaaaggtctttttcttttaccattttagtatatactgagtatacatataaggaggggtaatatgactgttaaactgagacaaactggtaattcaagaacgttaaccgtaccgtcaggaattaaagtaactggagaagaatataccgtaaagaatgttggtaagacaattgtatttacccctgttgcaaaaaggaaaaatatttttgccaccaaagattggaaagaatacgattatcaaaaagatatcgaaaacgacccagcattacagccagtaaaacaagtaggacgtgaggtaattgattaatggaatttcctaaaaagggagatattataattgccgatgcagaacttcacgcaggacatgaaatgggtggacataatcctaaaaaaggaaatatccgcagacattatgttgtcatgagtacatccgcctataatgaggcaacccatatgtttattgggatgccaatcacaaccgctaactattctaacaatcctcgttacatgcccattttaataaatggtagtgtcagcaccggggttaaaggatacgttgttttatggcaattacagaattttgactatcatgctcgcaatggagttattgttaatcatttatccgagaaaatgattaaacaactgcaacaatatgtaaatgatatggttgtcaacgaataatataggaaagcactatggagtaagtctcatggtgcttttttgattaaaaaagtgagtgagaattaaccgtcttgtcaaggaagttaatttccgctcacctatttatattattcttcaaatgcctttagctgtttccaaaacattgggagcaagaataactggaggaataatacacagccagtaaggacacttgtataactaaagaagatcaattctgaaaataagtcggctaagattacgaccgcgatgcacagctggctaacggttaaccattctcgcttaactttattagctgagaagatcattactaattggattgctactaagactgtctgaatcaactgtagtaaaaatagtgaatgcattttatatctcctaattaaaaattatcctcgtacattttactacgcgttatgaattttttaattacagcttttttacatctatttaacaactgttgaaacctttttcttcgtagtatacttgcgccacaaggtctgtaaataataagcagcataacaagcaattacaaacggaatcgtacaatacaaggcaattcgttgttggggatcaaaccaaattaagatgcaagaaaggctgctagcaataaatgcaaaccatggaacaatcggataccatggcgtgcgatactttaactcacttaactgatgaccagccgctaaaaagcgccgacgaaaaatgagctcacataaggaaatcgcaatccatacaaagacaaccgccaatccagaaacagaaaccaaaactaaatagaccgttccagccgcatagatgctggaaagcaaagctaacaccccaccaagcatacttaagagcaaggcgaaaacaggaatcccgcgtctattagttttggcgatgacagctggaattgttccttcattagctaatgaccataacatccgggttgatgcgtataggccagaattagcggcagagataatcgcggtgaggacgacaaaattcattaagtcggcagcatatggaattccgagttggctaaaaacgtagacaaatggactttgtgttacccctgccttttgataaggaatcaaagaagccataacgatcatgcttccaacaaagaagatcactaaccgccataaagtagtatggatcgccttaggaagagtcttttcaggatgcttagtttcccccgcggtgatggcgattaattcggtcccagagaaagcaaagtttaccgttaacatcgtcataaataagccgctaaatccacccgggaataggccgtccttagtaaagttgttcagcaaaggtgcatgatggtaaccttgaatcgggataagaccaattactgctaaagtccccaacaaaataaacgcgcagatcgcaaccactttaatcaccgcaaaccaaaattcactttctgcaaatgccttgacagtaaaaatgttagataagaggataataatgataaataacaagctccaccaccaaaccggaatctgaggaaaccagcgcttcataattaggccagctgcggtaaattcggagcccatcgcaatcgtccaagtcaaccaataaaggattgcaacggtaaatccagtggccggcccaatcagatttttggagtaaacatgaaaagcccccgtatacggcatcgcaacactcagctcacctaaacataacatgatagcataaacgattaaggcgccaagcaaataagcaataacggttcccaacggcccagcctgatgaatcgtgtaaccagaactcagaaataggccggtcccgatcactccaccaagcgcaatcatctggatatgacgagcacccatttcacgggctaaatgcgttttcttagtcatgatgggtgcctccttccaagtactcatgcaaagcggcaatatcatgcggcgtagtagtacagcatcccccaacaattgtcaatccagccgcgagccattgtggtaagtaatcaactaaaccacgacgtccatggggatagctccacgtttttgttgtcggatcataagtcgcacttgaattaggataagcaataaccggtttatcagttgcctgatggattgtctcaatggcggctgttacctcttctaatggaatacaatttacgccaaccgcaaaaacatttggatactttgcaacggtacgggcagcaactgctaacggtgtcccatctggtaaatgtgtggaattttttaaggaaaaactgacatagcatagggtatcgggagccagttctttgacaaggtccaattctgccaatacttcatctaagcgcggctgagtttcaattgcgatcacatcgacaccaaccgttaaaatatcagttaatcgtggtcgatgaaattgttgatattcagttttactgaggtggtaatcaccactatattcacttccgttggcaagataagcgccataaggaccaagcgctcccgcaacatagttataaatcccagtttcctgctgatattcatcacgcgcttctttagccaagacgactgctcgctggatcaatgaatgggcctcttgttttgaataaccattcttgatgaatgccggaacatttgcctggtaagtatcagtaatcgctaaccgggcacccgccttaaaatattcctggtgaacttttttaactaatgctggctggttagctaaaacactcgccgtccataatgagttattggtatcagcacctaattgttccaaagccgttgacattgcgccatcaattagtaatggtttagttaattctgcagtaatctttgtcatctttatcccctcctcgtaaataaaaaagcccctcaaaaagaaactagtcttttcaagggacgatcaatacgcggtaccacccaaattcaggaaatttaaaatcctgcactcaaacaaacttattcatagtaataaatttgcagcttgggtaacggtagcaacgccgtgatctgctaattattcaccgatcaatcgctcacaaaccatcttcactaacgctagaaatactgcattgcaccagtcacagctctctattaaatctataattagttactcattcgatctcagcaaattctcatataaattacgattagtataccgagcgagggcgaattcgtcaagggtgtttttaatatgattttaatttataaatggatctgatattgatggcgacacttagttgaatatttccagccagtcgaatgcttagcagtaaagtattcgtcatcgtcaaaaactgggaatctaaaataatggcgacgatctttacggttatggtgagtaagtggatagtcttttaactctcttgcagataagcgcttgcggtgagtacaacgggcatttgcacccatcgaatgattgacttgtccatgcttgattccactactagaatgagaagtcaaataatgaactggcctccacggtttgcaaggcttagcaatcgtttcaactggtatttcctgaccaagttgatttgactgagccaggtagttaagctgaccatcccaagcttcatgcgctttggcaacctcataccattgcttagctttcttgtacaagtcttttaatttttgttcctcaatttttttgcaatcatcacaatcaatctcaaaggaggaacctgcacctgacactacacgtttaatactgtgaacatttcggtaaagagtcaccgtactaaagaaagtaaaatctattagcggcttagcattattcagcgcctttaccaattcagaatacatatatactttgtcatcatgactgtaaatatagtcatgaataacataacaattgaacattttgcataatagtcctttcagggcccaattgacttaggccacttatgcaaaaccggtttgatgaatgaataacattgttgtacctccatatttttgactaatggtgataaagagttaaggtatctgttctaggtaatgatacttttttatatcatcatcagatagtagcgtattttgtcctttactatatgctctatcccatggcgtaccattattatgagttggattttggtctgaattctcaaatcgctgtccagaatcaaaaaaattagcatattttttgaccgaattatcaataaattccttaatcgaaggatttaatgctgctttttggataaaatcataattcttttcttgcaattcctttaaattatcctgggcctttcgccatacttttcgatcaacagggccatggtcgaaagcttgaaatgatgctaagaaaagacgatgtcccttactctctaagtagtcagcataactataatatagaactttttgaagaggaaatgcatgtaagttaaactgagtctttaaataacccgccacttcctcatctgtaagttgacttttttcttttactttttttatgaaaaatttcaagtcgtgatatgcaagaaactgcttaaaatatggatctttttcacataaagaatcaaatgaagcatcttctgtagcaagaatatgcgaactaaacgataatggaatatctttaatcaattcattaaagaatctttcatgttcaaacacttcatctaagttatctgaaccatagtggtaggctaaatcttcattatcaactgtaactaattcgactaattgaatcatgatttattgcctcctccttctaaaatattatctcgttgtttttcatgagcagaatgtagttttttattttgttcttcatcttgaatatcccaaatctgtaactcccacggaaatgttttattattttccttgaagtaacaatgaaatgctttataaccattatcttttctgtaataataacgccaaattattcctttgtctctataatattcaagaattaacttaaccttatctttattcatatttacatctggtaaaataagcctaaaacccattaaatcattaattacttttccaatattataagcaccttcgccagttctttctaagaagcttttagctcttaacttttctgtcgcagttttatacctttttattctatatcttaaatatggtaataagtttttacaagaggtattaatttcattaagtttatactgatttagtaaatccagatattttggaatggtgaataatatctcttcgtttaatgcatctgtacatgatgttttattcattttatagatctttggatgtccactaaaatatatttgattataattcaaatagagctgattaattaacgagatagtttcactcaatatttcaatcgtatccacaaacagcaccccgtcatcgagcgtatattcgatataattttaccatattattgagtataaaatctatattttagaataattactattgttactgttattcttacgagttaggaactaaaaaatcaaccaacatatttacgctgattgaccttagcaatattatatcggatttaacttacttatcctgtgagtgccgggcaccaatttggaagtcgtccgagtgttcaaacatgtatttaacggttaggggttggtcacctgtgagcttctcaaaatcatcggttttcaaactcatctttccttcacggattgcttgaccaaacgttaccatcccgtcacttgagaatggtgcttcagagtctttcttgaactttccatcagttgtacgaggaacacccattgcatcaaaaatagcatagttctgttcatcagtaatctcttggtaactaacattgttcccagtagcttcattaccaatttcaatgaatttactaattgtcattgcttctgccccattaatatttaagattgcagagtgataatcattagaagccaatgcataagccgccgctttaccacaatcttgacgggagatgtaggccattaagccatccccttgattgttcttcaaaataccatcgcccttaacgtaggtaaaatagttagtgatcattgcctcggcatattgcgagttgcgtaagaaaatgtaatctagaccactatccttaatataattttccgtataaatatgatccttcttttcaacacttggatttgttggatcatcagcattgactaaggaagtataaataatttggtcaacacctgcttctttagctgcatcgacaacattcttatgcgcagcctgacgtttagcaccaacaaacggcatagagattaatagcaatttttcaccattcttaaatgcatcccctagcccttctgcatgattaaaatcagtttggtgagtttcaatgccaactttgtcataaggtttgagcgcatcctcgttatagctgcaaaagattaatctttcagctggaactaatttttgaatttctttagctgccactctccctaagttaccatctatacctgtaacaattaatttcttcattttactaattctccatcttaataattactttgtagttcatttcacattatgttttaaagtataatagaaagaaattcatatatcatcgtcaataaagcagtaattatttcctaaaaattactacattatgtaggagaaaacagatgaaactagaacatattgtgagtaaagtcgcaaaagattattatttaactaactcattaagagaattagacattagcccgttaaattttaagctagctggctctgcgtttcagatatatcagggtaataaaatggtaagtaaaatcctaattagtcctaaatcgttaagtaataagcaacaatcgtggatccgcactacccggactccagaggcgcttttaaatttgttacaaagagaggttattgactacttaggatgggaaaatcagttagctgatgctctttcgtataagcatcctgttcaacgaattttacaggttattcaagcaaagattacaaattcgcttttgatttttgattccagtttaaagcttctcgggcatagtgaaggaaaaggtaagccagtcctagttgattggttaaagaccattaaggcaggatatattagagttgcagataacgcaaatgaacatttagtgcaagcagtgcattcaataagagaaggtaacggaaaagagtatcgatttgccgactttaaccaacctttctatttgcaaaagatcggtttacggaattcagatcacttctatcttgccattgttattgttgatcgttctaactttgaaaaggacaaatcaacgatcgaatcagtgattgataaaatttcagcaacagtcgggctgcataacttcccctatcaatcacaaggaaacaatcttgagggtttgcttcgtgatattctagtgcggccaaacatttcagtaagtgaaattaaaaatcgtctccaatttgaccctcatcaactaaaacgaccattaagtgtgttatgtataaaggctccaacaactaatatccaaccattaagtgtgttatgtataaaggctccaacaactaatatccaaccattaggaacgatcctaacgaggtttattagtttccactatgatgattacaatgtttatatggtggaaaatagcagtccgctcatcaccaaaacgattatgcaagagttagccccttatttaattagaaataaaactggtgcagggctgagcaattctttcactcatctgcaccagtttaatcaattctatcaacaagcagttaaggcaataagactggggaaagcaaacacgtttaatcaatatcatgattacattgctctcgatcttcttgatcatatccgccaagatcagtctttgaatagttatctaagtccccaaatacagaaactagcaaaagaaaattcagaactatttaaaacattgaaactcttccttctaaatcacgagaataagaaacaaaccgctcttgaccttcaaattcatcgctcgacgttagattaccgcttaaataagttagaacaggaatacgaaattaattacaacgcgccaagagaatatctttacgtttttctgtcctgtttgcttgttggataagctaaaaggcatcctcactaaaagaatacggggatgcctttgctataacaagaattacaatcttatttaatcactaattgaacctttttctggatttcttcaaacaaatcagccggcattgtttctacaaattgccatttacgttgatgaaagtcaaacaattttaattgctcaacataattggtcatcagctgctatcctctcaaattctttaggtgttaaaaaatgatatttagtagaatcacttaactgattagtagaatgagccaaagtattattatttgctttactttgtaatagataattagtctcttgccaagagttatattctttttccgatattacaacaacattcttttgctctagacgtgcaacaataattgtttcattatagtttgccacatcatcagcgtatttctcaaatgattttctaaagtctttgattgtaactacttgtatcatagcttatcacctcgcttatattagatcagccaagattatatttgtgcacaagtgtaggtaatcaaagtaagcggttacgattcagccatactaaaagagttcagtctatatcaatatgtctagctttggcagtctccaatttactatactgattgagacttagacttacattattaaatagtctagaatttaataataatatgaaattcatgaagtataaaaaacaaaaaaagtactaagataactaaataagaccagcaaaaaattgggcgaaacatacatttaagaaaatagcaaatcggcttgctgattattatatgcttgcccattatcattactttcatgcttttgattaaccaagatttctgtcgttgccgtatactttggtaccacgacgaactgggccacgacataccccaatactccggctaataatgtccaaataattaacatcttaatatgtttacgacagagcatcattaaccgatgcaaatcaattgtattattcgctgtttgttgtgaactattcacgacttctactcctcatgtatttaattttttaaactattttgtaacaagttggtgatccgttgttgctcactcgttggcaccacttcaaaggcttgaccatcttcattttgccctcgcccttgcgcatggtcttggacgatgtgttcgttcgtatcacgataactttgtgctaaccgcatcatatcattaaaggttaaatcagtttgcgagttatcagatactgaccgtaagaatgaccggttaagaaccgttttatatgaaacggacttcttaagcagagcagtgattactaaccgttgccgttgttgccgaccatagtcaccatcgggatcgtcataccgcatccgactaaatgccaatgctttctttccgttcatatggtaggtctcacccttttcaaagtgatagccttcataatcaaacgtcaatggggacttgacatcaaccccaccgacttggttgattgccttttccaaaccacccatgttaaccaatacatagtagtcaattggaatatcaaagtggtcttgaattgtattaatcgattccttgactcccccataggtataggcagcattgatctttgctggtgaatattgcggataaccaggtaagttaaccttcatatcccgaggaagactaataatcgtggtcgtcttcgtctttggatttaaagtcattaccatgatcgtatccgtccgacccttatagtcccgaccaagcgccccggtatcggtccctaagaggaggattgagaccggcttcttttggtcaaggaccttttgcgcatcccgtgacttggtagcacccgcgctactatacatatcatcggtcgttgattttaggttgtgccatgccattcccgcaaagaacagggcgactaggactaatacccctacaactgaccagaagatcttccatccccggtgacgccgatgatgtctgtggtggtgatggtgatgttccggttgttgcataccatcatcattattattcaagggtcgactattttcgtctgacataaaaaatttctcccatttttgactaacgccgtaattaaaaaaatccactagtgcaacaagttacattactagaaacctacactaacaatggtaaataacgagttgcgaacttttttaatatcagttgtcagtcaatcaaatttataattacttaatacattattaagaatgtaatatgaatagtcaaggacgaatttcataactttttcacactttcgtcaaatcatcaagttccttctcactttccttgtgattatatcagccttttaacgggtaaatagcgaattctgatcgttaatcatctgatcgttaatcacctgtttatttcattttagttacaaattcaaatttggttgttttgcctaataaaagcgcccagaaaactttccttaggcgctcaccgttcattacatatattcattaagcttctcattatactttatcaattctgacatactggtatctttttccggctcaacaatctgcgtggaagctcggttagcagagtcatccatttgttgccgaccccagacactcatggttaggaccatgttacgtaagtcattcccatcatcggtcaatgaatacttgttttcttcatcaacaactggattaacaattcgcaagttctgcaaggatgttatttcttccttaaaagcaacatctgtcaactcaggtagcaattgatgtaatccctcaatggtaaatggccgaaagcctaaccaaaagataatccgtggttgccagcgatcttctaaaacatctagtgtgtattttacgccacactcatctttcttttcagtcataaaaatgctccattctattacttaagctactcctcttcaccacctattataataagctaatggactaatgtttatttattgtgcatttttgtgatattttttacattaaaacttatttatcacccgttttacttcttttacaagttctgctggcgtttcttcgccatatactttcttatgggccttattcaggatatgtaaaactgtctggataaagagatcgagtgctagctttcgaagtttcgtataaacgcaataatcaccaaagtaggttcgttcgaagatctcccttttcacctttccgaggcgatacatccaatattcaaagagagaaagttgctccttagcaacttcatctgcagcacttacaattcgccgaaaagtacgttcagaggtggcgatttgaatatgatatttatctccctcgcgaccattcataatcatttctatccgcttatcgctttctagctcactagcgtcttccatcaaatgaaccatgtattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgacttattcaatcctaaccgatgattattcttcccacaattagcacaaatttggctagtatatgacggattgacctgaataagctttttaccgtaccagtcacacttatattgcaacacatctactaattttgaccagctagcgttagcgattgctctagctaaatggtgattcttcatcattcccttagtattaagtttttccaacacaatgatgtcgtactttttaaccaatttagtagtgaatttttgtagctgatccaaccgttggttggcaatcttttgccgatacttcgccaccataatacgagctttctgataattcttaaaatcatctaattgccgtggaactaacactttattatgatgatcccaggcgatttcctgctgagcctttaagaaccgacgactacgcaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatactaaatatatcatagaacaaaagaaaaagcactaacgtgctttaagagagcgattcatcccctacttatagaagtgggggtattctcgcaaatttatggataaattaggttcgtctgtgcaaaacgactaaggacatctttcaaccgttcccgaataagcagctgttccccgtccgcagttaagacaaacgtccgattttgatcgtaagccgttaacagtaaggtgttatcccactgaaccagatagtttgccacctccccatcgatttttaatttatctagcatgctcatatcaatgattttacgtaccacaattatctcctccaagcaaatcttaaaaaagtgcaaattcgctgtaaaacgtttcacttttaacatgaatattaagatactgagataaatctgccctgtcaacgtctttttaggacactttcgccctattttatcgttcgctaagacggcagattttttggtaagttaacggtactcaagagctcttgagaatattttcaaaggatgttctcaagaatgaattatcaaaaaatttctgaagttttaacttttctgatgagcgataagcggatcacgattgtccatggagtattgaagagtctcgggatctcaccacgccgggacgactatgatgattttgtccaagatgcttcgattatctttgcccaggcctacgctgatttcttacaagagaaagatgaagtcgaaaacgaacgggacttgatgtgctttgcttatcaacgaatgcgctggcgcttactggaccggttacgacggcagcaacttgaaagtttcctctttaattacaccctcgacagcgaagaagatgatcatgactacggcaagacaatggttgaccattcagcgaccgcgccatttgctcacctggaaaatagcgactttcttaactacctctaccaccactgtccccgcgttcaacaacgatatttgattgccaaactcaaccaccatttgagtgaccggcagattgcggatgagtatagtgtcagccgggcagctgtttcgcaatggcggcgcggagtaattacccgggcccaccagcttcgtgctaaaatgaaaggagagttttgaggtgagaatgtggaaaaacatgaaatcgatcatcaagctaagtggctccatattaaatatgatggcgaagatcgtgatgatgagtgcgttaatgagcttagtatttatcagaacgctgacgagcctgagctacaaatgctggtgtcaaatattgattttgataatatcagccatgataatacttttgcactgacaaaagaggacgcgaaagtattgattgactacttgcaaaagtgggtaaactaaaaaacaggtctggaattgtcacacagggcctgttttttattcacttacttgatcttttcccgatcaaaactttcacccaacatcttccaataatccatgatcatcgcaaagtcaatcggaccttgaatctcgaggtcaagttgggtaattttttgtaactcgttactcaacaaaacccggaagtcagttaatttaataatcgtcgaatggggcgatggtggtaccaaactaaggacgtgatccatgagatcctcaatcagccccgcgcagaagtccattaaatcctcactgggcaaggcagttggttctaataaatgctcccgctctttatcaaaaatcttataccagtgtgacatcgagttccagtaggcattgtagaggcgtttgctttccttatcagcgtattctaactggtaacgacttaaaactttccactgttctaacaaatcaacatagagtgattcatgagggaaagccgcgtcttcccgggtttccttaataaagtgtgccaaatcatcagtcatctgaaccggtgttttcattttcatttctctcattttccttttatattagtttgttgaatggtgagcggtgtttttaattaatctttcccataaaactgcgcagctgcaatggcccgttgccatccccgatacaagtcagctgccttttgcggatccatctgcggatcaaactggtcgccaatccgtgatagcttccgtaactcatcctggtcttcccagaaatcaacggccaatccagcgagaaaggctgctcccagcgcggttgtctcttccattgctgcccgcttgattggcgtttgtaagatatcggcctggaactgcatcatgaagttgttccgtgaagcgcccccgttaaccgttagtgctgttagtggtaattgggtgtccttgaccatcgtatcgacaacatctttggtctggtaggcaatggcttccaaggttgcacggatgatatgtccccgttcagttccccgggtaaggccaaacattgcgccccgcacttcttgatcccagtacggtgcgcccaatcccgtaaaggcggggacgacataaacgccaccagtggtcttggcatcaactgccatttgttcggactcgcttgccttattaaacatcttaaggccatcccgcaaccattgaacggcagaaccggccacaaagatactcccttcaagcgcgtaatgagtttgtccgtccagaccgtacgcaatcgtcgtcaacaagccgttatccgaaagcgtgggttttagtcccgtattcatgacgatgaaggctccagtcccataggtgttcttgattgaacctttatcataggctgcttgaccaaagagagctgcttgctggtcacccgcaatcccggcaattggaatctggacaccatagaagtggtaatcaccggtataaccgtagattgctgaacttggctttacttctggcagaagcgactgcggaatctcaagcaagtcaaggatatcttgatcccactcgagggtatggatattaaaaagcatcgtccggctagcgttagtcacatccgttgcgtggacccgccgtcctgataatttccatagtagccaagtatcgatggtcccgaacattaagtcacccttcgccgctttttctcgggcaccagggacatggtcaaggatccacttgatcttggtggccgcaaaatatgaatcaatcactaagccagtcttcttgtggatcatatccttataaccatctttaatcaatcgttcggcaatatcgctcgtttgctttgattgccagacaattgcgttataaatcggcttaccggtatggcgatcccaaataaccgtcgtttcccgttggttagtaatcccaatcgccgcaatcttatagggcttgatctgggacttaatcattacgtttgaaatcaccgactgaacgctatcccaaatctccaggggatcatgttcaacccaccctggctgcgggaagtattgaggaaattcttgttggctgatcgcaaccttatttccgtcatggtcaaagataatcgcccgtgagctcgtcgttccctggtcaatcgccatgatatattgttgttcactcaattatattcatcctttcgctgctaattgcgagcagtttctacctatataatgggaagaaacttgatggattttagatcatacaaaaaagccaccgtgcaaagactgaactgcctcccccgatgactctcttgttgttacttgtcgctgaccatcttaccagctacactatagcggtctttgcgcatctcattcaacacgatatgcacccgttcggcaggaacgttggcatcctttgaaattgctgctgtaacatcctttacgagagcctttaactgctcatcggtccggccttcaatcaagtcaatatgaactaatggcataatccgtgcctccttctaaattcatttaaaatcttaccataatagcgcttttacggcaattacattaacgaaaaatattttaattaacgccgcgcaaggcttcacgaacctcttcggctgctttccggtccccagtaaagaggatatgatcaccatactcgataatcgtatcaccatgcggatcgattggcttgcgcttccggaaaatccgactaatcgtaatatcattaacaaatggcaatgtatgcagttcacgtccagtataacgtgaattaaggacggttgcttcgtataggccagcttcagtatcggtcagcatccgcaagatcaatggtgattcaattaaggcacgcaggacactgctttgaacattgaaactattaaagatctcaatccctttttcccgaagagcactgacatctttcgggtccaaccgcggattattttggctggcaataacccgctttaccccatgttctttggcaatctgagctagacgcgctgacttatgatcatttaagaacccaacgacaacaatatcacaatcaaagtagcctccctgctccagggcctccgcgtcaagagtcgggagatactctaaatgcttcacctgactattataggtcttgaagttattttcattgtccgtcaccatccgcacgtcataccagttcttatataattgttgggaaattggaacagttaaggtgttggttccgataaaattaaccttttgcttgatcaaatcagacttttcaagcttatacattgaattgaagacgattggcgcaatgatacagataatcacggcggccaatgtaaaggcatccgattgcgcaccagtaattgcatgcaaattccgcgcaacttgcaaggttggtaataccaaggtaatcgttgtcgctactaaaaagctgcctgcaaatgaattgcggggcttaaaacgccgtcgataaatgaacatggttggcaatttagcaagtaaaaagccgatgaccaaaatcggaatcagggctagcgcttggtggttagcaaataaattcttcaagtcaaggcggtcacccgtcatgataaagaagaacggaatcaggaaaccataaccaattgagtttaaccggtcttcagttgcttcactaggctcaagcagtttcatgaccatcccggctaggaaggctcccaggatattttctgctcccaccgtttcggcgattgttactaaggcaaagatcaagaagaaagctaaccgaatatcaagttgagtggttgatttggaaattttattaaaccaaataaacggttgcttaaaccgtcgcaagaggaaaaaagctgccaagaagaggaagacaattaagcccaagcgtttggcattgcccccattaatggatgcatagaaggtcaatgcaagcatcgggaccacttcccctaataccgccgtcaataagagggtctgccccactggcttttgtaaaatatccttttcttttaacgttgcgataacaactccgagggcgacggttgaaaaaataattgttgctaacaaaatatcgctaaataagtgcaaacggctaataattaaggcaatcacaaatgaagaaataacaatgaggccaaatgcctgtgaagccataattaccggcgacttactatcacgctttttcccgggcgttttgcggaacaggtcaaaattgatctccatcccggacaaaaacattaacataataacccccatcgacgacatcatattgagggtccagttggggttaacgatatttaagaaactttttcccagaataatccccgtgataatctcagcaatggcggtcggaattgaggaaaccttaaaccgcgccataataataggaataattaacgccgctaacataacgattaacagtgataattgttgcatattttctttctcccttcctattttatacagcaatattatatacttcttaacttgaaattaaaatattcgttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaatcaataaacagccacggacgcttaattttatctttggcccggtgacttttcaacgacggtattatcaggctgggacaaagaaacgtgaattttacttagaccaacaattaaaaattaaaccacgtcgtcgtttatcgccacactacttaatgatgatgtctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagcctagttcctcaaggtgcacatggtgaatactttctcgaccgctatcattgtttacagaaaattgaacatactttaggccggcacaacgaattagccatgcgagcaattaaagccgttcgtcatcatgatcaatcagagctaacaatattttagatacttatgaatcacaaaacctaacggaaaaacaagcagacgacctaatgcgtttaagaaagtatctacagcgaaattggcggtatatcctctcaccacaaatgcgcggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatacaatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagatacaaatattctaactaaatcgacttaaatcgtggttcgcggtacaattaatatattacacaaaaggagaatttattatctatggggaataaattaactgcatgtacaagtatattaattggaaaggatgctagtatcgacggcacgatcatgatcggtcgaaatgaagatgctaaggctgcctggcccaagcacatggttgttcaccagcgtggcgaaatgcccagtcacttcatctctaaggatacccgtttagagcttgacttgccagaagaaagcgctcgatacacggcgactcccgaatggacagataaagatggtttatttgaagaagacgggattaatgaatatgatgtggcaatgagtgcgactgaaagtgcttattctaatcccctcgtcttgggctatgatccgctagttgaaaatggattaaatgaagaagcgatgatcaccgtggtgctaccatatgttaagacggcacgtgaaggagtccaacgccttggtaacttgatcgcgaagtacggaaccggcgaaacaaacggggtacttttcgccgataatgatgaagcatggtacttcgaaaccggagcaggtcactactgggttgcgcaacggattccggatgattcatacgcggtggtcgccaaccaactggcaattcaagaaattgactttaatgatacgaataatttcatgttccatcccggaattcaagaatttgttgagaagcatgacttaaaccctgatccagctactttcaatttccgcaaaatcttcgggacagctgaccggtcagatgcgatttactctgaaccgcgggtatgggttggtcatcaaatgtttagtccccggcaagcaacggaagagaccccagaatcaaccgaactgccatttatcatgaagccggaccataagttatcgatttttgatgcccagaactatctcagcaaccactatgagagaaccgaattcgatccgcttggtcatggtgagcacgctcataagtaccggccaattagtttagcaaagacccaagagtcacatattttacagatgaaccgaccgggcgctaatattcactggttagcaatgggagtcgctgccgaaagtacctatgtgccattcttcaacggtattaccgatacgcccgccccgtataagcgtgggaagctaccggctcagctcaactctgcttactggattttcaagcatgccagtgtgctagttgacagccacctacacgattttcttccattattacgggatgttcagaaggaacgaaacgccgcggccattaagatgattgccgaaactgattgtcgcctcccgagtctcaaaggagaagcacgagcaactttcttaacgcggcaaagcgacgactatgcgaccgatactttgaatgcttataagaagttaagccttgaattgattaccaagatgactgattattgtgaattaaactttaatacagatgagaatctgtaaaataaaaaagaagcagctcctaagttggaatttccagcttaggggctgcttcttgtatgcacctaaataaacgaggatcaaagagttttacttcttcaaatcctcgtttatcttaattttgatgatgtttttcaactgccgtaactagttcttccaatgattgacttccaaaaataactgggtcatcatcaatcatcgtcgctggaacactcataatcttcttttctttccgtaattctgggaaatgctgcaagtcaatcatcgtggcagtaattcccacattcagagaagccatccgttgacaagccgcaacaacatcaggacagaaatgacaagttaaggaaacgccaatccgaatcttagtcggcgcaagtttcttaattcgttctaccatttctggtgcaattgtttgtccaggaccggcaacgttgtagacacctagaactaaggagtttaattcgtgaccagttggaatccccgcataatgtaagccagtatcattaccatccgcatcaagcaagcgcaattgtggtaagtactttacgtccgctggcgccggtttagtctccatctgcaggtgcttatcaagtgaagcaaattcttcaacaaagctaactaactgattgctaagctctgtcccattggttaacacttggagtttaatatccttagtcaaacgggcaaagattggttgtaactgttggtcaatctcagctggcagccagtttccttcatgcggcgtggtgttttcttgttgactaagttcgcttgtctgtcccacggtcttagcaggctttttattagtttctgcatgaatcgggataccttgcttttccttttgcaaaataatgtatcgttctgcagcagtagaagcaaccgccccatcggatgcagctgtcacgatctggcgaagatttttatggataacatccccagcagcgtaaacgccatcgatgtttgtcttaccattttcatccgtcatgatatagccccgatcatccaaatcaaggatattagctaatgctttcgttgctggttgcgtaccaatataaatgaacatcccaaatgtctggtcaccatcatcgacatggtaaaccgtctcttcgccagtcttattattaaccaaggtagcagtagtaaggtaatcatccccactaacttcctttacctcagtattgtattccacactaactttaggattatccaaggcacgcttagccgtcaatacaggacatgcaaaatgatcgccacgaactaaaacagtaacgtgcttggcaaagcggctcaaatagtcagcttcttcagcggccgcatatccgccaccaacgacaaagacttgaagaccggtaaaaagttcgccatcacaagttgagcaataagcaattccccgtccacgaaattcattttcaccgggaaaaccaacttttttagggttagcaccagtcgcaataattacgcttcgggcagtatatttttgaccactcttgccaatcaatgtcttaacttcaccagtaagatcaaacttttcaaccgcatcatgttgaatttcaaccccaaagctggcgacctggctttgcatctggttcatcaattgggtaccgtcgactttttcgacagctggataattataaaccaccgaggtcgttgttacctgaccgccgacagtatctccttctaaaattaacgtatccaaggttgcgcgtccagcatataaaccagcagataatcccgctggtccagcaccaacgatgattaaatcatataaatgttgttctgccatttagctcaccaaattaaagcttaccaactagatcaagacttggcttaattgaatcttggcctggcttccagttcgctgggcagacccggtcaccatgttcacgaacaaattgagcagcttggagtgtccgtaagatctcatcagcactccgaccaattcccatattattaattgtgtaggattggataataccatcaggatcaacaatgaagactccccggtatgcttgaccagcgtcttcgtcaagaacatcgaacatccgggctaacttaccagctgggtcagcaagcattggatatttgatcttgccaatcttgtcagaagcctgagcccatgccttgtggacaaattcggtatcctcagaaacagagtaaatctcagcgtttgctttcttgaagtcttcgtgcttatcttgcaaagcttccaattcagttggacaaacaaatgagaagtcagctgggtagaagaagaaaatactccacttacctaaaacatccttcttggatacttcggttgtttcaccgtcatgataagcatttaccttaaaatcttcaatttcatgtcctacaaagttcatgtatatcctctccttaaattagaatcattcttaactgcaactcttagtataatctttttatgctaatttgcaagtaattttagaataattccaaaaagatcaaatttccttgccgaagattttcgtcttaatcgcctgtccagttggggttccagccagtccaccgaggcctgtttcccgtaaatcaactgacattgaccggccaaccttatcaagagcagaaatacattcatcggccggaatcatactcgtacaaccagcgagtgccatatcagctgcaattaacgcgttcccagctccaatcgcatttcttttaacacaagggatttctaccaaaccggcaatcgggtcacataccaagcctaacaagttactaagagcaattgccaatgcttgactgctttgttctggactaccacccgctgcttcaacagccgccgcggcagccattgccgatgctgaaccaacttcttcttggcagccgcctgtcgcgccagcaattcccgcatgattggcaataattaagcccaacccaccagcagtaaataagaagcgaatcatctgatcttcactaaggcctaatcgttgttctaacataaaaagagcgccaggaagagtcccggatgaaccggcagtcggggttgcgcagatgactcccattgctgcgttaacctcgttagttgcgatcgcattttccacggcagccatcataacatcaccagagagggtctttccttttgcacgatattttttcagcttaatcgcttcgcctccagttaaaccagtttttgaccgaactcccagctcattttcaccttgtttaattgcggctcgcatcgtcagtaagtttgatcgcatccgttgccaaacttcttttcgattgctaccagattcatgacattctgcctcaatcactagttcggacaatgctttttgctgaatttctgcagttcgcactaaatctttaacactttgatacatcgctctttctcctaaagacaaattgcagccgggtacttcttttcaaaataagcaatcgtcgctggctgcatcggttttttaatatcgtaaacataaatatcacaatcatctgcccgtaatacttgtcgccgggtaaatggtgctttttcttccaaatcagtattgatcgccagtgcattggccatctgtttactataatcgcgaaagataacaattggtaagggacccgctggtaaaatatcaacaccatcaaggttaatagccctaatttcaattatcccgccaccgatcgaacaaccagcaaccgttaccctcgtcttatcaccagtcatttgaaggatggctgtgttaggatggtgaatcgggctttcaccctcttcttcaacaaagcgaaggtccattcctccttggcgagcaatcattggcgccgatggaactcgtgaatcgtctggcgcaaatcctagcaatcccgccgcaattgcatagtctgttccatgaccacgatgcgtccgagcaaaagatccataatagtgaacggttactttaggtggaaccgtgccaaaaagtttatttgcgactcgaccaatcttgaccgcccctgcagtatgcgaactagaaggaccaatcattactggtccaataatgtcaaaaacacttttatagttatttttcatgttgttgttcccttaaaaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagtttcccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttgttgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtccttagctcatggttccgactactacggcccatagcggactttcaccacctagctaatacccatgccgggcgcactaaaatagaggttgaaagaaaaatcatgtttttctcaacctcttcattataattactttttctttttatgaaagtcaagaaatgaccagaagccgcgatgaccaccagattttttcttcggtttcttttctgcttttcgatcttctttggcagccttttcagcaagtgctttttgcttggcgagaattcccgcttttgccgctctttttcagcctcttttcgggctgccattgcctttttagcccgtgctgcccgttgctgagcagcttctttcattaattgtggccgcgttccattgtatcaaacattgttgccaccttaatagctgccttattggctaaggcttgatcagtatttgaagccacttcaatattatgggctgccgtaatctcacgttcccagtattgttgtgtcttaataggtaaaccagcaaactcctggctccgtaagaactgacctgctcgtgataactgcatcttcaacgaatgcttatccgtttgctgaccatttaatgcttttcgcgaattataaatcgcttgatcaacaaggtcgaccattgcttgtggttcattatatccctctttatgctcttgaaggacatcctcccccattctaatggcttcatcataaagacccttagaacgatcagtcccattaaagtatttatatgtttgccttacacgtacttgatcagctacatctttacttagttgatcaaaaactactttttcgttcattagatttccaccgcccgactttattcgtctactattcttagtatagcagttattgatcgcgaacgaagctaaaatgtcaattttttagaagattatcgaaaaaggaggctgagaaaaaactttgttttttcaacagcctctttaatctatacgaacattatttaagatatcgtggaactagcttcgcgtcgtaaccacaaggctcaagtctaagtccgaacgataatcagcccgtgccgtgctaatcaccgttctatccttagcccaccgccttgtcgagaaggttaattcccactcactccttattaccaactagccttacgaacaccagggatttgacccttgtgtgctagttcacggaacttaatccgtgacattccaaacttacgcatgtaagcatgtggtcggccatcgtaacgatcacggttgtgaagacgaaccgcactagagttacgaggaagtttggataaaccgatgtagtcgcccttcgcctttaattctttgcgcttttcagcgtatttctttactaaagcttcttggtgatgtaatttagcaatctttgacttttttgccattaagtagttctccttttatattaaaaactttatctactatacaattactatttaaaattaaaacatctgcgaactcttttcattttaatattatcgctgatacttacaaaaaatacaaggattttgcattactttttgacttttcttaaccatttaattttttcgcgtatttacggtattcgtcagcataattgtattgattattatattcagttaaaagttcatcatcatgggtataagcccgtcccgtcaccatcatcttcttgtaaaggtcacggtatggcaaatcactcttatcggcaatttgtttttcctgatcgcgactatatccaatatgacggaagctagtttcagctaaaccaatatcgtctacttccaaaattagatagtgggctcgcaaatcacgctggagaggttgccagtggttgaatggctcgccgactgctccgggatttaaaaccatgcgttcatcactcccataccgtaaaaggtcatggtgaacatgggcataaatggcaatatcaactggttcgccagcgacattaaacagcttatcaaaattttcactaacttgcgtgggaaaaaggtcttgacccatattaagccacggcaaattatgagagatgccaaaattaaggagacccacgcgtttcgtaacgtgcatcggccaacttgcaatttcatcaatcattccgtcaggggcatgttccgcaacatactgggctaaccgtgcaaagtaaatgtgggaaggacgctccatatccatcatcccgcgagcgccacgaacaactaggtcatcccagtttcctcgtacaattactgttggcttcatttcttgcaaaatctcccaaattggttttacacttgggcctggcatcagtaaatcaccaataaaccaatattcatcaacatgttgcgctatgctatcgcgatacattgcctgcaacgctgttagatttccgtgcgtatctgaaaagactgcgatcctctttttcacagatgatttcccctttcttaccttcattaatatattagcaaattttcgaaaaggaatgctaaattaatttgtattttcagaatgatttcccacattacaaattattttgttacaatatacttttatgaacaaatcattttaggagatgataatcaaaatggattcggaagtcgcaagaggaaaatttcctcacggttggcaccgaactttttacaccctctggctcggcgcgttcatcaccgggatgggctactcgatgacgatgccgtttatctcactttttattgcagaattaggaaattttacgcgttttcagctcaacatttactccggactagcatttggggtgaccttcattagtcaagccattgtttcaccgttctggggcagtctggctgatcgcaaaggacgaaaactgatgtgtatgcgtgcatcgggagtaatggcttgtacaatctgtgcaattggatttgctcaaagtgtctggatgattattggcatgcggttccttcaaggagtcttttccggctacattaataacgctactgctttaatggctggcgaaacaccgcataataaatcaggctgggtaatgtcagcgatgactactgcgggggtggccggcaatttggttggtcctttgcttggtggtttcctatcagaattgtttgggtaccgaatcccatttttcatcaccggagcactaatgttttgtgtctttctcagtacgtggttattgacggtagaacattttaccccgattaaaaaagaagcgatgaagccaatgaaagagataattcataatctggataatccaccattgatcttcgttatgttcttaaccacaatgattgttacttcttctaccatgtcaattgacccaattatcagtttgtatgttcggcaattgatgggcggccacggcaatattgcctttgtcgctgggattgttgctgctactccaggactaggaacattgcttgccgcttcaaaggttggtcacacgatggaccggattggaccagaaaaagtattacagattgggattctcacggcctttatcctctttatccccatgaccattactaagtctccatgggccttggcattttggcgcttcttgcttgggttagcaaacgcggcgttaatgcctgctacccaaacggtcttaacccttgacgtcccaaccgaagcattcggccggatctttagttacaatcaatctttccaggctgcgggtgcggtgttagggtcaattcttgggtcattcatttcgggaatttctagttatgaaatggtctttgtcattactggtttgactctcctgcttaactttatcttggtgatgttggttagaccaaagaagcaacttacagaataacttaaagaaaagagaaaatcatggttcaaacaaataaattattaaatgaacacgaagtaaataacttattttcccgggttgccccccgctatgacttattaaacaatgtgattagtctaggaacgcagaaaatatggcgacacgaactttttaaccagcttcaaattaagcctaccgataacgccttagatgtttgctgtggaacgggagacctcacaattgccctggctaagcggatctctgctggacgagtaaccgggcttgattttaataaagaaatgttggaaatcgctaaagaaaagacaaagatgattggcaacctcttcttggtacaaggggatgccatggcgttgccgtttgatgacaatagctttgatatcgtcaccatcggctttggcttacgaaatgttccagatgcagataaggcgctcagcgagatttaccgggtcctcaagccaggtgggcaattcgttagcttggaaatgtcgcagccgaccaatccaattattaaagtcggctggaaagcttactttacggcctttccattgatggcttcattagctggtggatattaccgcgattatcaatatttaaagaaaaccagccaacaatttgtctccgcccaccaactggcgcggatgatgaaggcagttggatttaaggaagtccattaccaaccattgaactttggcgcagctgcattacattttggcgataaatagaaagggagcgaggtagaagtcactcatgactatctcgctccttttcaaattattaaagaataatattgacaacattaaaaactgattataatatactggcaagcaatttaataaccgcaatgaaaagatgagtaattgatggtcgccttctccagagaactgcggatgatgggaagcagcgttggctaagttagtgaagatggtcttggagcgataaaagttgtgagctatttgtaagcagcttacgggttggtgtacgatataacacctgagtattccctttgagtacttgtagagagtttggctgtgaggtcaagctaaaatagggtggtaacacgctatcaatgtctaatcattacgcgtccctagaactaacaagttagttctaggggctttttttatttcacgaaaggagtcactattatgactgaatttactaagagaaccacatcaccatttcgctttgatattgttggcagtttcttacgcccaaaagaattaaaggaagctcgcgctaaatatcaggtgggacaaattacgaaagcagaattaaccgcaattgaggataaaactatcattgacttaattaagaaagaagaagcagccggtttacacgccgttactgatggtgaattccgtcgtagctggtggcacctcgactttatttggggattggagggaattgaacagtcaacttctaatgcaggatatgagtttcatgatgaaacaacaagagctgaaacggcaaagttagtcggtaaagtaagcggaaataatcatccttttgttgagcactttaaatttacacgtgaccatgttagtactggcacgcaagttaaacaaacaatcccttcgcctgctcaagccttctttgaatttttgtgcccagaaaacattgctagcgtcattgaactactcccacttagctaaacctacggtttaatgcttgaagtgggagattctggaaacatcgcatacttaccctaccgattctgaacgaaccttcaagcagaggttacgactattaaccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgggcctttaagaaccgacgactacgcaatttctcccaacgatacaactttttatggtatttgtcttcaaaatgattgattggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccaagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcaaaaatttagcttccggattattcttgcgccgtttaatttgcatattaagcatttgattccatacaaaacgaacacaaccgaaggtttgccagagctgatttcgttgtgctgaatttggatagatgcgcattttaacggcttttaaaaccattattttctcccttgactttcaatatatcgttttaaaacttctaaaggcgctccaccagtgctaattaagcaatagctttgtgtccaaaaagctgatttccaaagatactgcttgatttctggaaattgttttttaaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatatactaaatatatcatagaacaaaagaaaaagcactaacgtgctttaagagagcgattcatcccctacttatagaagtgggggtattctcgcaaatttatggataaatgagacctttgaacaaatctcctttaactctgctttcttttaaattagcccaatcgcaaacgttacgacttgaaccagtgagccaattaataatattttaactgcacatggaaatgtctctttcttaacttgcttagcaaataacattcttgtttgcttaaccacaaatgggataatcaataaggttaacaagactgtccatggtacgaaatgaagaaccgcggcgaaaataatagctaaaaatgctaaaacgttcttaatagcaaatgcatatagaccatttttctgcccaataaagtgaataactgtatgacggcgattgtcttcatcttcacccgcatcacaaatattatttgctaataataggttggaaatccacaattcatccggtaaagcaacgagaaagacgaccccgatatttgcccaggaccatgtaaattgctggccaacattaataaagacagaaataagggtaatcatgaaccccattgtaaatcccgaggcaaattcaccaactggcaaccctgacaaaggaaatggaccagaagagtaaagaatgccgatcgcaaaacaaaagattcccatccatagtaacggaaggccaacacgagtaactagatagattccgattaagccggctactatactaaaggcaagcaagagaccgagaactaaacgcggtgaaatattttcccgcccaataatatttgtatttttcttataatcaacggtatcaatggcatggttataatcattataattatccatcatatcaaccgccatattgaataatagcattgcaatgaaaaacagaactgaatttagtaggtttagggaatgataataatagacactaaggcaaaccccgaggagcatcggtaagatactagcagttttggccttaatttctactaattccaaaaaaacatttaacgacatttagtaaattttcctttcataattccttagttgttcggtacaatatagatggtacaccataacaaaggaattatcgattaatgaaacaacattttttccatacctatccggcgattaataacgctctaggtaaagtaaatcaaacaattaatgaccggattacaattaaaaatacccaactacacgatgccctacaacaaatggcctcaaatggtggtaaataccttcgcccagcattcttccttttatttgcaaatatcaatcatcaaactgccgatgagcaagaaagactaattaaaattgcctcttcactggaggttttacacatggccactttgatccatgacgatattattgatgattcacctaagcgtcgcggagccgtcagtgtccaagccgcttttggtaaagatacggctgtctatacgggagacttcctttttactatcttctttgacctcctcgtagaaacgatgaccggatccccctatctgacacgaaatgcccggacgatgcgcaaaattcttaccggagaactaggacagatggataatcgctttgatcttgaccaatcattactcgattattatcgcaatgtaaacggcaaaacggctgctatttttagtcttgccgctgaagaaggagcctattttggtcataatgatcgtcggactatcaacttagccaaacgaattgggcaaaatatcgggatcagcttccagatactggatgacatccttgattattcaggggatgaacgccttaacaaacctgttttggaggatttagcaactggtgtttactcccttccccttcttttaaccttgcaaaatcaccggcatgaattagaaccgttacttgcaaaaaaacgccaaatgacgattgaagatatggaaaaagtccaaaagattgttgtcactcatggcggtgttaaaaaggcgcaagaaattgctactaagtttacacaaaaagcgcaaaccgaaattgatcaattagcagataagcatacccgaaagatgttgaagttggtagcaaagaagttattgacgagagtaaattaaaaaagataagactaaggaaattccatttctcagtcttatcttttttattcttgaaccaagatctcaacatcccacgaatcaagcatcgtttcaggaaaatcgccagtcaaaaggtctcgatatcccttttgaaattctactggtaatggttgtttaccctttcccatattaaggacaaagtaaatatcctgacctgctgaattttggcgttttgttatctccaattctgtttgctctttgactaacgcggaaaggtgcacatcatcaacaatatgcataatgatcttacggagactagcatggtcaaggcgactaccaacataccatgctttcccttttgaataggtattctcggttaccgcgggagtccctgcataaaattcactagcgtatttagccaggacatgggctccattaaggcaaattaaatctgctattaaatgtccagttagttcattcccggtcgtcattgctaatttaacatctttatcaggaaggattgcatcgctttcttcaacccacagccccattacatcttttaatggtccaggataaccgcccggatagatattatcggattcatttaccattccggacataaaactagtaataaaattaccaccgtttgcaacataatctgtaatcttcttgcctaagccatccttaaccatgtaaaggaccggagcaactacgaggtcatattggctaaaatcatcatcaacggaaattacatcaatcggaatattcagctcataaaattgccggtaataattaagaataattggtacatattttagggcctgggtaataccatcgacatactcaaaagaccagaaattactccagtcaaagataagggccacccgcgctttagtctgagaatctttaataaccgggcccacttttcttaaatcatgacctaatttcgccacttctttaaatgcccgggtatcagtccggttggcgtgactaatcacagcaccatgaaacttttctgatccgcccagtgcctgcttcaactggaaaaattgaacagtatccgcaccatgcgcaactgcctgtaattcagtggccgccatctgtcccggacgttttaatgggctatatggttgccagttaacttgtgatggcgtggattccatcagcataaacggctggtgctttaaagaacgcatcaaatcatataagaatgctggctgataaaccggtgcatcataagacggataactatcatatgatataatgtcttgcgcactagcccactgctgataatcaatcattttattgggcagactatgaaagttagtagtgactaaggtcgttggatcatacttttcaatgatttgcttttccatcttaaataaatcaagcatttgggtcgattgaaaacgtaaataatcaattgaaagtccggcgacaattgtttccgatccttctgggccccatgcatcaccaagttcattaggcacaacaatctcattccagtcataaattgtatgactccacacattcatattccatgcatgattaagattatttaaggtttgatagcgcgccttcaaccattgctgaaattctgtttggcattcttcacaataacaattgccaccatattcattattaacatgccaagcaacaatatgcggattatcgccatatcttttagcgagctgttcaacaagatttttcgctaagcgccgataatttttactgcttgggcaaaagttatgccgggcaccaaatacatggcggcgtccttggtagtcgacccgcgcaacatctgggtatttcttgaacatccaagcgggcatcgcggcggttgaagtggcaagaacgatatcaaaatcagcagccgttaattctttgataattttatcaagcttggtaaaatcgtattttccttcctgcggttcaagcaaaccccatgaaaaaacattgatcgtggcggtatttatatctgcccgcttaaatactttaatatcttcagcccacgtttcttctggccactgttcgggattatagtcgccaccatataagaaacgaggcaattctttcttcatcattatctcaccttatttaaattctactgttactaccttatcaccatgcttaataagcttaccgggagtaaaaccagccgttgcttcaatattatgtggttgcgcaaagaaagtaattacccagtcttcgtaccctctttgtctaatcaattcacgatcaaagtcaaagagtagctgcccctttttaacgatttgaccgtcattataatgggcattgaagccttcaccacgcatgtttacggtcccgacaccaatatgaacaatcatttctaatcccctgtcagaagtaataccaaacgcatgacgggtgccaaacgtaaagttaatcttcccgtcaaatggggcgtacaatttatcgctagttggcctaatcacaaagccctttccggggaacggttgaccatcacgatcgacgacttctttcattgcaactaattcgccatctgttggggcataaatcgtttcttctttaagaccagtcgatgatgtcgacgcttcacttgtcagttctccttgtgctaatttatcctttaattcttcaactacttccgcatgaacttcttcactcaatttcaccttaaaaagaaagacaaaaattgacaaaatagctaataccagcgggatatagaatgccatactatcgaaagtccgaatatcatgacctgtcatgtcagcagcagtcgcgctccccgtcattccggctgcgattgcgatataaccgacaaggccatttgagatcgcccctgttaatttatcaatcattggtcgcacagcaagaacaaccgcttcatttcgttgaccagaatttaattggccatattcaattgcatccgttaatgttaaaactgttaccaattgggcaaaattaatgttaaacaagaccaatccaaagtccatcattaaaacattagagcgggcaaaaataaagattaaatatgctaaactcatgcagacttggccaccaatgaatagccattttcgtggaataaatttattcaaaataggataaagaggactagtacagaaaccaataatcgtagcgatgaccccaacaatccagaattcaccaggtttaccaataacaaacttgtaaaggtagaaaaggacaccattagttacaacataggcacatgaataaagtaaatatgccaaacttggccataagatttggtcattgtgaaaaattgctgaaaaaacttcccgaatagttgtcttatcctgggcagacttacggatcacattgtaattttctttcgtcccaacacaaacaaccaaggcacagataacagctaatgccgaaataatggcagcaaaggcaaaccaaccagcaggcccctgccgatgatgaccagtagctaaataagtaaaggtcgttacaatcggtaccacgataatcgttaatccattccaaccaagtgttcccgcaaaggcaccgagagcggtataaacgccccgctcttcagaatcttcacttaaagcgggcaccattccccaatacgaaacatcagaaaattagtagaaaatatcaaacgtaatgaaaataataacaaataaaatggcaaaaagaacccaattatattttgctaagccaaagattccggtaaagaggattaatagcagaatcgcactaacgatatttcccattaaaatccacggcttaaattttccccaccgacttttagtattatcaacaatatttcctaacagcggatcaattaataattccaaaatccggacagaaacaatcaaaccagtaatcaacccaattagtttattagcaaccgttttgtttagtcccgcgaacattccgcttgttacaaagataataaagtaagtactcattaccccataaaatgcagagtgtcctaagttaccaaagcaaaacgaagcacgagaaataagctgcttccccgtgagcttatggctatgtgtcatatttataacctccaaactacagctttctgtaatcgcttacaaatatattataattctttagctgatttgagtaaacatttatttaaaaagtaaattcattactagcgaagatataaaaaagtagctaatccgtgaatcgctgatacgaatactgattagctacttattttctttgggaaagcttttacgaaaaacaatattggtatttactgtcagatgaacgtgcggacgctggggatgggttattaaatcttggagaaggttaatcgccatccgactaagcgtttcttggttgatattgtatgacgttaacggcggtgaaacatacttagcaactttactgttattgatgctaatcacgacagtatcacgtggcacaattacccctgcttcattaaaagcctggagaacaccaacacttaacgtatcagaggcaataataaaggcttctggtaaattaccaccgctttgttcaagaacccgtttaccaagttgataaccgtttttaacattaaatggtccgtccacatataatggcgcttcttttatcccttgcatccctgtaaattcacgaaaggcgatttcacgggcatcagcttgttggacgttattgagattaagtccttttccaccaatgaaaccgattcgttcataacctgctttggcgaggcgatggagagcatcctgaatcgttaattcaaggttaggttgaacggaatcaaataattgtggcatcggatttatatcaacaaaaactccatgtggtaagtattgatgaagttcgataagctggtcctgcgttacccggtccgcacccacgccaataaatccttggaacgaatcagccgccgcaattaaatctttgatattactaaagatttcaacttgcgctcccgcctcatcgacttctttaataattgcattgcgcaaaaacgcaaaatattcatcttgcagttgttctttaccgcttacccgatacaataatgcgaggttaggacggattggttgctgctgagagtttttcttgtggttgttccaatagccaagctcgttagccaccgtcatgatcttattgcgggtgcttggactgatcgataaattttggtcattattcaaaaggcgcgataccgttgctggtgaatatcctgatttttccgcaatttctttaattgtcgccatcattttcacctcttttagtaatgggtttagtaaatattatacactagtttgaagatagagatgataattcaatctactaattttattcttaattattttcccttgtttatttcccttaaaatgatcataattaagaggacgagatttattgatgaggagatttacattatgaataaagtttctaagggcccttgtactcgctcttgccggtattactgttggaactagtactggacttagcactaccctttttcaatcaaccagtgttgcctatgctgctgagatgacaaaggaaaaaatgatttagctaatcgttatattgctgattatttaggcaactgtcaacagtatgagcagaatgataaaacattcaaaggcttttcttcaatcaaggatattacctattcgcgagacaataagattaaaattgacgttaatgatgacatttatcaattgcctaaagcacgtcgttcacttttgattcaagatttgcaaaacggtgtgtacggcacattagcagacaacgaccttaagaagttatctgaaaaagacattcaaaagggctgtccaactactgtttacttgaatggaaaagtaattggccacactgccaagaatgataaccaccacattatttgggataaataacaaaataagagatttgggacaaagctggtgttccaaatctcttattttcatttaaagatcaatttctagaataattggcgtatgatcgcggcgttctccactatcgatcattcccgcttctgtaatcttatcagcaagccggtcactgactaaccagtaatcaatccgccagccagagttattttgtttgctggtaattacccgttgtgcccaccaagaataaactcccttttcgtcggggtggaggtgacggaaactatcagtaaagccagcagctaatagttttgagaaatgcgtacgttcttcatcagtaaatccagctgaatgatggttggttgctggatgagctaaatcaatctcttcatgagccacattaaaatcaccactagcaattaccggtttttgctggtcaagttcatgcaggtagtctcggtaacaatcatcccacgtttgccgctcatctaaccgtttaagcccattgccggaatttggtgtatacacttccgtaacatagaagtccggaaattcaagggtaatgattcttccttcatcatccattggttctggcgcattaattttaggataagttactttcggctcatattgggctaaataaaggtacatggtcccagcataccctttccgtgctggctcaacggaacttcgccatgccacttcataattggggaataattcttgtaaaaccgttaaatgcttcttagttggcccattctttgacaacttggtctcttgaatggcgatgacatctggcttcatcgctgcaatcttttttaatacttcccgcgtttcccctgcccgtacggaagttccagttagtgctgcattaattgaatcaatgttccacgaaataaatttcacagctatttctcctttttatttcttgatttaaggtcgctttctttgatgaataccccatcggcagttgtcttacccgttcgctttgcaatttcttgataagctgcggtaagtgcttgttgatggtcaacacccactaatttacaaaagattagcaatgcaatctgtaagtccccgatgctatcgataagcttagtccgattttccttattatacgcactcgaaagttcgccgagctcttcagccatcttcataaattcgacacgtggatccgcgtggtcaatcccacgttcatgcgcccacttatcaattttttgaaatagctcctcgtaattcatcaaatgtcacctcatcaagtgataattctagtcttaactataaaataaaagaactagctacgcaataagaaaatttcacgtaagccttcttaacagtatttatcaatcaccgctgttataattattgctaagggaaggaagtgaaagaaatggacttaaccaattatcgaatcgatcctgctaagtttgctttagcttgcgtgcaaagttcacctgatcttaccactgaagacaaattaagggtttacaaggaagtatatgaagaagcgcttactttctatcaccaaattcaaacagccgttattaataaaggtcgttcaaaggaagatcgcagccttaaggaaatgggagactttttcgatttaaagaactaaaccaatcaccgaaatcactacctatcaaaatctcccgtactacattgatggtgaactactcggccataaatgaccgagcttctgggaacacgaagtagtatttaggatattacacaagtattcttgctacctaacttacagaactccgttcttttaccaaggctagttcctagccaacggcttttaatcctttttgcaagatgttaactgccgcattaacatctcggtcgtggtgaacgccacactttggacaagtccattcgcgaacttcaagtggcttcttgccactgttaaagccacaatgcgaacagatttgactggtatagtttggtttcaccaagactagttgtttgccataccaagcacacttgtattccagcatcgtccggaactgataccaactagcgttagcgatcgacttcgctaagtggtgattcttttggagattcttggctttcaaatcctcaataacaatcacgtcgtactgcttaactagagccgtcgttagcttgtggaggtaatccttgcgcttgttggcaattcgttgttgataatgggctttaacaagtcgggcgcgttgccagttctgataatcattgagtgctaacttggtatcttggtggttgtgattccattggcgaacggcaacggttgcccggtggcgccgcttgctgaatttactttgccacttcgttacttgatgttctaacaatttagcgttgaaggtaccgtacttgacaccatcagaactaatcgcaaggtcggccaggcctacgtcaagcccgaccatttgccccgttttcggtaaccgttcaacggttgtttcaacttgcagggagaggtagtaacgacccgtcgggtcataactgaccgtataacgcttaattttggcctcaccaataagagtcgttttactcgtgcgtatacttccgagttttggtaattgtaaccgccgcttggcaagtaccttgcacgttgatcggccagtgtaggcctgataggccacatggcggctcttaaagcggggatagccaccttggtgcttaaacaatcgtttaaaggcctcggtaagattatggttcaccactaggaaactggtggaatcactttccttgagaaagggatattcacgcttgagctgtttcaagaggtagttcataccatactcattgacgaagtggctactgggattgttttggtaacgctccttagccatactgagcatttggttccaaacgaagcggtcattaccaaacatttgccataactgatcccgttgggattggttagggtacaagcgaagtttgatccctttaatgaccttgttcattctagttccacctcctttttccgttgatcatcaatgtacttggcaacggcttgttcattaacggccccaatactttcaacatagtaactgggcgaccacaagtgacggccctcctttttccaatagcttcgctgtaattccggacattcccgaaatagctgataggcagtaccgcctttcagccaacgaacaatattcgtcaccgataatttgggtggtgcactcactaacaagtgcacatggtcgtccttcccaatttccatgtgggcaatttcaaagccatatttagcggcgatctcatggataatccgtttgaaggcgatctcgacccgaccggtaaggactttgtttcggtatttggttccccaaataatgtggtaattaaggttgtagaccgatgttcggccatatgtaagtctgtttgtatctttcataccaacgattataccataattcacgtttcccatatacgcccgtcgggcgtaaaaaaggggggcaattcatcacgtccttaaaagaacgtgtttccttgccccttttcaaaaatgttttttaaaattaatttactttgactagggactgtgacataagttaagttactttcataaaaagcaaatacgcagtacaacgatggcctctaacgtccggcaaaaccgatcgttagaggcctattgttgcttgcgggggctcccagaggctagcttcgcgtcgaaaaacgaagtcacaagtgacttttgtctcgctcccctttcctacgattagtcaagaaaaatatttagaaaagaagagtatactaaaccaaccctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgcaaatttatgaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggccctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccatactaaaccaactcggttcttcttcaaaaatcgagaattagtggtatattaaaattgtgaggtgattatgccttcacagggaccattgagtccgtataccgatagtagtatttttcatggtgcttaatcatggataagagacatttcagagttttattcatacaagctaccatggcgaccttgttcagttttggatgaggtcgtttttcttttaaacgatagtaatagtcaacgatatgattagaattagcgtgttgttggcggatcatattacctacagtaaaatataagagcttacgggcaatcgggtttccacgcttattaatgtgatcttgacctaaataggttccagattggtaacgacgaatatcaattccgacaaaggcattaagctgattggcattgtcaaagcgactaatgtcgcccaattctcccattaactgagccgcagtttgtttcccaattcccggaaaagagcagtataggatatactctggtaagcgctgggcaatagattccatccgcttgataacctcttcccttttacgggttaaggcaattaattggcgagcatagtagcgaacttcatcaacctgaatggcatcaccagaaacgccggatatgatttttgggcgagatcgattaatcgatcggcatacttataagctttcatcttagatattcgtttatctgtagatgccattagaatattctttaatttaactctcgaataaggcctaactagtgctgaatgaggaaaaagctccacgatattcaacgctaatttagatgttctatttacaaataattgcttaagttctggaaaaacttgttcaagtgcagtatgaagatgatttagacgatagttccaatcagcattgagctgattatagaaccgactaagctcatgtaactgaagatagtcttttttccaaggaactgttaatcgaaaagcattttcctggacagtgagcgcaatccgatgagcgtctttctgatcggtcttaactcgtcgtagactctcggactttaaatgaagttctagtggattaagacggcaaaagcggagaccattggtctcacagaaatgttcaattactcgcgaataaattccagtcgcttcaaagtagataattggcttctgagctttcttaatcatatctcgtagagcattaaaccccgctttcgtgtgtactaaagaaaactcctttaaacagtgtttccctcgataccagacacagtagcttttccccattgaaacatccaaggcaaatatatcagccataaaaagacttcctttctataaatagagctagatataaccgctatcctagatttgtacttcatttcctaaatactcgaactcgtagtttcacaacctaaaagcaaaatatcaaatcaaagatagcggagatcattttataatacggactcgaagtccctgggagcatgatcgatcttagctctatcttcagaataatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacacaaaagagtccaggacaataattatttttgtcctgaactaatcttaggttgtttaatttaaaacaaaaaaagaacccttgatacataagggttctgcactactagttgtcgcgacgacgttcagcgatacgagtagccttaccagtacgttcacggatttgctaagctgtttcatctgctattcatgaagtattcacagactattcaattagttaatttaaataggtagaaactcattaactagtcatgaagtattcataaactactcacaaaaaaactaccaactacctaccagataattaacggcatctcttaatgaggtgtcgttttatccataaatttgcgagaataccccaacttcgacaagtgggggatgaatcgccctctgatatgatataattcaactaattaaactggttctaatgcatcgaaaataaagctgttaacattgcttcaccatgaggacactgagtaatttcgtatagagtaacttcgagtttgtgctgagacaacgccacgagttgcaatcaggctaaaaatagctggcgaaaaccaagccagtatgtattttgaacacgtacttaggcggtagtccgatgaaactactaggcccgggacgggccttggtcaatagtcgtaacctctgctcgaaagttcacttagaaccggtagagtaagtatgcgatgttcccagaatctcccacttcaagcattaaaccgtaggtttagctaagtgggagtagttcaatttcattataactccgatataattttcgcgctaattctatattaaatttaaaacaaaaaaggatgccgattaaggcaccctgtttaccggtacggattaagtaacgaactgaatccattttgcatgccggtacttctcatctgatgtgtatattatagcataaataaattatggtacaatactattgcgtgtcgggagtaacgacccaaacttacgcgcaaaaggggtgaattcccctatgaagtttgtacttctcattctgatcgtgccgaacgggctcgttaagcaactactacattctgtaagggttgcaatcaaaaaggctctcaaacacctaattgaggaactacttggttaaactccatttaattccaaaaggaggtgggcgagatgctatttcagcggtggtaattcgtttactatcgctgtttttattatatatcaaaaaagccctagcagtaattgcatttaaaagcttgcaactactactaggatttttttctacttatttaaatgtgccaaatggttggttattatttgcatcacggcaaacaagataaccatattgattatttggacgtggttgacgtaaccacacgtaaccatcgtgacgagaccatgcatcatacttaatctcactattagctggcaatgtagcaattaaggcactatttgtcttagcgccccagcgtaagttaattgctgtaccagtaataaaagtacctttctcagcaaaccaacgatcacccatatcatcaacccagtgattggatggaagctcagttgtaatagctggcgtttcctgctcaattggtttatttggttctggcttcggtgcttcacttggattaaagagtttaatagcattgtcagttaatgtaatagaaccatcaacattgtatccaagcagattatctgtgtgttgccacatatcaacataatttgctgatgggaagtaattgaagtcaggattctttccggctgctttcccattagctaatggatatgccgctaaccagaacatatccatatttggatgaattgcttctaaattaaagttaggcagtaagtacttgtaagtatagaacccagtgtggaaaccagcgttccgaacagtattaaggaatgcaatcactgatgatgttggcatgttagagatttcagcatctaaaatcattaacgtaccaggttgtacattagcttgtgcctttgagttagcaataaagtagtttgcttcggccaccgcttgcgcatcattatggaaacgaccaaagtgatagaaagcaaaccctttaattccaccgccagcacttcgatcaatcaaagaacgaatgtatgggttaacataattaatactttcagttgtcttgataatcgcataatcagcgccaatagccttataatcatcaactgttaaatgactttgaaaacttgcaaggtcaattactgttttacgttctgtcatattatttttcctccttatttcctttataatcaccggttatcttatgaaaatcagctggattgtagtcatcttgagccttagcgacattaagtactttggctaacgagtcaatgattggtgacaaccacggaacttgtatgtccatctgatttaaattttcgacaattgataccaagtattgatagcagaatgtcaataccattacttgtgcaacataatcaaaaccgattgaaattagatatggataaaaagcaagcactccaatcataaggataaaattctttgccaatccatatgtccctttggtcgaatttgttcgagtagctgtgtgattgctacgtaagcctttggcaatccccgatccaatatcaaataacacaagcaaagtaaatccaactattaatggatcgtcaatttgcttggctgcttgatgtaatgctacttcatgataaggtagtgccattaataataagtgcattaaatttcgttcccattccctttctaaatgccgcccataagaaaagccctgaattcggtattctttaaacactaaattctagggcttatttatgtattgtttatttccgaaaggcgacaagtgcctttaactattcatttgttttatctgctgtcttatcagcagaattggcgatttcatcctgtgcattatataccaagttttgaaaatcttgagtatcttttcgtactaccttcttgttagcatcgtacaactctttattggtgatgaaggtattaaaagtatcattaccagcatcgtcatcaaatacatttgcagtaaagttagcgattacttgaccatttactgtggactttcctgttaaggtgattgattttgttgattctaacataattacttatctcctttttcatcgttttgcttcttaagttcttctaattgtgatttcaattgactattttcttgttccaattgagtagcttttgcttcccatgaggcagctgtgtaattagcaaccgccaatttttggttaagactttgagctactaagttcatatcaatattgttcattattaaaaactcctttaactattttcattcgatcattttcgtaccccttacgcttagctttgatttcccaagcaaaatgaatattagggttgctagatttaactgtaaaattatttgctgaacgtgaagaaacccacacgtttccattgccatatggcgttagaaacacttggtatggcaccaatgtattaactgtttctaagaaataaggatcaatcatgacagtaactacaccattactattagtttgtgtttctccaatatcgccaaaataatattcggcggtttcataggcgttaatggctgccatccctcgcgatgttggtacaacggcattttttgaaccagtaacagtaaaattcccactaacattaaaatcactattaaccccaggaaataatccatttaacgataagatacttttaccattagctgtaatattaattgctccatcactattaatagaaaaataatttttcccatttaagcttcctacattaacaaattcatcttgtaatgttattcccccagaaaagccactcgatggtccttgaaagaaatattgtgagaaagtaccttttaaaactgtttgaccattttgatatgttccatccaacactaaattaggtattgtttttaagttattattttgaattggttcaccagcataaagaaaaagttgcttttttgcagcgatatttataaagccatcgcttttaccggcaataccagcaccaataatttcattcccatttaaataagataatgtttgatcgttccagccatgagttctaagtagaaatccatccttaccttctatatctaaacctgatgttccaaaaaatacaatgttatcactcttagtaatacttccataatctggatctaaaacagcatctgaaagagattggcttttgtgaagatacaagcctccatcaaaaaggtaagctccacttgaattaccataagcgctaatagaccctcttgaaatccaaacattattaccttgattgtcataatcatgaattccgtttttatctatccaggcattatgatcaccttgccaaacgtgaagtgctccgctatctaaataaaattcaccattgctacctcttaatgtcccggcagtaatgttatttgcattcaggttgatgacattgatccgaccggcatctagtgttccagcagtaatcttgtcagccgaaatgttagttatagccgcatcggggataaatgctttaccagaaaaaatagttgaactggcgtccatgtatatcttgtcattttgaattaaggtggtgccggctgacatgttgatttgagccataatatttccgccagttacggttcgttgccaactggtccaattatctccaattagtaatctcgtatagatttcattttcattgttgtctcgttgccaagtctgcttaatccgttttacatctggataagctaccacttgaagataagcccacgccgatgaatcaggagtattgctattaggtactgcttgaatccaatagttaccagtcgttttgtaattattagcatcaattgcagatgtaaccttttgccaggctgtttctttgcgtaaggaattcagcgacacattaaagttattagcctgctgatttatttgtgtctgcagaccacctgttttgtcagatacttcttgacgaatggccttagctgtctgactgatttgcgattgaaggtcactgtgattacttgaaactgtcgattgaaggccttgtaatgttcggttcaactcactatattctgaataactagctgatctttgccactgagtccatgaatcactaaatttagttcgtacataccttaatgttggatcactatcagcctgccaagtttgtacaattcgaccatcattaacccgctctacttttaggtagcaccaattagttccaggtacgttaatgttatctgttgactgaataaaataatttccagtattcgtgtaatcatttgcattaattgcattattgactacttgcacattggttagatgctcaagactaccaactcggccaattacactattaaggctattagctgttgatgtggttttattgtcaacgccatttattcgatcgttaagttcggtccggacagcagaagcgctttggctaatttgcgtttgaagttgcccgtagttgccactaacagttgagcgtagaccttcaagcgactgggatagttcagcaaaagctattgtgttgtcagatggagctggagaccaaggtgtggctactgagccacgttctagtttataagatccaacactaaaatttggtttaacatttggttgagtaacaaatatctttacgtcttcggtttgattcaatgtgaaaggatatgaatatctcttccagatagtcccatagttttctgtttcaatatttacgatagctgagttgtctttttgacgctgaacaattacttgcattggcccttcagcatcacccttagcattccagctaaacgtatacgttccaggctctagatgcttcttcgccatgtattgtgtccacgcataattagtgataaagaatttattgccactgctatctttttgcaaattatctgaaagagacaatctaccatcacgatcccaattatcaccactaaaatctgctgttccagttaataaattaactccaccaccactaaacattggaatggtagtttgctgaactttttgaagaaatccatcagccgtctgcagaaagcctgaattagtaagaatattacttaatccttgccagttaccatcattgcgaatggtattgattgcatcattcttagcagagttagtccggttatccgtttcggatttggtgtagtagctactaaactgttggctagttgcattaatccgtgatgatagctcagttagactgtgttcagtgtcttctggagctggcacccaatttgatggtgtactacttttttctaccattaaattacgatattcgaatgcccctggttgtggattagtccaaattgtcggtctaactattgttgtgccttcacgaaccttgtacgtaaagcttaaataaccatgtcctccagctggaatgcttttaccgccccatgccgtattatcagttccgttaaccctgtcataaaagccgacttgaatagttccagaaccattacgaacctctgcgctaattgttaaggcatcaccaactgaccacttgctaggatccagaggccagttaggtccccaagaattatctacttttgtccaattattactagtaccgggtactaagtttcttccaccaatcttcaaattattcagccgatcggtaacgctattcatatcaacacgtaagccgttagcagtagcttcaacatcaacagtttttgcataaccatttaagtcgctagccgttaactttgcagctaaagcttgattggttagattaacgaaatttgtataagtcgaattgtcaaccttacctgcaagcaagccctgcatgtgttgagcgtcaatcttgagttggttaatatcgccattggcagtgccaagagtggtttgcaatcctttgacatcaatcttagtggtattaacatcgcctgctaaattagcataattgatgtttaaccctttaaccgtgttagacacatcagcaatatctttaccttgttgttgtgcttgtttagttaaatcagcaattgaattttgagcagagatgtatttctgcaaagcatcagcaacatcattagtcactttagttaagtcaggaacaatgttgttatcgtactggccttgcagattagttaccgaatcgtttagcttttgcaagctttcatcggcaatttttttattgtcctcaatcgatttgttgagattctcaacatcggcatcagctttttgcttgttattgataatatctgctttggcttggttaagcccttgttgagcgtccgcaacctttttctttatctcgtcatcagataaatctttacgaatccatttaccggacccatcatcctgcttttcaaatatccaaagttcggttgaattaccatttttcttaaaccacacgtcattaaacttagcattagttggtggcgcagttacacttggtggaaatacaactgtcccgtctggtaatcttctaagttgtaattccttgattgtttgagtaacgctaccttgccaagagaccatttgatcagaagaagttgtctgatcagcttttgaagttgcagaaagcccaccattaaaatcaagtgtgtaactactgtttgggacaacaaaagaattcccctgtttatcttctagtcgtagccaatcccccgcttcaacagcaggattaccaaaccaattcagactgaacgggtaaaaagttatgtctttcaattgctcccaaatatcattgagccgttgtggagtcatgatattattttcgagtttaatctgagaaccagtagcatctccagcttgataattcttggtttcttctgtactctcaccatcacgagttttagtagtaatagtgacttggcattgaataccattaatcttataggcagcttcattcttcgttagtcctgcttgttcatattgactaggatctaattcatagtttggttcagaaattgtccgaatagtaaacaatccttgtcgatcaaacagagcataaccaacatacaattgagcaatccaaccaagtgctttgcggtaactttgaccagtgatcggagctgacaaatctgcttggtgcggaagacgtgctaaatcatcagtattagccttaacacctgattgagcacagatctccgcaatgacatctaatactttagctgggtacgttagtttagatacataagttccctctaagccacagaaacgatcactagcactaacagtcgtaagattattatttcggtccatcttgatttcactggagataataaaaacgcccaacggttcataaacataaccgctagatgtttttattccaatgctaggatgaacctccattcccagcttcaatccctcaataaggtgagagaattcaatctgaactgtatttgaatacgtagacccaattgcaaacgtatcaccattgtaagctcctgaatcgtacttcaaactattaatatcagttgcaccatatgttttaccatcaatcgtaactttaatatccaaagttcgctgtgaagctcgccaagcatctcgagtttcttttgattgtgttaacactaattaatcacctccttattgctcaatcagatcaaaagataaacctttccaaactggtaaagatcctacaaatgaataaacgggcgctgtccgatcaccaacataaaacgtccccgatcgaacttgcccgtctactggatctaaatactcaacattaaagaattcagccttaacagaatctaaaatctttgcgcactctgctactgttaaagcaccaaaagttaatgttatttttcttttagttgcaactcgatcacgatgtaaaagtccttgcgcatcacgggtcgcctttgcatcaatatcttgaatagcaacctgcattgtttgtggggcaggattaaccactgtcccagaaatttttagagaatacaagcatccatctcctccttaaatatttaacatatttcgaccattcttttgatttaccgcgttaattcctttgatagcatgttcgccaaatgactcatcaccaatcttaacggttaagtgtaagtcaactggttgattactgttgttagtagtattttgcatttgtaatgcttgaacgatggcatttactaggtcggtactcatttctttgaatccgccgttttgcattgttgcatcattatttgatgaagattcagcatacatagaatttgaagtaattgcattatttgagagaactgttggaagttgtaaccctccgccaaaattccgattcataaatgcaatcgcttcgttaatccgttgcatacctaattcacgattcattagtgggataaccatttcaggcttatcaccttcaccaatttcatagaagccgtgcttagaaattaagccaccatcttcataaccgtgtccgtgaccaataactgccaacattgaagaaccgtaacgatgcttagcgtaattaatagcggcaagcatgttatcgtaacccttcatgatgttgtgatgaccagggaaagcataagcattaaatgttcctggctttgtttgtaaaagaccagttgcgtttccgtcagctaaaccatcgttaccaccaatagcacgttcgttaccgcctgattcagtttgaatttggcgaacccaagcatttacataatcagcactggcaggtaagccgttcttgcgcaatgctttcttaacagcactacgccaaccttccgcacctggtccggtttgatgagttgcaccaccgaattggtcaatcaccttccgtgcccagttcatcatgccttttttctcttcgttaactgcacctttggcgagttttagtggtacctcgcctgctccccaatcataggtcacaaacttatcgacaatatagttaacgagtttttcgggatgggcaatgtcatctgtaacgttttcgagttcatccattgcagcatcaaagaatccaccaataccgctaaaaaggccgccaaagtttaaactgctaagtgctcgactaattccactaaagtcaaaattaaagctaccaatcccaccagcatatttaggaaccatgtttgctaattcgttagcggtatcagttgcagttttgaccttagtaccagccggcagataagttaagaaattacgtttagcagggaatagtccttgctcaccattagggagttcataactttctcggtaaatatcaccatcttggtcattaactaatgctaatccacctggatgattttgtgtccctgttttgtaggcgttccagttaaagtaaccccaaccaacagaaccaccgccaagcttccctaatacccagttaattccttcgcggattttatcggttgctttttgaacaggtctaaccattgcatcaacaacacgactaatagcattcctaatgctttgcaaaccactagtaataccattaccaatagtgctacctagtcctccagcccaagaacctaacgtccttgaagtgccgtctctaaaacttgaaacccaacttcctaaacgctcaccagcatttttagcagcgttataggcaccactaataccattgcctacgtgaccgcctaaattaccagcccaattatgaatgctactattggcatcattaaagaaacttctggtccattcagataatttattaccagcattaacagaacctgagcgtgaagattcagagccgttattaatatggtcacctaagcgttcagcccattggcgtacaagaccactagcagattctctaaagtctgttgtccaagatttgagtttctcaccagcatttttggccattgattgaccattttcaacactgtcgttgatgttagagccaatttgtgatgaccaactatggaccttttccttggcattaccaatgaaatctgttgtccagtccttgatcttactaccagcctgcttggcaaatttcttacccttttccacatccgtattgatatttgaaccaatcttttgcgcccaggatttaatatttttcttggcatcagcaacgaatccagtagtccaagatttaagcttattgctaccagcaattgcaagcttcttactcttttctacatctttattaaagttggttccgataccagaagcccactttttcaaggtcttcttagtgccatcaataaatccggttgtccacttaccaagatttgaactagctttttgaacatctttcttacctttagtgatattcgtattgatgtctttaccaacagacttagcccatgatgtaaagttatctaagatttcatgggacttaaagccaatcgcttcaacccagtctttaggttttttacctttgccatacttagaccaaccatcgctaaacttagcagcaccagtaccgccccatttaccgataaatgagcctatttgttgtccaatcgcagcacctaatggtccgccaaagaataagccgataccaccaccaatggcaccaccaattcctgaaccgaagctcttgaacttaatttctttgttctttgctttgatacctttgtaaatatcaattccagaagttacagcaatcatagcggttgatagaccgatacctaatttttgcccgagcttcatcggttcgccagctttaatagaagacttagccgatttaagaaagtcagttttagcgaggttagtattttgccacttcttgttaacttcgttccataaatctttaagcttaccgacaccggtcttaaaattatcaaacttaattttagctagttcttgaattttagtaattgggtgtttactaaaatcaatcaccgttcccagtaagtcatcagcatacttagcaccattcttaagcttatcaaaactaagcattgtaactattttaagggtatcggtaaagtccttaatacttgaaatagttttacctgcaactttaagactgaacagtgtcattaaagtagtagtcattactttaactgctgtttggtgatgatcgatccaatcagataagaggtttaatgcacctgttagtaatttcaatgcaccaacaatggcaaaacctgtaatctttgctaacggtttaaggaaaccattaaagaaccattcaaaaattggttcagcagctttaatcacactgtgaacaaccttcaatgcagctgctaatagattgaagaagtctggaagtagtttagtaatagtaaatccggctagaggtaacaggacattcttgtaggcccatgccaaaccgtcccaaacatctttagtaactggacgaatagcttttagcaaagtgtcaattgattgcaacagcggtgtaaagtcaagcttcttagcccaattggcagtgtaagttgccatatcaccaagagcacctaacatatcatcaaccatacctaagagcgtcttaaagattgatgttccaacatcaccatgtttccaagccttgtcgaattggtccgctaaattgccaattgtattaccaatgcctgtaacaatttcaataagatggctccagattgaaacacctaattttgagtgattccatgcttcatcaatggatccaaccatatccttaaaaattctaagtatattattaagcgcattaagccaagcttgccatagtcttgtaccgttattgccgtgttgccatgcttcatcaaaggctttagcaatatcaccaatgaatttaactaggttagtagccaaatctaagagattagcaaaaatccttttaccaagatcaccagtattccatgcttcacggaatgattcagctatgtgatggatagcaacaagaatattattcagtgaatcaaagatagtctgaataaaccttgttcctcgtccaccttcttcccatgcttcggcaaatgccctcgcaatgtcgccaataatattcagcatatctgctagcagttgaagcaagttctccattactttttgcccggtaccgttgtcccagacatgtaagaatgaattccctacatcacctaataagcgtttaatttctttccatgaatacttagcggcgtcaacaactgcttgacctttttcatcccaggcttttttcattggatcaaagatttcacctaaaacctttttaaccttattagctgcatcaatcgcattttgagaagcctctaacgggacattccagtcaaggcctggatcgccttcatcacctgctccaccatcatcaataccaggatcatcaaagactggtgtatcttgcttttgctgtggagtaaacttctctagtggttgagcttcaaaggtgccattatcttggttattcttgttattatcaagaacattaagttcatcaaagcccatcaaagaagcttggaggtcttcgtttgccttcttagtatcttcaaaagctttcttcgcttgctcattagaagctttaatccgttcgttttcagcagcaacagcagcagcaccttgacgattagcttctgcaatctgctgattagctcgttgcacagccttagcttgttcttgctgttgtttcttaactgcatcgttggctttgcttgccgccttagaagtatcgttcatcgcccgtacttgactatataagccctgagcaccacttctagcaccagacaggctcattccagttaaagcagaagtaaactgagcaagccaaccagttgcttttttaagagcattcatcaacgagttaatagctggcaaaacaaagctataaattggataaaaagcagttaacaagttgaccttaattgcgttaaagctgcttgcaaactgcttattagtcattaatgctgaacccataccttgagctaacatcatgattccttgatacaacaatgtaaatacgattaactgactagctaacatactcattgccatctttacgccttttaatcgctcacttagcattgaagcacttgtaccagccttgcgcattgaagaactaccactatcacccatgcgcctaaatgacgaggtgacgtttgaaatagtatttcgtaaccgattaagccttgaacttatatttgatgcggtgttaccttcttgagctagtgtagtgttcactcttgaagatgcgtttcgtaattcatctccacgagaactaacgtaactataagccttagctaattcattgcttcgatttataagacgtttatactctgtttcggcttctttgagtcctttattattaccagatgatctaccaagaacagcatcttgtgctttggtttccgcaatagtacgcctaatccgttcaatctttgcttccgtttgatccatctcacgttcaatacgcttgagtgaatttggaatagtattaagctcttgcgacatttcttgtgcaagggctttggcttgattctgataacgttccatcttgacttgtgcattagcaatctggtcatcaagtcgcattgctctaacctgactgccttgtttgttcatatcaaggttatctctgctagccatcaatgttgctattctacgttgcattgattgcgcctgttgcattttctcgttgatgtgggatacaagcccatcaatttcctttttagctcgggaaacttccgcttgaatttcatcatcaattcctaaatcaaccggccttttaggcatatagctctgaattcttttttcttggtagtcatcgaagcttgagttttttattcttggtctaggcttttctttaggacgtacttcttgttgagcttgtttaacaggaatatcacctacagtttcacgagctaccttagtttgttgagcaattcgttgttgcatgttagatgcttcttgtaaacgagcagtcaaactatccaggcttttttctgattcgttaacggcttctttggaactttcggcttgagccttgtttccttcgataatcctattagttgcatcattctgcacactagccgtacgctcaatagatttttgcttagagttttcagcctcttcacgttgacgaacttcttctttggctttctcatttgctttagaagcgttatcgttcatattttgctgaatacgatccaagttactttgaattttagcttgcatatcgttagtcttttgaccgatgagactagtcaactcatccattttctggagtacatctccataattagcccgaaaccttaactcaagttcttccaagtccattactattcacctcctcctttatctttattaaattgtctaatccgttgagcttgttgcataagaatagcttgatctcttttccaatcgggttctttttcagacatttgctctatctggttcatatcatccttaacaaacggataagcttcttctaacttaggcatcttagcaggatcattaaccgcaaatgctaccaattcacttaaacggtgatccatatatgctttggcacgtaaatcatttaattctcgcttcctgttagcggcaatttgcgtcatgatttccgcaaagtctaaatcccagaaatgatcagcgtctattcctgattcaacagcgattgggtaaagatctttgaataaatctgatactgtatcgtaatttttttcgtttacagcaactgatcttgggtcgcttccactggatctaatgtcacttcgcccgattccgaattggtcttcgatgacttcttctttttgccgaaaaaaccagacgcttcaaatagttccattaaggcattaaagagatccatcgtggtattaccatcatctaagtacttttcaaaggcgttcaatactcgtttatcagttacgccatgattttgattagcgccttgtaatacgatcaggatttcattaactggaggtagcttatttccaccttgagagtccataaataaggacaacatagacttgccaagtcgccgttcaatcttaaatacctcacgaccgccaagctttaagtcaagttccaaatcacctaattgcattgtctttgttgctttcttaacagtagttgtcatatgaataaattctcctttaatttttatttgtcactaaagataaacgtgggaatcgaacccacgtttattaataaactagccttttggtgtatcactacctggtgcagcagtgaagtgtggaccatcagatacagtaatagtaattgtgtaacctaatgccccgttaactgcaaccgctgcaaacttgatgttgtatgaaccacgcattgtagcagtcattccatctgggtaagtaactttccattggtattgtttccgatcaccggcttgttttagggctttagcaaaactagcacctttatatacagcttggaactgaacgttagaagcattttgaatcccttcaacttgcttccgccggtcatcagccaaagtagtgacatcaaccttttcagtgtcaccacctaattcgggaatagtcttgatatctgcaatttcttcccacgttgatccatcttctgaacgttcaagcttggtaccagtaccaaccagaccttctgaactatcgatagcaaaacgttgtaggtctaactttaatgcgtcactatataattttacattcttcataatttcatcctttctggtatacacgtttacttgtgttatctacaattcctgtaaagacaagtacaacacgtgttattccattcaaatcttgatcaccaatgttattagaaaagcccattgccgaaaacttagcaatgagcttattttttatttgcgttaaagaacctttatcattgtacaaatcaattgttatcttccattctgtatcagtctcttcttggtaggcattacgtatataagaagactgagttgttgaatagatagcaattggaaatgccgtgaatttatcaggataagacggcgagacaatctttaattctggaatagacttcaacgtcttatataccagtgctttaacattgtagatttccatttaaccacctaatttatcacgaagctcttggtcaactgatttctttataatcccaggtgcttccttagctattctgttagcagaaggtgtcataaattgtcttgctggttggccgttggttcgataaaaatacttgtccttaatcttaacctttggaattccatagatttttgtaaggtcaatatcaacttcctcagctggaatgtaccagggagtttggcgataaacaattgccacattaggtggaagctgcttactagattgttcaccaaccttaccagtaccaaactcacggaaaatagcgatcattgacgaattccaccaacgaccaactatttcatccccatcgacttttacttcatgcttaaagctacgggcaagttcaccagtagaatatttgatactagattgcaactcttggactgcataggcttcggcttgttcaattgctgtctcttggccgttaacagttgcatctgctacaacttgaggaagttttcgtagcttagtttttaactcattgagccccacaatctcacattcaatcattttgctcatccctcttgatacgttctaaagtaacgtttttatgagtagaaaactcttgaatagccgtaatcttataatcaggatcactagaactcggaacttttaggcaaataccaaagccttcgccgtgcccttctgaaagtaaattgccttgatacttacatgtcttaatatatttaatatcttttccataaatttgcgcattgaccgtaccaccagctgattgaacattcatcctgattggttgtggatcaccccagccagaaatgctatagccttcatcatcttgagtattcattggttctttaagataaacggttgtaagatcactttcttttaatctcatagcttcgtcaccttagcaattcgatagcggtttaatccttgtcgaatatcttttggaataccagtctcgagataattagttactccaccttccgagcgttgtgtttcgccttcaagtcccagtcggttgtagttaatgactgccaactttttaacatacacactcatgttaccaactaattctttttgacccgtataatctagcacctgagcatttgcttcttctactagctccttaattaattcatcatccgtaacttttaaacgagcacttacggatggaaccatttcggccacttgatccacattcagcacctccaattaattaaaggactttagcttggtatacattatcagcactagcaaatgatggaagcatggttgccgctgctaatacccaagttccaattggatcttcaccagattcataaatcttagccataacattaccaacttctgatacttgcgcattagttgagatcaaacggttttcttctggagttgggccatagatcttttcacctggcacttcatcattaaagagaacgatccgatcttccgggaagtatgtttgtgttttaactttacccttagcgtcttcctcacgatacttaccagcatatgcacgaataaccggaagtccttgagcaaccatgaattgatctaaatcagcttgaccaacaacccgaccggtatctttaccaaagattgcttccttgatttcagtactacgcattaatgtccgtaataccttcttagaggtcaatgcacgtgttggggtaatgtcgagcttatcagaccaatcttgtaagttttcaatgattgaagcactaccgctatcccaagtagtattacttgctaatgcagtttgatgctcttttggaacttgataatcaatggaaatcccgttgtccttatcagtaatcttaccagtagcaaacatttccattgtcatcttttcgccacgtgctttcaccgcttgaaccattgcatcaatatcattaaatacatattgctttaagtagttagcttcggcattattacgtggataacgtaacttgattaacatttcttcggtaatttgcatcttgcgctttacatatgctaattcagcagtcatcttacttgcttcacgactaccgatttcggcttcggcatcaaaggctgaatagctagcaattgttggaacacgactaccagcttttaagatatcgacttcgagtgttggaaccttagttgctggaaataaagtatcacctaacatatctggatattgacgattacgagtataatcaagcaccgtattctgatcgaacatatcaagaattggtgtggcaaaacgttgtaaatctagcttaagtgtttgcttattcatctattatctcctcctcactacgcttttggatctgctgtggtagtatctaaatccttaaagtgaattgctgtcattgctttaattgcatctgctgatggagttggagttaatcgttgacttaatacccaaccttcacgcataacagctaccatttgattagaaccatcttctgatacatatacatcattaacagtaataccaaccgcctttgcatcattcgttggatatactgtcccagcaggtacatacttgcgtcctaagtcatcagtttggacattgtaattgtccttgttaattgtttcagggaaagcagtgaacttctcagaagcaaggaagtttaattgcttaccgttttgaaatcgtgtgtacattaattttcattctcctttcttatttccaaaaatcactttcagatttattagcactattagccttttcggcataaagctcaccggccgatttatgagtcaaatcatcatccgtactcttaggtgttcgtgagccttgtgctaatcgagtttcaacggcatcatgaacggcgctacgaaatacttcgcttacccgttcatacgtttcattcatattgtcttcgttagctagaacatcatcaaaaacatcaactaacccagttggcaaaccatcatcaactaaacgagaagcaagcttacttcgattctcacgcttagtaacatcagcttcacgagcagataaagcttcttcccgttgcttgaagtcatcctcacgtcgttcttcttcggtcatgttcttgcgatccttagctttctttgccttatcgctttgttccttttcccagttagccttagcagtccctaatgccttgtctaacttcttatcaaaataagaatccaattctgactgggtctggaacgtcatgaaaggcttattttgcgtatcagaatcatcattagtatccgttgcttcgtttcctgtatcagcacctccttctccatcttgtccttcatctgcaaaccgctgtaagttcagctttagcaaattgctataaaactttactttttccatagatataatcctttctacccatgcacactcgaatttatgactgcacgaaaaaagccactccatatttctacacagtgacttctaaaagtgtgtcttcaagcccacacacgtattcaattattgaagtagtttcatgacgtgcttaggtcaagatttattgttacctagatagattacaggcacagttcgacaaaacggatgcaaaggtggcacattcttaccaataactgcatcagatacgttaaaaactttattattaattgctcgacatatcttactggttcgactatcaagaacagcaattaactgatattgcttaactccccgtttcttccagctatcaagctttaccttagagtaaaaataattagcttcggttctgattaatcgactagcattgaaacgacttgtattaaactcatcttcaatttgcttaatcatttctcgttcagacattccacttaactctttagctgtaaacaattcttgcaagcgttcagcaagcttatcagtgttatcccaaatacgtgatgaaaagtttttaccttcccatctggaatttaatgctgcctccacataacgattaggtagctcagtgattttcgacttcggtacgtcttgttccatcgataccgttgcaatctgcttgtcagtcttagggttcttgataacgattttattttctttagattctaaggctggttttgttttattagagagcttgtaatcttttgctttatcatatacggctccttgcttttcgacttcggaccaggttcttttcattacatcagtatgcaatttaatattctgatccaattcaacgtctccaacatttttagcaactatatacgctttgacttgtaactcttccagtcgggtaattctgctcttagcggctaattgatttaagtaattatcaacagccttcttactttctttatcgacaatattgcttgctaacgcttgtaaggttacaagctcagatggtgagatgtgcgaagacatgatcgttgcaacttcattagcagtaatatcagcataaaaatagcgacgataaatcttttggacctcgtcgcttaaatatgcttgcgctttctggtatgccgtattaataacttttaggcgtttggttgcttcatcctggttctcttgttcatcttgcaagtctcgcaattgccaatagttgaaattgtttttatcaactttcataggctttcacctacaaaacagtgatgtattgaccatattgcttcacaagctgattaactgtattctcaaacgcgtttagcaaagttttatcttcaatgcgttcactatttgtaaatacagccgtcagagttccattctcatcatttacagccacgttagtacaattattaaccgtatgagttagcaaggtagaaaacgaagcacagacgatatcagagccttttacactatactcagcgtgtccgcttgctatgattgtcgtcttgttctgttccttttggatcttcactcgaatcatcttgactatcctccaattctaaacggtctggatcttgtcgctgtaacgcttgctggttctttttgatgttatcagcatcttgttgagccatttcatcaataacttcttgaacatccccaacttgtggaagccaactataagtaatcttgcgcggaagaataccgtcagcattcttaatgttgttaactacatcagacaggttaaccggaatgtttggtgttaacgatatatcacaaccatcaacatccgaattgccacctttaatattaacgatggtttggatcagttttaatcgccggtgcaagccatcgaagaagtaacgcttcttaattgaaataagattttcaagcccaaacagcttaaatttcattgcttcacctgacacatttcccataaacttttcatcgttcatatttggaacgtatgagatcttatgaatatcattttcgatcgattggctgagtagattaacctgtgtttcgtcgaaagttttagttagccattcaacatcagctccatcgtcacgagaaggcgcattaataacaccattctttaatgcttcaatagcatccgtatcctcttctaacacgaagccaaacgtaacaaggattgcatcgacaaaggcttctttatcagaaattcgatcagtttgcaggagattataagcatcaatcaacgagattagttgttcaaagtcaccctgtcgctcttcattatttcgatactcaattaatggaactgcattgaataagttatcgtattcgtcaacgatttgatcatctatcgatacttccattcctacttcagtgcgatattctacaatcttttttggcatgtataccgtgacactataaccatcagtctgtccacttaaattcttctttgcttgaacaaacacgccaaataaaggttcatgttcaaccgtatcatcagtaacaacaattgcggcacgtggatcaacggcttctactcgtaattcagtgttaggagtaatcttttcattgccaagctcatcaatgctaatagttggagcaattgttttaagataaagcaactcatagccatacccaaacacagataagtctttttcaagctcaatatcgtgcttatgaatatcaatcttttctagtgcttctaacacatcatcaatattcttacctttcttggcggtatatttaaccggattcccagtcataaaaccaacattcatatcagtgatgtacttagcatgattaatcataacgttagaagctttaactttagcattctcaaagcgatggttattaacttcttgatttccgttgtaataatcagcaagtttatctagcctgctttgtcgttctttcagtttacggatagcataattaatcgcttcaagatttggcttattaacatcctcaagtaattctctatcaattgcaacagccacataaacaccttctttctataaaccacgaacacgtggacgtttggtaatctttgcagtgaatcctttatggataaccatgtaaacgaaataacgcatagcatcgcaagcgtgatcatgttctttcactggtttatcttcaccacgttcggctgctttttcatcccatacatagctggataattctttaaataaattaggacattgattgctaaatagtatcttgccttcattcattgccgtttgggtaacacgaataccatctaccacatcattttttgccttttgcactcggaaaccattattccgtaacacagcaataaaagaagccgcagacgggtcaatgataatctttgcgtgaatgttcccaagaaacttcttaagctcctgacaatactgctcatctgtcttttggtgagcagtcgcacgtcctgaataataatattctttaactaagtaccaaacaccatgattgcgtccccacaacagaaatactgttgggttctgcgtaccgtaatcacaagacacataatacttttcaaaatgattaggcaattcattaactaccatcgtatctcgatcgaagttgtcatagatgaccccttctgacattacccacaagcctaaaatatagcgttgataaaacacgccagaatacattcggttataacgatcaatggtttcttgtgccaatgatggattgtcctgcatcataaaatgaagtcgtaacgctcgcttatctttcatttggtcaatccattcaagtttgaaccagtggtaaggtccttcggggttacagttaaaccacatcttagaacccgttaccgaacaacgagccgttgcctgattaacaaaactttgcggcataagtgcaacttcatcaaaaaagaaccccgccaaagtaataccttgaactaggtcctgtgatgcttcatctttaccgccaaaaatgaagtaataatttgtatgaccattcttgctgatcgttagcatattatccgaacgtgaatcgtgaatggcatacccttcactttctagcatgcttcttaatggtcttagcacgttacgcctaaatgaaccaattgttttaccagccattccaaactgctgaccattgaattgggtcatggaccatagcacgtatgataatgacatgacaactgtcttaccagcacgaacagaaccatcacagataatagcttcataaccctttaattcatcattagcccaccagctaagcgcttgaagttgtttccgactaaacggggtaaacttgaatctaactgtctttatccccatctttatcactccatatcttcttcataccattgctaagggcagcaagtaatgagttggtgctttcatcattaacttctggttctggcaagcgatcaagtaagatctgcattgccttctgacgatcttccatttcaacaactggctcacctttatcaattcgaatactcttgatgttcgatgtatcaatcttgctactatcttttaactcaacaatattcgtatagtaataagcctgttcgcctgtttcaggatcaatcttcggcacatagcggaaattacctccgccgtcttcataaggtccatttttatcgcgtaccttataataagccaaatgcttttctgttctgaacgatagaacgtcagtaacattgctagtcgcttgatttaagtaacgtagcaagatgtcattggcggtcgcatatagttcttgcgattgctgtttctttaactcagtaaggtaagattttatccgagcatttccgagcaatctaggaccgttagtcgttgctacattgtaacttccaccataagctttttgataagcccaagtagcgttgtatcgttgcaagtaatacagacaaaaggctttttgcttatcattaagttcatcactatctggcaattctggaggcggtaacgacggtgcaaccttttcttgttttgtacgcgtactttttacttttgtatgcatacttttcttcttggttgcattgtttcgttgccatttattcctggtcttccatgacttaactgtactaagtgcaacgccatacttcttggcaatgtccttatatttcatcccagctaagtaatccgccttagcttcttccatcttactcatggcatatcaccacaccacctttctaaatttgtgtacaaaaaaagcacctgcaaattgcagatgctaataatgagggcgcccggagttgcaccaggatcttgccacattggcacgttttcctttataaactacttccctcgtctataaaactttatttaagtaatctcgtagctttattgcattttctttagataatttgaataccgtctgttgatcatcttgttcccgtgttccttgacgcatattagggtaataaagattagttaataaaacatcaatactatctggttgctttaagaagctgatctcagcctccattcccagatgatcgtcaatcttatctttatacattgcattaaaccaaccatcatcaatgatcaacgaatgatcttttacattcttaaatgattttctatgcattctttacctctcataattgattcagctactcttatcacctaactcacagagaagctagttgatagatatataccacatggcgccatcgcgctaatcgttattctgtttccgtggatccttagtaccagtgattgcttccattccctcggtagtaactatccattgctttccaaactttcttatagaaccatttggaaatttatctgggttctgctgataagttctccttacatagttttcagcatggccccagattatggacgcttctttagcatccataatatctggagtgttcaagtttatcctagccatacgcgtacagccccatagacaacccatgccactacaccagtaatcaaagcaagtttaatacttttacgatactttttttcttgtttactcatgataaaatagaatatagcaaagcgggcgaggctctcacctcaaccctttgttatcgtttatttaaggaaatgcttaacgactattttaattgtttctgcaatcggataagcaggcactgcccatgcagctattgccgcccactttgtagcttcaactttgtcgttctgcttttcctttttctttttatgttttgccatattcctatcctcctttcacttattataatagtactatatcgtacgtaagtcaagtgaattagagggaaaactcatttatttttatgtactttaaaagccggcaagcgttgacctgtcggctttttctttgctaatcgtttcctagtgcgttcagcatgagctaacatatgcaattcagcaccgctgttggtaaagccccaattcttagttgttctcatatgttaattcctttaaccattcaatagcgtcttgggatagtttcagatgatgaccgtattcaccatcatctgaaaacgtaacgagtttgccagtcatcatatgttttaaatcgccagcattcagttcagtgggttctccaccaccccaaagattatattcttctggcacatcttcccagcgcttgcaatttagcctagttacctctgtcacttccaactcctcctatcaatctatcaaaacaaaaaagcacccattgctgagtgcttgtatcaaggctatggaagaaacacgagtaagtaggtgcttcctcctttcgttgattgttgttaaaagtagatgagccttgaatgctgatggacggaatcgaaccgccttctccacgttgaaacggaaacaactgtggtgctttaccattaagctacgtcagcataatacagaaatgcttgcatccactaatcgtttttgaattttgttactcattgcatctctgcattaaatcacggcttagacaaaaaagactatgcaattacgaaagaggagcgttcatctcctatcatagttaaatttgccgtgataaagccgagaggtggattcaaaccacacttttgccacacgatcaagtgtgcccatcttggttctcagcaagcagtgcgacccgttaacactgcaattacgaatatcgggaactgcccccgcaagtattgggccactccaggatacttggcatctagtttgcatattcgcataatcaggaccacgtaatcaccgcacccggtcgtagttttccgcctactcctgtaacggtattgctgtccattcatacggtaatcctttagccgctgagttagattacatactcttctgctgattacagcacggttgctacgagactatcagagtagcatgtaaatttaatgataaaggagatcttccaatcttccaaaacgcacaaaccaaatttaatcgttaccgtaaatttcttttgaagttaatgatagtctcaatgtggattatggtcatctgccaccatcgcgtcggcttgtttaccggattccacacttcctacgcttaacaagagagatcccgttgcgagtatcgttaaacgttggaaacacgcatagcagtttcaggattgcttaggcacatatttaaacggagcgtgcaaagttttattagctaactttgcgacgataacataatataacgttatatctcccgttgtattcccgtttttgtcctcttttcatcccatttttgtcccgttttcttcctgttttttgctcgcaagtcaggaataatatcagaatcaacattaagccgttcacataccgcttctaaacaatccgcaaattctaagcaagcataatcatcagctcgatagtaagtagaattgccgaatttgttaattcgctctttaattactgaaagagataaaccttgaatatatctatacttgataatttgttggctagggtgtcggtaactactgctgcatcctgcaatcgcatagtcaaccgctcgttttgccaacgtgtattcagcatattcgatcatgcttttttctgaaccattgccacgtcttgatcctcgaatacctgtaatatcattctgtggcgatttaataccccaatcacccgatctacgtctaatagttgggtacttatcttcgtctaaaaagaaattctgtacgttcgcaattgttgctttcttattatccccttttaatagttccactatttgcacgctccccttgtgatataatagttatgctttaaatttatatctatggaggcgttctcatagtgagggcgtcttttttttacgctttttaacgcaatttaacgctttttaatgctatccaaagaaagaaaagacagcataccaaatactgaataccatgtatagcactccgcctagacctaacaatgcaatgccagcaactataagcccgataaatccaattactgtatatcccgcaaaattacgtattactcttcccatcttttccctccaaattcacttctattctttaatcttgttatttgcgtctttcaaaatgtcagatattttttcttgccttaaaactgcttctacatctgtaattctcaattgtccgtaatagcctgtattacgaaataacactcctacgtgacgataatattcaggttttgataaccctgtaatctttagaatagtagactgtttagtgccaatttttcgcaagatataagcttgtgcaaaagggttattaatattgtgcttataaaaatattgcttaattcgccattcggcttctttaattcttctaggttctcgcaacttcaaacccttacgaaacttcataatttcttgaagtcgccaatcatcaggagcaaggatctcttctggcatttcattaactccaccccattcatgattaacagttaatgaatccattgctttagatagtcttttaggtattgccatcttcatttacctcctctacctcgatttctaccctaggatggtcactgtaatacttttcagcaactatctttacaatctggttgtcatcttcccatagcaggccgtttaagccatccaaagtagatttgatgtaattatccgtgtccggttttacaatcggtctgtgtattcctgcgatccgcaattcgcgttcttttttcgatatgcttgattgaatgtgtcggtaaaatttaagactaacaattagcgggcctgttaaaggctcttttttgtattgaaattggcacatcatcgccaattgttttttgtataccgacactttctttggatcatacaagcgtattcccttacccattcgagttgctctaggccgtgcttgttctacaggttcaatttcaaaggtaagtttcactaatctaccctctcgtaagttcgttcaaatatatcttgatcgatagcccaatgctctccatctatgccagtagcgacgtaatcacctttgtgaactcgcatcggtccttctttagtatctaagtaaccagtcccaccgtcttcaggaaaccaaggctctccgcaatcaagcctcataggatcccagctcagtgctagttggtaatgttctgcttcggcacgagttaatacctgttcagcctcaattaaggctgtctttctgtatttgtgtagcattattcttcctccatcctgtgagtttcccagtcataactaaccattgtttcaactttgaattttttatcacatccaatgcaagagatttcatgctcaccatcttcatacaattcgggatattcaattaaatcatcatcactaattgcagcaccacaataaggacaaactacataatcactgctaaaagtatccggttccccttcttcaatgctttctctaattttcgctaagttgcgaagttttaagcaatcattgcaatatccgccatttacccaggctaatttgtcatactttccacacatcttgcagtgatgatcttgataatctagcgtcattattcttcctcctcatgttcactctcacgattaaatttagccaattctaattctgtaatgaatggtttcccgttatattgggcttccacagaacgcttaaaaaattcaacagctttgtgttctggatataagaatttaagcttatccatgattgccatcgctctaagtttttgctctaagctccccgctttgttaaacgacttcgacagtagatcagcaaaccgtagtaaatcatggagttgtttattgctaatccagtaaggttgatccgcttgtttacggccgaattgctcagtaagaattgtttctagctttttcagataagcatcattttctaagctttcataaagatattcacctaatgctttcttttcttcgttcatcatttcttccacctcttaggctttctagctttgctgtgccaccattgtgaccattcgtagctggtgtgatcgtgccaagccatcatgtgcttggccttagcaatctgtcgcttacgagtgcgtttgattggtttaattctcttgcacttatggaaagctgcatgaagatctttacggagtttgggtgtcattatcataactgctttaatcttcattagatactcaccatcccttcaaataatacataagcctgtcacgttcataatcagttgctattattcttccgttttcaatctgtgaaatttctacagtactaattcctgatacaactgataaatgtttagcagtccatccttttttcaggcgagttgatctcaacaagtcaccaacatttgtatggactctaggtttttttctcctaattgtattgtcgcaaacccgacaatgcatatttttctcaaaacgcgccaatctccctatccaaaactcatgaccacaatccaaacttttaatcttaagtggtttatttgcattttgatatgcggaaacaattatgaagtttggggaaagcttatttttagcgattttaaatccacgttctcgaagggagtttatattccgtttacgagcacaataggggcaaccatctcctctataaatgctgtaaggtcgttgcatatatatattgccgcaagcaagatgtttaacctgtgtttttaccgaagaccctttatactcaccaacctcgtattcaggaccaagtatttttaatgcacgtctttcaaattcttcttgagttatatgttttcctctgtaaagatcgctatattgcaaaaccatcaacccattcggaaatgttataaatttcttgtagttcagcagtgtggggcattttgataacttcactaaatgctaaaaagtcacttgtatcattacgaataaaataaacatcctttgccttcctgcttaaagaatcacactggattgctactccattcatccccctaattgccatattgaataacaagaaaggaattgctctatctgacatttcttctacttgataccaataagctctagggtcataagtaaagattgacaagaattttaagttaggatcagcgtgtaatggattaccaacccgatcatttatacagtcatcccaccagcgcttgattaaaattccacctgtccctgcagctacctcgaaatagtggccgttagatttatcgctatcaactaagctattaagcaaggtcgcaatgctatcaggggtaaaatcctgcttcttgcttttccgttcagcttgctcatcttcaaaatattcatggaaccagtcaaactttaggtccgttgaaacttctaggaacttcttaaagacttctggacgtttttgatcattaagcattagctgcagcattctttccggagctttatatgactcatcaactcctaacagtttattaactgtcttagtatcaaattgcattatttcacctcaaattccggccatcacagtcataatcttgttgtcatcctcttgggctagttcatcaagaagatggatatatactcgttgcgttgtttcagtatcaccatgtccaaggcgcttagctactgattgaatagacacacgattagcaattaatatcgatgcatgagtatgacgcaagccatgaactgtaacccgatgaacccctgcttcccaacacattctttctaacttagtattaaacgtactattaaaaattcgaggttcaccgtaaacaggagatggcttgctaatcgacgcataccaagtcggccatattggttcatccggttctagcccttccatatgtttttgtagatccatcaaagtcttgtaatcaattttgatcatcctaaccgaatacttatttttcgttggcataaattttccatactcatcactgccatattttttggacttgtagttgaaagtcttattgatataaatagtcatattatccatatcaacatctttaggtgtaatgccaagtgcttctgcaaaacgggtaccagttcgtaagctaaagtcaaagaagtcaccccaaccaatctgatcctttttgaagaccttttctagtttccttacttcgtccatttctaagtatttaggacctttattatcgggttgaaccatcgaagttattttaattttatgatttggatttttacccgtgatccatccttcgtaaacggcatcgtcaatcgccgcagcaatatggtggtaaaagtcaagaaccgttgctttttgatgagtctgaccataaacattaattaacatctgtagatcttcacgcgtcatatcacccaaaattaggtctggtgctaactttttcaaccacttcaaaactagcttatatttagctgtcgttactcctctaactgaattaactttgtaggtcatataccattgctcgtaatatttccaaaatttaattaagcgtttcttaccagtctttgccatagtttccctccgccttataaaaatcgaggatagcttgattaatttcaggcaccttcattgcatcaatcgatggtgcaagagatggttcacgttttttaatttgatttaattctttctcactaaaaattcttgcttctttttcatcttcagataaatcaaaaacaagttcatcaaatccagtgatgatatttgatacatactttggatgaaaagatgtctctcgtttagctactaatcgatacttcttttctggaaaacgttcattaactggtgtatcaagcagccgctggataacgtccatggcacgtgctaggtcttctggtgcaacttcagttaagccaccccaatgttttaaaaccgtatcccagttaatcgccttagtattcaattttaagaaccaattatcgcttatcatgtcttttgaaaaaacgttcaaatagtcgccatccacttttgctctaactgtcatagttgaattaataacgtttactgcttcatcaattttcattgtgctacctcctcaatttccttgctctcacgatctttaacaggcgttgcgatgtactgatcaatcaaatcagcaatcttatcccgcagctcatcgtttagatcaaaaatcacctttgacgcttcttcggtagtaatatcccaaaactcaggatcaagccattcttcgggccagccctcaaagttatcgccaaacggttgagcgatactctttgcctttggatcaattgtcataaaccaccggcaatctttgtcatcgtctcggtattcttcccgatccgcgtaaatgtcgataccataaatatcgctacggatagcgaacactttaggcaactgattaatccgctcaattaggtcatcggttgttaaatactcttctgcattcatgctgtctttgcctcctcgtaattccaattggtgcaggctttgtcacgtagcaaacggcactcgtgacaccaattagctgcatctttaacgttttgctttgtaatcggtgcttttaaggcctgtttcatttgatttcctgtaagcggcatggtgtagttgctatcatgttcgtctaactgtgacagataataaatcgctatctgtagcttggttttaacgaatttgattgcccgtgcctcaacattatggctatcccattcatcttgggttatctgcaccatacgcttagcaacagcccacttagcccgtacttcatccttagtcatgtgttactgcacctcgctctcatctggtagttgatccatccaattaccttgatcagacttgccctgtttctcctgctcttgttcacgtttaaaccactcaggcataggttcgttaattggcgcacgtttgccatacctttgtctttgattattagccgtgctagggttggcatttaagtacccatcaatctttgatgagcgaaagagcgtttctggtttcaagtaattgtcacctaattcgccgtttctaaacgttaccccgtgccacaatgagtacatgttatcgattacctttttcatctcatcgactgtgtagtcttctttgagtcgaggttcaataattcgcttattaccatcagcatcaggcttgaagtgcttgccagtttttttgattgagatattcaacaacttctcgccgctgtgcagcaatggaaggttgggctggctgtgcctgccctttatctcttgtagtagtcttttgtgtagtctcttggtagtctattggtattggttgggtagattcttcctctccgattgggcagtttttaccgtctccattgggtagattcttcccattcgttgggtagtttctacccaatcgttgttccaaatgggaaaatgcgtcatagtcaattcgataccactttgttttgtcaaaagataatttattatagttgcctgtaataattagtcctcgtttttctaatttcttaaagtggttcgatagagcctttctagaaagccaagggaactgtttattccaatcagccatgctgttatagacccatttgtgattgtctcttactgtattagaacgttgaagccaatagtgaagctgctggagaataacagcttcgtctaagcttttcaacgctccagctaacgatgcctgaacttgtaacggtctttcatcaagtaatagtttgctcatagttaccgttaactcctatcttttttaagtcttttttgcttaatttaattcctacggttgtaaggtgatacttcttacagaactctgtaatacctatcttgtggaattctgtatggtgaactctgcataacgccattgcacggtgtttagtgtgatctgtcttattgcggttgttacccataccaacggtatctatatggtgaaaatctgcatgctgtccacaaatcaaacactgtttatgcattaagcattcatactgaaaatgttcttcatttcttggcaagagttcatatcctttcttaactggtacttgattgtcaaaaataaaatcaattacataatcaattaatcgtttagcgtcactcatgctattagatgagccatcttttaagctgatttcttcaccgtcattcttgatccagtaaagattgtggaaatattcatcaattatttctttgctctctccagaccagttaataatgtcacctagcaacgcatagtaaaaatggcgttgtaactcgcttatttcacgtttatcaacaaaagtgaccattgcaggtacgccttgaactttaccgtcattgatattggctacatgttcccagttgacttcttccaagtattcggaaattccgaaacgcttaccgttcttttcttgaacataaacctttgctggaatcttcattgatggcatttatatcagtccttagaagggcaattggtcattatcaatatcaattggagcgccgttaccgtcattaaatggctgtttattatttgcttggctagcagtgccaaagccgttgttagtttgattactgttattttgagggcgtttttgtccgtttggctggcttccgtccgcttgtaacatacggtaacgtgttactactaaataggtattaccgttgtaatcactcttttgccattcagtttcaacggctaacttttgattagccattttttgcacaaaatcaggaattgagtaaataggttcgttatcttggtatccagctgcaattaatggagtattaaatcgcttaactgataaatcatgattttcttgtgtattattagtccaaacaagtcgatcaaagatatgtttgcccttttgtgttccatctaaaacaatgtaatccattgaagccattgggttaccattctttgagttgccggcttttgattgtgcagaaacataaatgttatagattcccgcttcatcaggtacctgtgagccgaatgtgttgttgtggttagtgacaaataatggttgttggttattcataattaagcagctccttcttcttttgcttgttcttcttgtttagattcaattaattcttctgcatgaaatttcttacgatcatcaattctgttctttccgtgattaccgctttctgggtcgcaatcaatccaacgttggttgtcttggacgtatagccgtccgacaaaatcaaacacgctagtaaacgcgttaaacgtcttttcattcatatcagccccgtaacgtcctgctcctgttaatccaccagtaccgttatcaatttggtgtgcagtagcgtagatagttacattgctctctcgtagcatagtggctaattgtctgaaccaaatttgtaacttctgataattttgtcgattatcttttgaagcattgtcgatgttttctaacaccaagttttgtaatgaagtgacgttgtctaatgcgattgcttgatattcgccactcttaatggctcgttgtaagaagcccaccgttaactgctgaatgttagcgaagtcgtcttcttcaacgaccataaagtcagtatctttttgattacgcagtggattggttgacttatcaaaactgaaaagaagtttttttcctttgaattgtttgaataagcttgtcttgcctgttccgccatcgccatagataaaatacatattaggaacttctggaattgctccggctttatagaacttcataacttaccacctaccgatccaatcgaatgacacattgcttcttgccaccctttacaccagataatccctcaataatttctcccgtttcattaagtatgacttttccatcatctgtaatcgtggtagctcccttgatctttgctttgtcaagttcagtgactgttttgagtaaatcactaggtaactgcttcattgccttcctttgtgcaacagcacctccccacttccaactatcactggtcgttcttgcttgaacgttacccattgatgtagatacagacgtttgaccatgctcggtgtcaataaatccaagcaattctgtcatcaagattgcattatcgtcttccgccctttttattttgctttcgtaaaagtttttaacttcatcaatttctgccttttcagaagcctttgcttcttcaattaatttcttgtttttcttgtactgccgtaaacgctgattaattgcaacagctttatcagcttcaaattccacttgattattcatggattagcttcttcctttctgctaaatggtatgcttcggtttcaacttcttttgcgtcttgcttaaaatcgctctgattatctagatcgtctaacagatacatcattgctcgtgctatgtcataatcataagcaccatcgcttaaaatcagattcacgttatagaggttacgtgctaaaactttttgcattcttttaagtcgttgtttataaaattcgttcatatgctataatctccttagatataatttttcatatgctatctatttgccatcggtgttcccagcaccggtggctttttttgtgttcaaatcccatagcattagcagatagaagaacagtaagaacactgctccgccatagtcaccaacgcctgcgcaataggtgatccaagcacccattagcattgctaagagctttgaattaactatttttgttagtgtcatttgattacctcctctcgttgttgcttaatgaactcaaatattttccttgctgtcggcacctgatcagctgtaatctggcgaacatctttaaggccgagcacgtatttaattggacggtaaatagcatcttgaattgtcatatagccaatgccgtctttcttaactcgtaccttaatgaattcttggatttccttactaagtttccgccaatccgggctaatcttaggttcattatccttcttgcttaattcataaaccttcaatgcaattgcgttcatttcttcttctgtcattgccattagttcttgttctcctctgctgttaacttctgatatttacgatcaaattctcgactatatttaatacaagcgttagtcacaacagtattaacacttgatccgttgtattccgctattttgttaagcttattggctacccattcgggaagtcgtactgatcgtctaactctctccatgttatccctcccgacatattttatgtgtctataatagggtgacacttttaatgtgtcaatacttttttaagcctaattggtataattttggtgtcaggaggtggtaccgtgagttccacaacaattaccattcgtctccctttagagttatcagataagctcgattacgtatctgaaaatattggaatgactaaatcaaatttaataagagttgcaattttaaaatatctagatgtaaaacagcttgatgaatttgaagaaataaaagcatcgtcagaaagtaataagcgaatcaatttatcattaactgagttactttattcaatagttaagaagcgatctgataacttaggcgtaactgtaaacagccttatcatttatgcttcggaaaaaattcaaaaacattattcatacatgcttgaatcattagaccagtaacgctaataccggttaatttactgattcttaataagtcatcatcgacttgttttggcaaacgtactgttatatatttcatatttcctccatactctcctttgaagggaggtgagtttatgactgataaagaaattgctttggaattgaccaagatctacgttgaacacttaaataaacaaatggacaataagcatcaacatactgatcttgacttcaaagcctttgggaacgtatattcaaacctttatcaactagttcatttaattgataattctgatgaaggtaagtaattgatattaatatttacttcattagccgaaagagttgctacttcatctagcagctcttttatttcattcaagttagtgcaagtggttgaaatatctagtgttagttgttccatttttgtttacctcctctgaaaacatctaagctaacgtctaatgcgtcagcaatcttacacatgtttttgaacggtggttccttcccatcgtttttgtagttataaattgttgttagtggtatgcctgtcattttagataggcgataaactgttatcttctgtttgtctaactgaatttgtatgctattccacaacatcttgtataaatcaactctttctatatccatatgtagtgttataatcaaaattacgattatttacataacactccttttagtaaattaatcgtcaattcaatcaaagtgaggtgtaattaatgttctttagtcttcgcaaatcatctgatggacaatattatttcgttatcaaatcagataatcaggaagtagttgctactagcgagacctacattctcaaagaatcagctaaacataccatcaacgcaattaagaatggtattaattccgatactccagtatttgatattactgattgctaattattcgtttgatcttattggctagagttagattttttgcagcttgttcttcaagctggcaagtaatcttctctagctcttttttattttcttcatccataaatcgttacctcctaatgtttctttctgtacttttctttcagcacattcagtttctcaccctcaataacgttgacgattgctccgattaagaagcaagccataatcgccaacacacaccatgctagatacgccatttaatcacctctcaacgcttttacatatgggctttcatgatcttcgtagtatctttctgatcgaaatgtttcaaacttttgatattccttcaaatcaacgcgaccaccggcaagaaatacctttcgccagtctggatagttttcttgcgcccaaactttgcgtctatcaaaagtcgactttgacataggtacttctatttccttgtcgcctatctttttaattgacttccaaacattacagaattctagcctgttcatctggtataaatatgggctcatctaatcacctcctctcttttgctatacttagttcatcccctacgaaaggaggtaactactatcactactcattacagttatgaggaagctcttgaagacgttgcacgcattacgaattacatccctccagaagcacgtaaagcaatgcagctagcttcgcaagctaaccaacaaattacagaagcacttgcccctattcagggacagctttcccaacttcaagaactgctcgcttttacttcgaactttgatattaaaattgcctcgactctcaatagaatcaacaatgaaattattcactacccagttgaatcatttgttaaacttgcggataccgtcgatgatcttcccgaatctaacttcgatcattccaatcacgaaagcaggaagtttacccgaaatagttattccggttgcaatgatactgaagcagacagcacacgatataacgtcaagctttttataaaaaaacaaatcgatcagttcaaaaagaataattccatagaagagataaaagtcccagatgtcgattactgcttcaaatttttcaagcttctttttcatacaataaataccctctgtatcatttacggtgtctataacgacacttttacttatgtgctcatagaagcgatcataacgaatatcgacgacatccttgatttcagggataagtaatcgtctgtcactagatgtctaccgtcttctgcaaaagaccgtagacattctttttttgtcttgggtatctccttacatatccagcacacggtagatcttcttacgaatctcgatcgctttcggtgagttatcacccttaattgctcgattaacttgttgacgattaatgtttagcaaacgtgataactcagcttgtgtcatatcacgatcaagaagtttcattttgatgtttcgctccacgtcagctgttgctttttcaagctcattttctactggcatatcctattcctcctctcttgaaatgtttatcaacttgttgcttgtttctatcactcgtgataaaatcagcttaaaacaaaaaccgttattttacggcatttatggcttttgtttatgttacttaacttgttgacaatcttattatcaatcattcgtgataaattgtcaactgttttttaatcattcgtgataaaaatagtcaaaagaaggtttgattgatatgaaaactgtagacagaattaagaaattatcgaaaaagagaggatggtcactgcaaaaagtagcagaagaagccggtataggaatcaatagtatatatcgttggaactcaaaaactcccagtacacaatctttaaataaagttgctaaggtcctaggagtatctgcagactacttgcttggtgaaactgagaaaaagaaaacagccgatctcgcagataaagatactgtctttacgttcgaagggagggaaattccgcctgaggatttagaatatatgaagcgtttattgcgtggtgatgataaatgatatatcaacaagcagaagaagcatacgattatcttttagaaaaagctgcagaatatcatattgatgttaaatggaaacacttttctccttatactccacctgggagtagttacgaatatcgacgtgtagtaatgaaccttaattggcatcggccgaaagaaattatttttcagtttgcacatgaattagctcacgttattcatggcgatcatggagacgttgtatattatcacgcgtcttttactggtaaagagtcagttgaatataaggcaaatgttggtgctgttgaattactagtccctttttactgtcaagaagtagatagagaatgcgctaatagcgcaaactttatggaagtattcgatgttcccaattatttaacagacgtggttaataagcaaattcatgattactatgtagtttaatgccacgtccaaaaactgatcgacgttaaaagctgaattttatttatattaggaggaatatcacgttggcaaagaaaattagggatgcagaggggaatgtttataaagaagttattgccccagacaagaacaggaaaagaactctcgaaattgttgttggagtaattgcaatgattctttctgttctatttattggtggtagctttggagctgcggctgtagcggatgcttttggtggtgagggttattacaccgccagaatgatgctaggacttattcttgcaatcatttcttttgttttagtatttttcataaacaaaaatcaaaaagttattggttggtcaatcaccattatgggcgcaatcattctgtttatgtgcggtgactatggaattattccgggcattgtctacataattgatggcattttagcattagttagaaaataatttaggaagactcgttacatggctaaaaagattacagataaagatggaaaaacttatgtgcaagtaaaaccatggtacaagcgctggttgatttgggtaattgttgtaattgtcgctttatttttaatcggttcattaactggcaacagtgaaagtaaaagtagctctggatcaggaagtaatactcaaacaacatctccttctagaattactgttgattatgacgattataaagttcagtcttcaaaaacatataaactaaattacagcaatactgattgggataaagctgatgtaaaaatcaataaagttactgtatataaactttccaagccttatgaattcgattcagctagcgatggtaaatatgacattaacggttttattaaattagatatgactattaaagcaaatggtgatatttcaatttatccgcaacaaggtactgccgttattggaagtgaacaagaagatgctgttggtgaatcatgggatggtgatataaacgacggcgtagaaaaatctggagaagtttatattcctatcaaagaccttgatagcccttcaagcatttcagatattagatttaagtttagcgctaacgatcaagatatggatagcgatcatgattacgacttaacattgaatctagataacaattaatatatcttatcaccggcatttgccggatacataatgaccaaaatctgatgtcataaaaaatgaactataaaggagtaagatattatgagatctcgtttacgttacacttcaaaatggatgcaaatatatttggtggtttactttttcgcaatgattgctaacgtacttgttcaacattatttccgtcaatcattatttgctgatatttgtaattattttatcattcctgtttctagcacatttaccttttttgtattgtccttaatggtaaaagaaactgattctctaaataataaagcagataaaatgtccaagcacgactaagaaactagttataaaataaaaagccccctccgaagaaaggactacatcttaggatcagggctgttgagagcttgttcaaggagaaacttgaaatcatcatcatcatttgttaatgcttggtttctagcattctctagcgtaatattcctctgtccaagtattaatacagtttgtaagttcaacttctgccagtaagttaaagagctaagaaaggaatctattggtgaaatgttttgagatttaaaaagcatgactattttcctccaagtttaaaacatatttgtactttctggggaacaataataactataattatagcattatgggctatttcattcttctccaattggaataagttatttttatatttactgctagtagtagttgtattgttatcaattaatttaatttacaattttcatcttgagtatgaaaattttcaacagttaaatgacagttacattgagttaaaagatgaaaataaaaagttaaaagaacgtattgagaaccctaaaccgtcttcctcagattctagactaaattctttagaacatcaaatagctgaactaaataagaaagtttcatctatcgagcaaacaaatgatacctcatcgatgaaattaaaagacaacattacgagatctagtaaaaagaggacaaagtcaacaactatcagaagtaattataatttttctagtacttatatcgtcgataaggacggattagttcattttattaaaggagacaataagaatgacaactagcccaactataaacttcctagcagtaaatactaataaaaataaaaataaaatattaatgagtattactagtgattttctgcccatccaacaaataatccccttaaatgtaggtttgatatatttaaaacctaatacccaatataaaggtaatcttcaaatcaaatgtgatgataaaacaataattaatgatgatagtttactcttcccggaacaagaattgtcttcaagtaacgaaataattaatggccttgtaggagcaacatttaatataaatactcctgttataaatttagcggaaggcgcatacgctctaacactaacactaaaatcagccgatgataaagaacttagtaaaagatcaacatattttttcgctaaacatgagtaattaaatattttgtttagaaggatgtgaacatgaattgattgactccacaacaatcaatcaattcaaacattgatgtcattaaaagacgtgattattagggagtaatttatgaagaaaataggtcttatttgtactgctattattgcatgcatagttctttcaggctgcaataacttagcatcacaagaaatgcacaaaaaaagcgctgaatcatccagcgtgaaaaaacatcatactcatgacgaagatcaagatgatgacttttcattaaatcttgtaagttcagatgatcaagatactgattcgaatgatttagatattaatgttccatcagctaacacttcaactagttcagcatcaaatatccaagtaccccactttaattctaacggtactggttcccctacttctggtggtgatccaaaagttcaagctgaaaccgcaagcatacaacatgattggaacgttaagcaaggcatcgaaaaccctgatggaagcgaaacacaaaatttcaagaattgggtatctaagcgtgaccaagcagaagcaaatgggcaaagcatgccagaatatgatcaaaatcaacgatattaaacgggggaagattaatgaatactgaaagcaataagaaagaaccacaattttggaaaggtgatccttctggtggttttgcgaccggattagtcgccggattcatcatcgggctaatcaatatttgttcattcaatattccttggttgggaagaatctgtttcatagcaatttggctcgtcatgggtacacaaccccgatttaaggacacacgtacaccagaagaaattgctaaagataaagaagaacgagaacaaaagtttgaggaaataagagaacaagctaaagcaagagaagctgaacgtcaagcaaccaaagaacaaaaacgtgaagcaaaaatgcaaaagaatgagctgaaacttcaaaagaaccaacttaagattcagaaacatcaacttaaaaaccgcaataaaataaaatgccccaagtgtagaagtacaaacgtacaacctctcggagttcataagaaaggattttcagttggcaaggccgttggtggcaccattttggttggtggagttggatcacttgctggatttgctggcaaaagctcaaagaaaacagactttgtatgcatgaattgtggaaaacaatttaagaaataaaatcttgtccaaccaaattgatgacattaaaagctatttaatattcaagttttaaaccggtcgaaatcgaccggtttaaaaagcactataaaagaacatatgtacgggaaggactgtttattatgaataaaaatgaactgctggaatatatagatactaactccaccgccattactatcttcaaggataaggtacgtacagaacaagaagccaaaaataaaaagcgccaacctgctaaacgctggaatgacgctaaaatcgaacgcactgtagataaatttactgatgatttcatcagtaatgtttacgacaagttatataaaggggtgaaagccaatagaaatacaccaagaaataaatggattgagtttatcgaaactaacgaaatccttgatagtttagaagaatcagtaagtatgatggagattggagaagattaattatgtggatgcaagaacgcaatggaaaattccgcttctttgagcaatataaagatcctctaactaataagactaaaatcatcagtattacaatgaaagatcataaaaagagtactgctaagcaagctcaaattattctagataatcgcatatccaaagctttatcaaaagtcggtatcggaaaaataattcatggaattacactcaaacagttacttgatgaatatactgaatatgaaaagccacgaattaggagatcaacgtattatagccatcaaacaatggttaatactttactagatatttttggcaacgatgccttagttgaaaaatttaccccgcttatcattactgaaaaactagaaagtctaatgtatggggatagagagttgtccagtggctatgtatcacgatataagtactatctgcataagttatttgattatgcagtaaaacactcatatacaaaagataacccggttgataacgttaaaattgattataaggcccctgctaatggccaacaaattaaagacaagttcctcgaagctgatgaactgaaagccgtcctcaactatctatataacaatactcggatctacggagaactttgcgaatggttatatctcaccgggctacgttttggcgaagcagccgctttaagttttgatgatgtttaccaaaaggacaaccattggtttgtagatataaccggtacattagagtataaacgaattaaaatcaaagaacaaaaaaagagtgacgcacctaaaacatcatcctcagtccgtagtgttgtactaccaaagaaagccgttcaaatttatcttgatctgaagaaaaaatctaatggcaaaggttttatcttcgcaactgaaaatggcacaccgattcaaactgcctcagtaaatactgttttaagatcagcaaagaagaaacttaaacttaataaaccactaagtactcatgtatttagacatactcatatttcaaaaatggctgagttaggaattccgctatatgtaatccaacaacgagttggtcactccagtagtaagattacctcccagatatatcttcatgtgacacaaaaagcaattgaaaaggaagcgtcaaaacttgatgaactgtaaaaaacctaccaaaaacctaccatttactttaaaaaattatttttactctttcttttttcttaaaaaagaattttaaaacaaaaaagaacccttgatacacaagggttctgcactactagttgtcgcgacgacgttcagcgatacgagtagccttaccagtacgttcacgtaagtagtaaagcttagcacgacgtacacgaccgtaacgaagaacatcaatcttgtcaacacgtggtgagtgaactgggaaagtacgttcaacacctacaccgttactgatcttacgtacagtgtaagtagcactgataccagcaccgtggcgcttgataacaacaccttcgaacatctggatacgttcacgtgaaccttcaacaatccgagcgtgaacacgaatagtatcaccggcacggaattctggaatatcatcccgtaattgactagcagtaatcttttcgattaacttgttttgacgcataatatatttctttcctttcgccgacattcatgtcctgtatgacgggcagcggaataccgttattcacagctaaacagccaataactactatacattgttttcagctgtctttcaagggtaaattagtggttttctttattaatgattgaatgacgaattccatagataaagtaaattaacaaaccgatcacgaaccaaccaaccattaaaatttttgcatcagtatttaggccccagaagatcacggccgaaaagatcgccgaaattgctggaagtactggatataacggcatcttgaactgagcttcaggcaaatctaccccttcccgcggacgcaaggcataaattcccagagaaacaaagataaatgcgaccagggttcccgcagaaacaagggttgctaagaacgtaaatgggaaaacagaacccaagatcatagccaagaaagtaatcatccataatgcgtgattagggacgtgcttatcatcgatttggccgagtgattttggtagtaacccatcccgtccaaaagcataaattagtcgagaggaagctaaaaggattgcgattaacgcagagaaaataccaacaatcgctacaacggaaagcaagttcgccgtaatatagtgtccagactgtcttaaagcccaggctgctggttctgcattatttgcataacggctatatttaaacatccccactaatacgagcgaaaccgcaataaaaaagcctgttcctagtaatagtgtcccgatcaatcctcgtggcattgtcttttgcgggttaatcgtttcagctgtattagccgcaatcgcatcaaagccgacataggcaataaagatttgtgcagtcccagctaatattccctgccagcccccaaaagtggtacctggttgatgagcagggagaaatgggacatagttttgcggatggattgcagttacgcccacaacaataaacattaaaattactaataactttacactaacaataatattttcaatccggctaacctgatggacaccgcgggaaattaaaactccaacaattagaattgcaaaggcggccagaatatcaatataagaccctgtatgtggatcaaaaccaccagttaaggcatgcggtaatttaatcccaaaactcccaagaaatccttgcatataggctgaccacccagacgcaacaaaagcgactgaaataaaatactcagctaaaagggcccagccagcaatccaaccaaagaattcaccaaacaaaacattgatccaggaaaaagcggaaccagcaaaaggcaggactgaggacgtttctgcataggctaatgccgataatcctgcgccaattgcagctacaatgaaggctaatggaactgcaggaccagtatgctcagctgccacaatccctggcaaagtaaagatagccgttcccactaccatcccagttcctaatccaattaagtctcttgttcgcaaactaggggttaattgtgcatccttttcttcataaacgcgggggttctgcttaagaaataatcgtttaattaattttttcattcgggtcaccttagtctggaacagttggatcttcatccagcttaatatcttctaacattaattgctgttcccgacttagcttagcagtttttaaaagatctggtcggcggtgaagagtccgtcgtagcgattcacgcatccgccattctttaattttctgatgattaccactcgtaagaacttccggtactttcatcccccgaaaatctgctggacgtgtatattgaggatattctagtaaaccgttactaaatgaatctcccattggtgaagacatgttgccgaggacaccaggaacaaagcggacagtcgcatcaatcatcaccatcgctgctaattccccgcctgttaacacatagtcgccaagagacgcttcatcggtaactaaattacggattcgttcatcatatccctcataatgaccgcagataaatgttaagtggtcttcctgggctaactctttggcataggcttgatcaaactttcgaccagcgggatccattaaaataacccgtccctttgaatactgatctttagtttgttcatgaattgcatccatagcgtcaaaaattggttgcgcttgaaggagcatccccgctcccccaccaaatggcgcatcgtcaacatggttatgcttatcggtagtatattgacgaaaatcggtcacattaatatcgataaatccattatcttgcgccttaccgataatggattcccccattgttgcttgaaacatattggggaataagcttaaaatatcaatcctcattattcaagtccttccattaattcgactgttacaagatttttatcaaggtcaacgtttttaacaacatcatcaatcactggtaataataactctcttttttctggacgttcaacaacccacacatcattcgcaccaggagataaaatttccttaattttccccagatgacgaccatctgttgtttcaacgtctaatccaataatctggtggtagtaatattgaccatcgtctaatggctgttgatcatcagcactgaccattaattcatgatcacggaattgttcaacaccattaatattatcgtagccgacaaacttaacaagaacaaatcccttatgttgccgcgtactttcaatcgtcaatggtaaaggctcacctgattgttgtaggtacaaggtatttcccttggcaaatcgttcatcaataaaatcagtagttgctaatacgcgcacttctccgcgaacaccatgagtatttacaattttaccaacattataatattccataaattcctcctgaaaagacaaaaactcccacagattagtgtgggagttttaaatttagtgacgatggtcattaattaataaccggactcgcttagagttagcccgtcgagattgagtaccctcgactattgttcgcaatgctgcggcaacgtgtccctgtcgaccaattagacggccaacatcattgggagcaacatcaattatataacgatggtaacgtccatcatctttttgggtaactgacaatgcctgtggctgcttcaatagcggaataactaaactacgaattaacgactcaatatctgtctcagccatgactgattatcactacttcttagcgtactttgcttcgtggtacttcttcataacgccagctgcttgaagcatgttacgaacagtatctgaaggttgagcacccttttgtaaccattccataacagcgtcttcatcaaacttgacttccttaggagtagtcaatgggttgtaagtacctactgaagtaataaaacgaccatcacgtggggcacgtgagtcagctacaacgatccggtagaatggacgcttctttgaacccatgcgctttaaacgaattttaacagacattctttgcacctccctgatttcttttaacagataataatataccagtgttcaaatagaatgtaaagtattttttcttgacaggcttaaattttttgaaattattttttctttcgtaatttacgaagctttttaatgcgtttttgcttgtcttttttcattttgcgcgccatgcggttcattgccatttgtcccatcttgccacctggcatttgtccaccaaacatattttgcattccattgaaattaccgtttgtaacctgcttcatcatcttacgcatttgattaaattgcttaatcatccggttaacttcaacaattggccgtcccgcaccagctgctaaacgacgacgacgactaggattcattagatcagggttttcacgttcttctggcgtcattgaaagaacaatggcccggatatgagcaaattgcttaggatccaaattaagattcttcaaggcaggattattagccatccctggcatcatcttaataatattttccaatggtcccatcttggtaacctgatccatttgtgccaagaaatcattgtagtcaaatgtgttttcacgcattttatccattgtttcttgagcttgctcttcatcaaaattcttctgggctttttcaattagggtcatcatgtcccccatacccagaatccgtgaagccatccggtcagggtgaaagacatcaagatcctccatcttttccccttcaccgacaaacttaatcggcttacctgtgactgcccggattgacatggcggccccaccacgggtatcaccatctaacttggttaaaacaaccccagtaatgttaagcttatcatcgaagccttgagctgtatttactgcgttttgaccagtcatcgaatcaataacaagcaaaatttcatttggatttactagttctttaatgtttgcaagctcatccattaattgttcatcaatctgaagccgaccagcagtatcaataatgacataatcattatgatttttcttggctacttccatcccttcgcgaacaatttccaccgggtcaacatctgtccccttttcaaaaacaggaacatcgatctggtcagcaacttgttgtaactgagtaatagcggcgggacggtaaacgtcggcagcaataaacattggccgcgcatgattttcattctttaatcgtaatgccaatttaccggcagtggtcgtcttacctgccccttgaagaccaaccatcatgataacagttggaatgtgcggtgctttgttaagaggaactgcttcttcccccatcagttttgtcaattcatcattaacaattttaacgatttgttgggctggatttaaccctttcagtacttccgctccggctgctttttcccgaacggtctttacaaagtcttttacaactttaaagttaacatcggcctctaaaagggcgagccgaatctcacgcatcgtttcccgaagatcagcttccgtaactttgggcttgcgtcgtaatttttccatcgccttttgcagacgatctgttaaaccttcaaatgccattttattcttcctccaagctttccagatgatttactaagtgattgagcgttgcatcgtctggatagttttctcggacgtatcgttgaattcgatccgcctgttgattacgaacttgaaattcagcatacaaatgcaatttggcctcgtaatcttctaatatgctttctgtgcgctttatattatcatatacggcttgacgactaacatggaaattctcggcaatttcgcccaatgagtagtcatccccgtaataaagctctaaataatcattttgttttttggttaataagggttggtaaaactcaaataatgaatttatccgataattcttttcaatttccatatcgtcatacctgcctagtcaacttcgactaatcccttgaacaggccataaacaaagtcgccagcatcaaacttctggaggtcatctaccttttcaccgagccccacatacttaaccggtaagtggagttcattacggatagcaaggacaattcccccacgagcagttccgtctagttttgttaaaacaatccctgttacatcggtactttccttaaatagtttagcctgattaagagcgttttgaccagttgttgcatccaagactaacaatacttcatgaggagcatctggaatttcacgagtaagaatgcgtttcatcttagctaactcattcatcaagttaaccttgttttggagccgaccagcagtatcaacgaacaagatatcatagttttcatcttttgcccgttttactgcatcaaagacgacagccgctggatcaccgttttctggtccggtaacgatgtcaacaccatcacgttttgcccatacatctaattgctcagtggcccccgcccggaacgtatcagcagccgctagaagaactttcttaccttgcttcttaaagagggcggccatcttaccaattgttgttgtctttccggctccattaacaccgacaaacataataacagttggtccttcttttgccatggttaagtcaggattttcgtcttgaccagctttatcgtaaagttcgaccattttttcaataatgacgttggaaacatcctgcttgctcttagcgttttgcagttttacttcttctcgcaattcatcactgagcttcattgccatatcatagccgacatcagattcaattaacatatcttcaagatcatcaaagaagtcttcatcaacatgccggaaattagccaagaacttatttaaccgtgccccgaagcctgtccgggacttctcaagcccgcgatcgtatttcttaactgtttcagattcttgatcctcttctggttcaggagaaggttgttgctcctgctcctcatcaccatcattttcttcagaattatcagtctcatttgattcttcagtagctgaggaatcttctgccacttcttctttagttggcattactggttcttcaactgttttttcttcttctgcaacgggttcggtcggttcaacggctgtttcagtttcagcagaattagaagatggttcttctgcagaaatagtttcttccggagtactagacgacggtacttctttttcagaaacacttgaggccgctatctcttctgagtgacttttctcgctagtatactcttctttttcttctttaaccctgttatgaagtatttcgtgagttccatccgggttaatcttttcctcatagctatcggcaggaggaatatttaccgtttccggatgaattggtgcagaagctggtgtcgcactcgtcgtatctgctgcttcatcttcatgtgcggtttcagattgaacaactgcgcttgaactatcaggcgttttttcctcttcttttttcttatgacggcgaaaaatatcaaataatcccatacttgaagcctcctaaattagttaattgtcactctcttgtaaagtatcaacaacgtccactgataccatctttgaaactcctgattcttgcattgtaaccccgtacagtacatcagcgtccatcattgttcccttgcggtgggtaatgacgataaattgtggaccttcagtaccaaatttgctgaggtagtgtgcaaaacgttgtacattgacctcatccaaggctgcctctggttcatcaagaattgcaaatggaactgggcggacttttaaaatagcgaatagtaaggtaatcgccgttaatgctcgctccccaccggataacaatgaaagatgttgatttttctttcccggtggctgggccataatatcgactccggttgttaataagtcatgaggatcggttaagacgagtttagcatgaccaccagagaaaatttgttggaacgtctcatcaaacttttgtgaaacctgattaaaggttgtaataaaccgtttcttgacttgggcatccatctcacccatcgtctgattaagctgagctcgagaggcgagcaagtcgtcttgttgtcccttcaagaaatcgtaccgttcacgaacacgctcatattcttcaatcgctccaacattaacttgaccaagatcatccaatccccgctttaatagcttcaaccgggtcgctaaggtctcttcgtccaagtcactcatctgttggcgagcttcatcaatggtcatggaatattgctcagataatcgattaagagcttgctcaaccattgattcatacttcacgcgctcttcatttaagttattacgatcatcaagggctgcccgctgaagttcttgcagacgattataatgtgcttcggcttgtgacagcttttgctcaagttcttcaagagcaactgaattatcttccagttgcaccttagcttttgcctgctcttctttagcatcttttaaggctgtctgtgtcgatttttcacttgttgattgactagctgattgagtcgttaactcagcgattgcaaccgtgaccttttctaaactctcctcagcttctcgccgttgacggttatactcttgactttggcgttgatattgttgaagtcgttcttcggccactgcaattttttgttgcatttgtgctaattgtcgtgcctgagtcgacgcatcattctgtaattcatcgatctgggtaagaatttgcttaatctttgccacaacttgcgtcaatttctggtttactttatcagcttgttcattattttgttgaacttgtgattcgtaatcctgatgttgagtgtcttgctgtttattttgggtttctaaaatctgtacccgattagtaagcgtctcatgcttacttgagatcaactggcaattactttcttgctcatgaaacttatcttgtaaagtctgaacttgttgctgataatcagctactacttgttcgttcgctttttgcgcttgttgtagtttagcaatttcttgctctaagtttgctgcaagctgttcctgtttttttagctcttcttctagttgcttagccatttgcttttgacttaaaagtcctgttcgttgactacgggtggctcccccagtcatcgctccactagcattgatcaactgaccgtcaagagttaccacccgtaccatatgacgacctgcacgagcaatctcagtggcatgatcaaggttgtcagcaataaccgttgttcctagtaagtggtcagcaataatctgaaacttttgatcaaacttaataagttctgttgctcgacccaaaaagccagggagaccagttagttgtggccaaatgtttaatggtcgccggtggctaagcgtatcaagcggcaaaatagttactcggccagcgcgagtcttaatcaagaagttaataattgctttggcagtagcttgccggtcaacaaccaattgctgaagctggcttcctaatactgtttcaaccgcttgcgtgtacttggcaggaacatcaaataattcactgactgctcccgccaatccaggaaattgctgccgttgccgaaggacttcttgaactccccggtaatagccgctatattcatcggccattgactgataagcgttaattcgcgacttaagcgaccgtacatctcctaatgctgcataccaatcacgttgttttgtttggtacccgtaattaagtttttcacggtgatcttgagctgcttttagtttttcactgacagtctgtaggcttcccttagtaatggctgcttcttgttggtagcggtcatattcttgattaatttctgcaagctggttcttagtagcgtcaagttcctcgacattctgacgttgaagactcatcgcctgttcatgattacgtgacaagaaagattgctgattatgaatcgttgttctttcctgcatcaagctaacttgttggttacgtaaatcctccacttgctgttttagggtcgcgatccgctcactgctactcatctttctggctgtttcaaactcagcttgctgaccattaatcaacgctttttgttcagccaattgctcgtcatttgcctgttggtttgccttaacctcttttaaacgtgcattgagttcagcctgttgggtagttaaccgccgttgctcattttcacgttgttcacgacgaacactagaaacagattgctgattctcatacttagcaattgcctctgtctgatttaagataatcgcttggagacgatctttagttgcgtttagttgttgacgcttttgcttcaaattatcaagctgttgctgatcgcggtctgcttgtccttgatagtcccttaccatcgcttctgcttgatcgagcttggcacctaatttggttaacttttcatagtactcgtcataatgacgaaccgtttgtgtccgatcaagcacatcaaattgtttcttttgttccaagtaatcttgggcaattgcactttgctcttctaaaggttcgatctgcttttctaactcactaataatgtcatttacccggttaaggttttccatcgtcgtagtaagtcgcttttcagctgtttctttattcttcttatacttggcaactcccgcaacggtttcaatgattccccgccgatcaattggtttaccgttaaaaatttcttcaatccgtccctgggaaataatggaaaaggattctcgacctaaaccagaatcaatgaataagtctgtaatgtcctttaagcggacgttttggtcattgattaagtactcactatcaccattgcggtatattttacgagtaatggtaagctcagtaaattcactagctaagtaatgatcgctattatctagcgtaatcgaaactagggctcggtttaaaggtttacgatctgatgacccattaaagataacatcagccatccgatctccccgtaaatgatgagccgactgttcgcccattacccattgaatagcttcaataatattactctttccactaccattcggaccaacaatccctgtcattccgggctcaaatttaattgttgttttttgggcaaaggatttaaagccgtccaaagttaaagacaataattgcatcagttattcctacttactatttatttttatttctcatattatcaagtgcctgttgtgctgcttgcatttcagcatgcttctttgatgagccctttccttcaccgataacgtcaccgttagcagtaacatttactttaaattcagggtcattttctgttccgctttcctccaccaaatgatattcaatggcaatgtcaccgtcacgttggagaaattcctgaagactagtcttggcatcaacagcatgatcaaaccagcccatatcaagtttaggaaagataacccgttggacaaatttttcgactgctggtcggccttgatctaaatagagggcaccaataaatgattcaaaaatatcacatagcaagcctggccgttctcttgcgccggccatttcctcaccatgacccaagcgaatatattgatcaaaatgacattccttggcaaatttagaaaaactatcttcacataccattgccgctcttaagcgagtaagttttccctgcggcaattcagggaaacgtttatatatatattctgaaacgatcagttccaacacagcatcgccaagaaattcaatccgttcgtaatattttaatccttggttaggatgttcatttacatacgaagcttgagtaaaagcttctgctaataaagcaggattatcaaaatgaatattaaattccttggccaggtagtcttgtaattctttgatcataaaaaattcctttcgtttttgacttaaaattattaaaaatgtctaaggcctattatactaaataacccgctattccgcaggtaattttaataatattcgaaaaaattaaaggctgtgaaaaaactttcgccttttctcagccccttacttttctaccttaataaaataattaaacggtttgattagttggcagtatgttctgcaatgtaatcaacaacttcaccgattgtacttaacttttcagcatcttcatcattaatttcttcgccaaacgtatcctctaattcgagaacaaattcaacaaagtcaattgaatcagcatccaaatctgtctttaagttcaaatcatcagtaatcttagcccgatcaacatcaaaatggtcagcaacaatctctgaaaccttattaaagatttctgttttcttattatcagccattattattaacctctctttactagttcgctacttattctattcgtttttcttagaattgtctagattttcggtgttatcaaaaaattcaactgttttttcaatcacacccgttttgatcatcgttctgatttgactaattgtatttttcactgctaaagcatcagcagatccatgagtcttaacaacgggggccttaagtcctaataagactgccccaccataagttgaagcactcattttttgcccgatttgatggaaaacgggctttagcataagataacctaacttagcacggagaccaccatgtaagattccatctttaattaacgtcatcatcatcttagcggttccttcagtcgctttcaaggccgcatttgccgtccacccatcacttacgacaacatctgccttgccaaacaggaggtcgccagactcaatattgccgacaaaattcaaatcgtctttgctattgaggatttgccatacttctttatgtaatttgtcacccttatcttcttctgccccattgtttaatagcgcaatccgaggattcgcaactcccaatacattttcggcatagaatttaccaaggtaagcatattgttccaaatttttctctttactttcagcatttgcaccagtatcgaggtagacaaaattatgtcgactagcacccggcttggcaattggcaaaatactagtgagtcccggacggtcaattcctttaatacggccaacaatgaagaggccggccgccaaaattgccccagtgtttcccgcagaaaagaaggcatcagcttttccttctttaactgctgttgccgcgcgaacaattgacgaatctttttttcgtcgaatcgcccggactggttcttcacccattgaaatctcttcactggtagcaacaatattaagccgctcattattttttattaagggtttaaccttgtctggatttccataaaggtcaaattctaggtcggggtaaaggtctcgggcctcttctaccccttcaatgattacttggggagcattatctccacccattgcatcaacagcaattttcataaaatttcctcctcatattagtcaaagtgcgtctccagttcatgacgctttaaatataaaacaagtggctgattttcattgacctgatcccaattgggcatccctaataggttcccagcatcagcacgggcaatttgcagcattttcaaatcagcaaccggatcacccactttaaattctggcatccccgattgcttttttcctaaaatatctccagatccccgtagtttcaagtcttgttcagctatcttaaatccatcatcggtagcaaccatcgttttcatccgggcttttccttcatcagttttcggatcggcaattaagagacaataactttgtcgactgcctcgaccaacccgaccacgtaattggtgaagctgtgcaagcccaaaacgatcagcatcatatataaccattaccgttgcattaggattatcaacaccaacttcaataaccgtggttgcaactaaaacttgaagctcaccagatttaaactggcgcatcgcttcatctttttcttccgtccccattcgtccatggagtaagcccactttataagctggctcaagatcggccgatagctgattataaagatcagtcgcgttttgtacatctagagccgctgattcctcaatcaaaggactcacaacatacgcctgtgctccttgctttaattgttcacgtaagaaatggattgctgcggcatgttggttagactgcagccactttgtttgaattggttttcgaccagccggtaattggtcaattatcgaaacatccatttcaccataattagtaatcgctagtgtccgtgggataggggtcgctgtcatggctaatacatcaggatgttcgcctttttcacgaagttgctgacgctggttgaccccaaagcgatgctgttcatcagtaattaccagaccaagattagcatactcaactccatcttgaattagcgcatgggttccgacaatgaggttgacatccccccgcttcatcgccgtcaatagttcccgatgttgcttagcagtcaatgaaccagtcagaagagcaacctggacatgggttccttcaaaaattttcgctaatttctcagcatgttgtcctgccagaatttctgtcggcgccattaaagctgcttgataaccggcagtaatagctgcataaatggcaatagcagcaacaattgtctttccagaaccaacatctccctgtaacaatcgattcatctggtatggttgacgcatatcacggcaaatttcattaacaacccgtttttgggcatcagttaattcaaatgggattccgccaataaattcttttaactcgtcattatggtataaaatccgctcgccatcttcttgacggtgggcacggcgaattgcttgcagtcgtaactgaaacaggaaaaactcttcgtaagctgctgttcggcgggcggcttttgcagttgcctgagtttgtggaaagtgaatttccctaatcatttgtcgccgatccattaaccggtatcgttgacgaatcgtttctggcaaatatgttggaatgatattggcatattcctcgtaagcttgacgaataaaactttggaggacattttgccggatatgcttattcaccgcatagaccgcaccaaactcatttcgatcatcagctttttccttaagaaacttgtttcctgttacttgacggcgagatgcatcccatttccccattacagttacttgctgatttagttcgatttgctttttaatatagggctgattaaaaaaagttgcgatcaccacttcattacctacctgcattcgaaaggtaagccggttgcgccgataaccatagcggaccaagagcggttctgacactactactccttgaagagtaattttctgtttatccttggcgctttcaatgtctgtaggcgtgaaatcgttatagcgagtgggataatacgtcaacaaatcttcaatagtatctattcccagagtagctagatctgctacccgcttaggaccaactccttttaaattggcgacggaatccgttaaactccgcaaatctttcacctcttttttaacacaaccagtaaccaaaataggagtgggaataaaagtagtcctttattaacccacccctataggaattaatttaatgtgccgctattcaaccgaaatcaggtatggataaactggctgaccaccatcgtaaatctgaatatctaattcatcatctacttcttcaactgctgctttaatctcttcagcagttttttgatcaccaccagctccatataagatcgttacaatttcactatcctcgtcaagcatggctttaaccatcttaatagcggcttctttcagctccaaatcagtagtgacgattttaccatcaacaattcccatgtagtcatctttcttaatttcacgaccatcaattgttgtatcacgaacagcattagtaaccgctccactggcaaccgtatttgtattagcttccatatttgcttgattttcgtccaaagatgcttctgggttgtactcaagcaacgcactcatcgcttgggcaatcgtcttactgtggacaatttttgttggaatatcagcaacttcagcagcttgatcagcagtcataaagatgttgccgttatttggcagaacaatagcttgcttggcaccactattattaatggcatcaagaatatcttgagtgcttgggttcattgtttgaccacctgtaatgatatgggtaacacccaagctctttaataatttcgctattccttctcctgatgcgacggcaataacagctgtctggaggtcctttttagcttctgcagctgcttttgccttctcaattggcgactcactgtcagcgtcttcttcatctttttccatgatctcttcttgttgccaaaccatgttatgaatttcaattgtctgtaaatcaccgaattgttgaccccaagataaaactttaccaggatgctcggtatgaacatggacccgcacaacttgatcatcgtttagaacaagtaaactatcgcctaagtcagctaagtagttatagaaagtatcatagtcaaacttttgagtcacttgtttacccttaccaagtcgtaccaacatttgagtacagtaagtatacttgatatcttcaggattaagctttccttgaacgctttggtgatccatggcgtgaaccatctcatcaatttcagcattgtcaggtttatagtcatcacttttatctacgcggccactcaaggcttcatcaaaggcttgaagtacaaagacgagtccttgcccaccagaatctaccacgccaacttctttcaggactggcaataaatccggcgtctttttaagcgcttcttcacctgcttcataaatagtatgcataatctcaacaagatcatcagtctctttaatcttattgaggcctgcttgagctgattcacgaacaacagttaaaatggtaccttctgttggcttcatcacagccttgtaagctgtctttgcaccattagcataagcattaacaaagtcagcagtagataaaacatccatgccttctgttgcctttgcaaagccacggaaaatctgcgataaaataaccccagaatttccgcgtgctcccatcaaaaggccctttgctaacgctgcactcaggtcgccaactctcttactggtttcgttgcgttcgtacttggcaccgcttgccattgaagaagtcatgtttgtcccggtgtctccatctggaactggaaaaacatttaatgaattaataaattcagcgttcttaccaagtttatcggcggccgcctggaccattttaccgaattcaaggtttgtaatttttgttacagccaattcgaaattcctccccaatgctcgcttaatcttctagtgtccgcacaccttggacacatacattaactgaatttgccgtaataccgagcattgtttcaagattatactttacctttgcttggacactttttgatacttctgagatctttgtgccatagcctacaataatatttacgtcaacagctacaccattatcttgctgccgaacaacaacgccgcgcgcaaaattttcacgacgaagaatttggttaaccccatcacggagggggtttcggcttgccattccaacaacaccgtagttatcagtagcagccccaccaacaactgatgaaatcacatcattatcaatgtcaattgtacctgacttagttttgatttttactgccatcgtcatggcctccttataaaattaccaattgattttagaatcctatgatactaaaattcacaattaaatcaataccatcataccatagcatatttcactaaaaaagtaactgatggatatttttgcagtcgatcaatggggttaatcaattaacgtaaaaaataagccgcccaaactggacggcatcattttaattaaacccgagtcactttacctgacttcagtgtacgtgctgaaacgtataccttcttaggcttaccattaactaaaatggttaccttttgcaagttaggcttccagctacgccgacttgagttaagggcgtgagaacgcttattaccaaattgcgtccgtttaccgttgataaaatctttagccattggtgataccctcctctttgcttcataattttttcgtttacgcaaaactgcgatgtaactcacctaattaatctaccataggcatcgtaacaatgcaatagttttctttcaagtaattttccttgacagggtattttcccctcaaaaacctattttaattggtcgctacactgaattacagaaataattccactttcaaatgaaaaatgattttcttcagctgtaaattcattgcttgtccacgaaaatagaatttgactactccagttttgcagtggatatttttcgtcttttaacgtaaggcctcgaacaggagtaagattgacaaaggccaggtacttcttatgcggcaggcgagaaatagtgtaatcccctggcaagtagtaagagacaacattttgacagtcaataatcttaatcttggttaagtatggtttaaattcactctgcaacggaagaaagaggttagctaataaatgatctaagcgtcctcccgttgcaccaaaaatttcaatttcatcagcctgttcttggattgcaaatttcacgcccaattgcgtatcagtataatctttttcaggaggataagtttttatacgagtaattttaccttctaaaccttgcaattcctccccggtaacggaatcaaagtcaccaattgctaaaaccggcttaattccccaccttaataatcttaaagccccccggtcaaccccaatccatttttcatctttacgttgcaaaatcaactcggttggaaccatttcaagcggaccgccaactagtatatttactctcattttttactcctaaaaaaatggatcttcaatattcagacaaatccgaactagaagatccatttttgttttttacttaatgtgactaattacttagtagcatcttcaagagccttgattcgttcagcaggatcttcagcgttaaagacatatgaacctgcaactgctactgtagcaccggctttgtagcaatcgacaactgtcttatcgttaactccaccgtctacttcaatatcgaaattatagcccttttcttctttaattgcgtttaattgggcaatcttgtcaacggtttccggtaagaacttttgaccaccaaatccagggttaacagtcattaccaagacttggtcaaccatgtgtaatactggttcaatcatcgctactggtgtacctggattaataacaacttcggcttttacgccaccgtttttgataatttgaagagcacggtgaatgtgttgagtagcttctacttgaacaccaataatatcagcgccagcatcaatgaacattggtaaaatatgttctggactttcaaccatcaagtgcacatccaataccatgtttgtaattggacgaatagccttaacaaaacctggtccgtaagaaatacttggaacaaaggtgccatccataacatcaatgtgtaagtatggtgcaccggccttttctaccttttcaatgtccttttgtaaatttacataatctgcacttaaaattgatggtgcaactttaatcatcctgattccctcatttcttataatttggtttttgattagcaatcaattcatggaactgaagataatcatcataccgactcttcatgattataccattgtttaccgcttccttcacagcacattgtggttcttttatgtgaaggcaaccccgaaacttacaatcagctgaaattttagccatttcagggaataaatgcggcaaatcatttaccgtcatatcaaatgtttcgtacgatgaaaaacctggggtatcggctatcagagcaccgttaacatctagtaaacttacttttcttgttgtatgccgtccccgttgaagcgcttgggaaatttcaccagtcgctaattttaattggggagccaaatgattaagcaaggttgacttccctgctcctgtctgccccatcattgttacaatatttccctttaattcttccatcaaacttactaattgatcagggttaaagggctcacgggccgcataaacatggtagccaattttacgatagccctcgatcgttggtaaaagttgttggtactcatcatctgtcagtaagtcagtctttgaaaaataaattaaaggagtaacatcttgggcttctaaagcaatcaattgacgatctaaaaggttagcggaaaatgctggttctttagctgaggttacgacaactgccatatcaacattagcaacaggtggccgcaccaactgattgcgacgaggcaagatttttaataaatacccttcctgttgattttcagcactgaattcaacatgatcgccaactactggcttgatctttcgttgacgaaagtttccacgcgcccttgtccgataaatcttttcatctgcaattacatcataaaagccacttaatgattgttggattattcctattttcaaactgcacctccattatccagtaatatttgttgcactcataatcgttcgtccattgcgaacaacacggtatgcacctgtttgtccttgtttaagggtaaatggcacattaattgttgtttcctgattaattgtaatatcttgatactccattgttaaattatggttggcatctctgatatatacctgtacacggttttcacgctggccaccatttccatcgaatggaatgttaatctgaatattcgtcgtctttgtttgattaccagaattagcaatggaaaccgttaacgtatcaccatgatttaatgtcgatccggctcgcggcgtctgattaatcacatggttagtcgcgattgtttttgattttttctcttgagttgtcaattgcaaattatttttatttgcaaactgttgcacagcactaatatcttgattcttaaagtttggaatcttaattggttctttccctgcgcttacccgaaaaataattgtgttagcagcaggcttaacaatcgtaccttttttgtggttttgtctgataatctgtcccttatcgatatcatccgaatacactggttcttgatgaacttgaaatcccttgcgacgaaggttagcggctactgaagaatagtcctcaccaacataatcagccatttgcaattgcttaactcctgtactaaccgttaaattaattggggtactaacacgggtcttatggctgacgtcaggattagttgaaacaattcggtttttatcaaccgcctgactatttactcgagtaatcttaccaatccgtaagttttgctggtgcaatcgttgttctgcctttagcactgtcattccttctacatcggggatgattacttgacggatcaagaaccaccagctacagactgcaatcagcacaatcatgccaagcgttccactaacaatcccatattttttccacttttgcggtttagttgatggatcaacggttggtgaatcagttgacttctttggttggtaatcatcagcttttaggtgtttaatatctaacaccttagtttctccattatcatcttgttggatctttaaccgcggctcattagctctttgtggatcaaggacggttttcaaatcagccgccatttcatcaactgaactataccgctcagctggttcctttgctgtcgctttaatgattacgttttcgagtgcttgaggaatttctttattctgttcacgaacagaaggtatttcttcgcggaaatgcttcaaggcaattgagacagccgtttctccttcaaacggaacctttcctgttagaagttcaaacaagataattcctagtgaataaatatctgattgtttagtagcaatgcttcctcgcgcttgttccggggataggtagtgaactgaccccatcaaggtattagtctgcgttaatgagtcttgcgatacagcaaccgcaattccaaaatcagtaattttaacgtttttattttcatcaattaagatattttgtggttttaagtcccggtgaataatcccatgagcatgggcggtcgcaactgctgaaagcacctgttccataatatcaataacttgtggaagtggaatcggatagtgcttttttatatatgctttaaggtctgtcccctttacatattgcattaccatgtattgcaagccatgatcctcatcaacgtcataaattccaacaatatgaggatcatttaattgcgttgcggccattgcctcccggtgaaatcgccgtttagtacttggatcgtcccgtaagtcaagacgcaatagtttaacagaaacgtctcgatcaagaaccatatcatgtgccaagtagacattagccattccaccttcacccagtgaccgaattatccgatatcggtgaccaatttcatatccaggattcatttcctatccctcctggttactattaatcccaattaaaacggtaatattatctggtccgccggcatcatttgccatttttataagttgagcacatttctcttcaagcggtctcggcaattcaatcaccttgataatccgctccttagaaacagtcttaaacaagccatcagaacacattaacagttgatcaccttcatttaattcaaagcggtttacatcaacttgtgcatcctgtgagattccaattgcccttgtaattatattgctctggggtagctttagtgcttcatcttctgatatatctcccgtttttaccaattcattaaccaatgaatggtctactgtaatctgcgttaataggttttgatgaaggatatatcctcgactatcaccaatgttagcaaccacaaccgcatccttaaatgcaatagcggcaaccattgttgttcccatcccctgcaagcgaagattacgtttggattgcgctaagattttattattgattaattgggtttcacgagcaaaccagcggatcccttccatcgaagtctgcggaggcctttttttaaactgactccccaaagtcgcaactgtttgctctgcagcgatatctccgctacgattgccaccaattccatcagcaataaccattaattgattgcctagcttgttagtaaacacagcaacccggtcctggttttgctttcgttggtggccgatatctgtttgataagcagctttcattaatttattatattcccttcttaaggctactgacgaagaagccatcagaatcaaaatcactcggtaatatagttaaggttggtgagtgacgattatccttaacttttcgtgcagttgttgtttttactaactcaaactccggatgttcagctagaaacgcttgaacagtatcatcattttcttgctgtaaaattgtgcacgtgctgtatgtgattataccgccttttttaacttttgcggcaaccgcatttaaaattgctaactgaatcttatgtaattgcttgctatcatttagcgtttttgtataacgaatttctggcttccggcgtaaaagtccaatcccactacaaggcgcgtcaactaagaccttgtcaaaactttcatcatcaaaaagttgatcaacttcccgtgcgtcaagggcatgagcagtaactcgcttttcaacccccagtcgacgagcattcttttcaatcaatctaaccttatgttggtgaatatcaagtgcatcaacgtggccgtcttcattagtgagggcttctgctatttgaacagtctttccacccggagctgcacaagcgtccaggactttatcccctggctcaatatgcatgctttccacggctaacatggcactttcgtcttgaatagtaatttcgccatttttgaagagatcggaactgataatttcacctttagtaattactaaagcattttgcgcaacttgactttcttgatattcaattccagcagcatctaaagtttgtttgacggtcggaaggtcagttttgacgatgttaactctaattacctgatgagccggctcattaattgattgaagtactttttcagtattttcttcgccatattccctagtcagctcgttgactagccaccgtgggacactattttcgatacttaaccgcaaatcacgttcatcaatttgccgcaggtcaggtaatcctttccgcaaaatggcatgtaaaacgccagtgacaaactttcgaatacctggatttcctcgacgtttagctatttcaatactttcgtcagttaccgcccaatccggaactcgttctaaataatgatactggtaaagtgcagacaagagaagcgtctttacccaaggatcaagccgttttccctgcacaaacccatttagccaatattcgagggtaagtttatgctgcaaaacaccataaataatattagttgccaaccggcgatctttatctgccaacgggtacctttttaataactggtcaacctgcaagtttgagtatgcaccattttcgacaactccttcaagcgccactaaagctaattcacgcgcattttgcggttgaaatttagtcttcacttacaacttggcctccctctgtaatatctttatgtccattaaggtaagaagtaatatccatcgcctttttccctgctggctttaacttattaatctggtatgtcgttccatctccagcggcaattactaattgatgcttcgtgacccgcactactttccctggttcaaggtctgttttttcttctaatggggtcacatcataaatttttgtgcgtaatccatcaataatcatattaccaagaggagccggccgtaatccccgcaccttcgcatcaattaaccgtgccggaagtcggaaatcaatctgttcttgttcactagtaatgttgggagaaaagactactttatctggatcttgagcgaccggattaacatccccgctaataagtttaggcagcgtttctaacagcaagtctcttcctagcaaactaagctttttaaacatagtgccactatcatcagtgtcttcaatcggaatagacctttgtgaaataatatcgcccgcatccatcttcttaaccatgtacataatggagaccccggtttctttatcatcattaataatggaatattgaattggggcccctccacgatattttggcagtaatgaaccgtgaacattgattgctgcaattttagcagccgccaataactttgttggaaggaattgcccataagcagcagtaatcattaagtcaggctgcaaattaataattttctccatttcaggacttttgctgagtttagctggctgtaagacttcgatattatattgttcagctaattctttaactggcgattgatgaagagtacgtttccggccgatatggtggtctggctgggtaagaactgcttgaatatcgtattctggattatcaattaaactttgtaaaatcggaacagcaaactcgggtgttcccataaaaacgactgatgttgacattaataacatcctttctttcacataaaatactgtggatctggatcgatacttacttggacatccttaaaaccgcgactttgcgtatcctgaagaatatcaaacaatagctgatgcaagtaaggatccttcttatatttgatgacaatttggtaatagtaacgacgcttcatccgggcaattgctcgcggagtggggccaagaataaccgtcgaagataataatccctgctttaggcgaccatagatatctgccattgcccgagctgctttggcttcttcgggatgactggccatcaaacgaacggtgtaatagtatggcggataacttgcttgtcttcgtagcatcatttcctggttaaaaaatttttcgtaatcgtgcattttggcatcttgaatagcgtaatgatcagggttatatgtctggataataacttccccctgcttatttgcccgaccagcccgaccgctaacttgacttagcaaatcaaaagtccgttcactagcacgaaaatctggtaagcctagaccagtatcagcatttaaaacccctactaaggtaacattagggaaatcaagcccttttgcaatcatctgggttcctaataaaatatccgcttggtattgaccgaactgtcgcaataattttgcatgcattcccttccgccgtgtggtatcaacatccatgcgaataatccgggcctggggtaataattgatgcaattcttgctcaaccttctctgttccagtcccataatagcgaatctgatgactatggcaattgggacattcacgggggattggttcttcatgaccacaataatgacatttcattgtccgcgtatccatatggagcgtcaaagaaatatcacaattaggacattttaaaacatttccacaatcacgacacatcataaaggatgaaaatccccgtcgatttagcattaaaatactttgctcgttcttttgcaggcggttatttaattcggttaatagtttttgagaaaagttactctccccgtactttttaatttcatctcgcatatcaaccacttcgattggtggcagttcctgtttatttacccggtgaggaagacgcaacaagtgataaacgttttttactgctcgcgcacgactctccagactaggagtagcagagccaagaactacaggcgcttgattatattttccccgccatttagctacttcacgcgcctgataacggggtgattcatcttgtttataactagattcatgttcttcatcaagaatgattagccctaaattagttaacggagcaaagactgctgaacgggcacccacaactacttgcgcttctccacgttcaatccgtcgccattcatcatatcgttcaccattcgataaactactatgtaaaacagcaaccttagagccaaatcgtcgccgcacacggttaacaatctggggcgttaatgaaatctcaggtacaagcattaatgctgtctttccctgttgaagagcattagcaatcgattgcaagtatacttctgtcttgccactccccgtaactccttgtaagaggaaaactttagggtcatgattgtcgattgcttgattaatctggttaacagcattttgttgatcggcgttgagctgcaggggggctgctaaatgagcatcatcaggagtgccctgcatagccaagggttgtcgatatacttcaactggtgttttttctagccatcccttctgttgtccctgattgaaggtggctgcttttaaaccagttttatgttcagcatccttttgcttaacaacttgactaccaattgattgtaaatatgaaagaagacggttttgagcatgagcattagcatgaagggatgcgcgctcatcttccagttgttcaaaattaagcaaagagcgaataccagtcaccgttttagctttggctcgatcctccacttggtattcaatcgttatctttccttccttttgcagtttgaacaatttacttaagattgccggtttatcttgtaccgccgccatttctaattcatctcgcccatgaaaaatgtcaaaggcaacatactcgtctacttcatctacaattcgaataattctggtagtcttagccttcaataagttaggcaacatcgtatataagcaagaaatccaaaaagagtaagtagtatcagctaaccatttgctaagattcattaattcaggattaattaccggttgaagatccattatcgcctgaattggtttgagttctccctcatattgggatgcattgtcaagggcaacaacaaatccttgaacagtacgttttccctttccaaaaggcacaatcactcttactccaacttgaatttgtttttcaagttttggcggaatctgataagtatatggttgatttgtttgcattgttggaacatcaacaactacctgtgccaactctggcatttaatcacctgactttaattttgcactaattaattcaataatctcgtttgcaattttagctttagattggcgggctaatttaattggcgtttgatctttttgtaagatggtcacttgattctggtcactgccaaatgctcccatatctcccgccacactatttgcaataatcatatccgcatttttgctagcaagtttacgattagcattttctagaagatcatttgtttctgccgcaaacccaacgatgtattgaccgttttgcttcatcttcgcaatattctttaaaatatcaatagtttcagtaagcgcaatggtaagatgcgggttaccatcttttttcttaattttatgatcaactatctcaactggacgatagtcagcaactgcggccgccatgattaaaatgtctgcctgcgcaaaacgttcttttaaactggtatataaatcttcagttgtgattccgcgcacaacttcaatcgctggtgattgtggaagggggacggtaacttgaccggcaatcaatgttaccttagctcctgcttggaccgcggcgttagcaagtgcaatccccattttaccagaggaccgattaccaataaaacgaacaggatcaatattttcacgtgttccaccagcagtaacaatcacgtgtttgccctttaatgcttgactgctagctaaaaaatcttctatatattggcaaattgctgctggttctggcaaacgcccgtgaccagcatatccttcagctaatcttccactaactggcggcataatattgaccccatcttgtttaagttgagtaatgtttcgttgagttgcgggggccaaccacatatggctattcattgccggaactacaattttaggagcattagttgctaataaggtggtagaaacagcatcatcagccagtcccattgccattttagcgattatatctgctgatgctggtaccactattgctagttctgaccaatcagctaactcaatatgaggaataggcgttgaatgctcatcccataggtcagtaagaactggtgctttcgtcaaggcaaaaggagtagcaggagtgactaacttagtagcggcgtcagtcattcctacgcgaacctcatgtcccattttttgcagtccacgtactacttcgattcccttgtaagcagcgatactgcctgtaagatacactgcaattcgtgtcattatgtcacctcaacttattttttcttaattgattatagcatttttagaagcaaaaaaggggccagtgacaatcctgccctagtcccttacttttgtttatccagcttaatttaatcctgtaagtcttcagtatgatcaggatcgatcgtaacttttccagccaaaatctcttcaagggccttcccaactgacttgcttgaatcataatgttcaagtaatggggcagctcctgcatctaattcattggcacgcttactagcaagcataactaatgaataacgagaatcaatatgttttaataattcatcaactgatggaaaaaggatcatttttcggcatctcctaacatttcaagataacgtggcattacacgggtaacacgaagccgttcagtacgaataatgtctttaatcttttcaactgcatttggtacttcgtcattaactactgcataatcatagttttgcatcatttgaatttcactaaatgctttatgaattcgtttattaatgacttccatactatcagttccccggtgaatcaatcgttgttttaattcatccaaatcaggaggggttaagaaaataaacacgccatctgggcacttagaccgtacttgcattgctccgttaacttcaatctcaaggaaaacatcttttcctgaatctaaggtctcattaacatattttaatggggtaccgtaatagttgtcaacatacttagcatattccaacatcccaccagtttgaatttggtgttcaaactcttctttgcttacgaagaaataatcaacaccattaacttctccaggacgtggttttcgagttgtcatcgaaattgaatattgaaaatcattatcatttgaatcaaagatagcttttcgaacagttcccttcccaaccccggaaggacctgaaagaacaattaacattccacgatttgccattataacgctcctatttatttaatcgtattaatactataatgcactagattagtactgaaatcaagcacctgaataacaaaaaatcattgagctttttgcttgcatttctgaatgtatgttcgtatactataatcaaacgaatgttcggaggcgcgattatgcaaattgaacaaaagtctatttttaaatttacgccacaaattattagtgataagcttcggcatctttttgaagaagcacctgctgacgatcagcaagcagggttacttactccccaacctgctaaacaacgacaattatttttaaaacgagccattaaagataaaattaaagcaacgtttcagctaatgccaatcaacaacgatggctatcccgtaaacgttaccggtaacatcgcccaattagcgaatagcaatcgataccttattacgaatcaaaatgtaagttatgttgttaactttgatcaaattagatacatcgcgaatttataatattggatttaaagagagactgggaattagctcagtctctttattgttttaaagatatttatacagtagctgcctggattccgatcgttgataaggcaccccaataggctagcttcgcgtcgtagctatcctcgtggaggaagacgaagtcgcaagtgacttctttcccactccctcttttttattttgccatattaagcaattcttgcgcatgctcttttgtcaactgagtaatcttttcacccgatagcattcgcgcaagttcttcaacccggtcgttttctttcaatggtgtaactcgagtagttgtccggtcatcatggacagatttcttaataaggaaatgatgttgcgcaacggctgctacttgtggcaggtgcgtgatacataaaacctgtgaatgttgagcaattaagcgaatcttatcagcaattgcttgggcaacccgtccgctcaccccagtatcaacttcatcaaaaatgatactagtaacgccttccttttgcgcaaaaattgtctttagggccaacattacccgtgacaattcaccaccagaagcaattttagctaacggccccattgattctcccggattagtccgaatataaaattcagcctggtcaattcccgtcggtgtaaattgttcccgactttgattagcaaagtgaacttcaaattctgctttttccatgtaaagctctttaagctgctggtgaacttttttaccaagctcatgagcagctttttgtcttacctgactcaatttacgaccggtctctcgaatcttattttcggcttctcctaaccgttgctctaggtcactgctagaatcagccgcggcctccatcgaatcgagttcttttttgatcttatcataatacttcaaaacatctgccaatgtatcgccatacttatgttcaagatcaccgatagtagttaaccgttgttcaatctgagctaaccgttcatcatcaaattcaagcatgtctaattgttgactagcttcattcgctacatcttgaagagcgtaataagcatcattaagagccttactaagattatcataagcatcatcaaattcagcaattgcattgattgagtccatcaccgtggcaacttgatctaaaacaggcgcttgctcaccttcattaaaggtcgtcacagctagttgaagagcattattaatttgttgaaagtgttccaatcgatcacgttcactaattaattcatcttcttcattttcttttagattagcttctgcaatttcattgacttggtaccgaagcatatccaatcgctgcgcccattgttgttcatttgcttgttttttatttacagcagctttgagtttagaataagcttgatattcttcttgatattttttaagtaagggctgaacctctttagccgcaaattggtcgagcattcctaaatgagtctcaggttgcattaattgttgatgttcattttgcccttgaatatcaactaatcccgcaccaatttgacgaagagttgccgtattaattagttgaccattgacccggataatattgcgaccattgcgatgaatttcacgggagacaattaagatcccatcttcatgatcaattcctagtgattcaagtagtttatcaaattcaggatcatcaggaattgcaaattgtccttgaaggcttaatttttcttctccacggcgaatgaattcctgcgatccacgaccaccagccagcaaaccaactgcatcaataataattgactttccggcaccagtttccccagttagaacagtcatttggtcagcaaaagttaaggttaagtgcttaataattgctaaattatcaattgtcaattcttgtaacaaaaattttcacctcgcctagtcgagcattgcgttaagcttttcttctaatttaattgccgcttctggagacatacaaactacaagaacattcccatcatcaccaattgttgtgaagaccgttggaaaatccatcttgcgaattaaggtagctactaccggcccattccccggatgaactgttaacgctaagaaacagtcattgcgctttaattgttccaaactgtcttgaagggtctgagctaactgattttcatgtccttgatgatgatatgctggcaaaccataacgataacccccattatccgcaggaatctttatcagttgcatttctttaatgtcacgcgaaatagtcgcttgagtaactgtcaatcccatttcacgcaggcgttcaacaagatcttcctgccgctcaatgctctcattagtaatgatttcacgaattttttgttgtcgttctgcttttttcatggattaagtcacctttatttattccttatgatttaaatcatcatcagcggttgcaataaccttatcgatatttacttcttcggcaacaatccccggattttcacttaggcggaggtgaactaaaaattccatatttccttgtccccctttgattggtgaataatctaatccaaggatatcaaaatgatcttcacgggcaaaggtcagcacttcttccaaaactgctctgtgaactttatgatcatgaatgatcccatttttgccaacatgctcttttcctgcttcgaattgtggtttaattagggccactacttcaccacccattttcagtatctgagccaaaggtggcaagatcaaacgaagggaaataaacgaaacatcaatcgaagcaaattctggttgaccactagtaaaatctgctaacttactgtaacgaaaattggtctgctccataacaactacccggggatcttcccgcaattgccaaaccaactgattagtcccgacatcaagagcgtaacttaacttcgccccattttgtaacattacatcagtaaagccaccagttgatgatccaatgtctaaaaccgtcttgtccttaactgaaatatcaaaaacttttaatgctttcgctaatttcaagccgccccgactaacatatggcattttatggcctttcatgtgaagggtggtggtaatcggaattttttgtcccggtttatctaatcgttcattatttttgccaagaatttctcctgccattaccgcccgctttgcttgttcgcgagagtcaaacagcccttgttggaccaataatacatctacacgttcttttttcataatccctttccttatttaaaatatgctaaaaagtcatcataaccagcaaatgacttgccagtaagcttttcaagattcttttgattttgattagcagcagttaaagctatctgtagctgctcctttgcaccatctatgccaagtaatcctggataagtatttttttgctcatcagcatctttgtgaacagcttttcccatctcttcagtagtactgaggacatccattaaatcatcatagatttgaaatgctaaaccgtagttttcaccaaatgctgctagctcttgtttgatttcagcagattgatccatcataatcccacctgccaaaacagcatagcgaatcaattcccccgttttttgacggtgcaagtatttcaattggtttaaatttaaatgttggtgttcgccttcaatatcccgtgcttggcccgcaaccattccagatggtcccgcggcttttgcaagttcaagggtcaactgactccgaacattagctggaagatggttatcggcaacccactgaaaggccaatgtcaataatccatctcctgctaaagttgccattcctgctccaaatttacagtgattagttggttttccgcggcgtagatcatcattatccattgctggaaggtcatcgtgaattaatgaatatgtatgaagcaattccaacgcagaagctgcgcgtagcagatcatcattaagcgtgccacccaacatctcaatcgttgtaagcgtcaatgctggacgcagccgcttgcccccagccattagggaataagccattgagctttctaacgttgcttgatcaatatctgtggccaatgacttgcttagataatcttcaatctgttcttttaaaatcggcaatggtgtactcatctttttctgctccgttgcttattgttcatcagtgctaccaaatccacggttaccaccgccattattgcttgggtcatcggtttgtttttcgtagacttgctcatcaccattatcgtcaattaagtgcccaagcgttttttcagcatttgttagcttcgtttgtaattccttagaaagcttgattccttcttgaaactgttgaagggcctcttctagtggcacattcccctgttcaaggtgattaacgatctgttgtaattgtgctaattgttcttcaaatgttggttttgctgttgccatcttagtgctcctttaccttttttatttctgcttgaacttccccgtcatcaaaatgcaggtgaacattttgcccaaccgttaattgactggcatgattaacaactttttcatcactcgttacatatgtatacccccgactcataattttaagggggctcagtgaatctaattgtttaataagagttgtcacttgttgtttcttttcattttggttggcaagtgaggctgtcaccaattgtttttgtaattgattaactaactgttcttgttgttgaacccgatgcagtggagaaatagccgttagacgcccacttaatctttctacgttcattcgcagctcttgcattttattttgtgctgcttgacctagctgttgagttaattggtcaaccttttgtgcatagttttcatataatcttgtcggttgctgaaaaatatagctttgcagctgtttattcaattgttggcggtcaaaattaattttagtccgcatcgtatttaataaacgattctgatcatctttaagtgtcattaatacatcgtttaattttaccggcgttgctaattcagcagcagcagttggggttgctgcgcgttgatcagctacgaggtcggcaattgttgtatctgtctcgtgaccaactgatgaaattaccggaattttactattggcaattgcacgggcaactacttcttcattaaaaggccataagtcttccattgatcccccaccacgaccgataataagggtatcaaagtcgccgcggtcattggcacggttaatttgtctagcaatatccgccgctgctttatccccttggacgacagtgggatatagaacaacttgagcaattggataacgtcgtcgaacagtcgtattaatatcccggataaccgccccatcaatactagtaacaactgcaattcgtttcggaaacattggaatctgttttttaggtaaattaaatagaccttcagcgctcaatttcttttttagttgttcaaacgctaagtataaagagcctagaccatctggctccatccgatcaatataaatctgatagcgaccacttttttcatataaacttacatgaccgactacacaaactttcatcccctgttcaggagtaaatttaattttccggaattgatgctcaaacattacagcatcgatcacagcattatcgtcttttaaactaaaatactgatgcttttgccgtaaacgaaaattagaaagctcaccggttaaataaaccgtatgtaggtatggatcccggtcaaacttcattttcaaatacttagttagttcactaactgttaaatactggcttctatccatgatgcctccaccgcgctaaatcaactgtttgttccattaaagttgcaattgtcattggtcctacgccacctggaacaggagtgattgcctgagcttttgtctttaccgcttcaaaatcaacatcccctgtcaatttaccattgcttaaacgattaattcccacatcaattaccactgctcctggttttacatctgtctccttgataaggttaggcacaccagtagcaacaattaaaatatccgctgttttcgttaaagcagaaaggtcgccagtacttcttccagccattgttacagttgcgttagcattatttaaaagagctaaaagaggtttaccaactaaaatactccgaccaacgataactgcatttttcccttgtaaatcaatattatattctgccaacatccgcataattccgcgaggtgtacaggccactggataattaccatgttgattggcaaacagttttcctaagtttaggggattaaggccatcaacatccttagttggcaatatagcattggtaattacttctgaatccaattgaggaggaaggggttgttgaacaagaatggcatcaattgtgtcatcatgattcagcttttcaatttcggcaagaagctcatcttgactaacatcagcaggaaatttttttaaaattgaattgattcctaacctagtagccttattatgcttatttcgggtatagattaagctcgctgcatcatcaccagcaatcacgactgcaattcccggagttatattttgtttttcttttaactgtgccaccagtttttgggtctgggcattgatttttttagcaagggtcttgccatcaataattgtcgtcacagtgattcctcctcgttaaatttccattttatattctaccataataatattgcgcttaagcaaaaaaggagtggaatcagaagtttatcacttcatttttccaccccataattattgttaacagtaatattagttattcgtgttgacttgtttttcaaatttgccaagggctccattgataaatttacgtgacttatcactgctgaatgttttcgtaagttctagtgcttcattaattgctactactgttggaacattttcagcatattgaatttcaaataaagcaagccgtaaaataactaaatccggctttgctaaacgattgatggtccatctgcttgcgagaaggtcattgatttgttcgtcgagctgatcttgatgttctcgcaccccatttactaaagtcagtaaataagggggaatttgcttttcatcatgatgaggaattgcctcatacacagtttgaatatcggcttcaggatctgattgcaaagcaaagagaacttgaaaagcctcctcacgaatcatgtgtcggtttaaactcattttattcaccagcctcgtcattaagatgttcgccaaacaagtcattagggtctacttgttggtcttctttagatgttacgattcccttaatatgaacattaacttcttttacttttaaatcagtcattaatgtgatttgttgtttgaccttatcttgaatcattgccgctactttaggaacagagacaccatattcaacataaacatccacatcaagtgataatttttcatcattgctggaaagctttaccccacgccggcgatcagagcgtcccaaaagttcacttacgctatttgcaaatgaaccatacatctttgaaacaccatcgatttcacttgcggcaatccccgcaataatttctaaaactcgtggcgaaatttgaattgtcccgagtgacttgtcttcactacttaaaacaatctttgattcttcagccatcgtcagccctccaatttatttcttctcttaattatagtaatcatttctattctgcactatgttcgaacaaattgcaacaacttggtcaattaggaacatagcgccagtttagaaattaaccgcaaattatgattataccaatcatgaacgactaaatcgagactagatgtggtaaattgtccgaaattaattgatttaaattcttctaacgttttcaagaattggtctgcctgctgaagcggactagtataccgtgcaaccgtcacatgtcctgagattgttggatatcgttcttttagcaataagtcatgtaacggcagttctttcctaagtacattccgtaaagttgataattctgctgaataatacccttttacaagaagtgctcctgaactagtgatcattcctgctaaacgccaatgaatcggtccaatttgtgaaataatctgccctactacgtttttatatttttcctcttcaaatgttgagagcgaaaagtatgaactagctgcaataaggtcaataatcgtaatatgcaggtcagcaggaggatagaagtattggttaggctcaattgcagccaacttttgcaagcaaaacataatgttccgactaacgtgcgcaggcagtgaagcagtaagcgtcagtcctcgacgcatatctttatcaggatttagcaagttacgatctagctgttcttgatgatttctaattgccgacattccctgttgattaatattattatacagagtagtaagttgcatactattttcctacgattattagatcagttggcgcctttgtcagcacttcaactccaccgtgagtaaccagaatatcatcttctatccggaccccgccgatttcaggaatatagataccaggttcaacagtgataacttcattgttccgcaatttaatattttgagcactgggtccatagctagcaggcaattcatgaaccgataagcctattccatgccccattccatggttgaattcatccccataacctgctatttcaattaattgccgtcccgcaaagtcaagttggtctcctcgttgcccaacatgagcagcttgaattacagcttcacgggcctcattgacgatttgataaacatcacgtaattctggatcaattgaaccaacggcaaatgttctggtcatgtctgccgtatagccattgaagtagtagccaaaatcaacagtaacaatatcgccgtcttcaatcaccttttttgaagccgtcgcatgcggtttggccgcatttttgccactagcgataattgtcggaaaagaggccccgcttgctccatgttctttcatccaaaaatcaagcaagttcgcaacatggcgctcggtcatcccagcgtggacattttctaaaagataccggtatcccgctgaatgcaagtctgcagaagcacgcagggtatttacttcatcactatccttaatcattcgcatccgttcaatttgttggtggaaaggaacaaggtctgtcgccatctgctcatcaagcatatcaaataaggcataagtaactgtatcttcatatcccagaacattcactttcatcccctgacatattttattaagcgaaccgtaatagtcacgggtaatcattcccacaacctcatcgttttcaaattcttctaatgcaagctggtaccggtcatcagtaataataattgcattatcttttgttattaaaaggcatccatcgccttcaataagattaaagccagtgaggtaataaatgtttttttcatccgttactaaaaatgcatcgatatataatttttcaaatttcttctgtagacgtttaattctagacatagtacatttcctttaatactgccggttagagtaatcacgagggccaaagatagccgtcccaacccgcacacaggttgacccttcttctaccgctatttcataatcatgggtcatccccatactaagaacatctaattttaattgatcattttggttgttcatttcatcgcgcaattcacgtaggcggcgaaaaatcggccgcgttttttccggatcatcataataaggagcgcttgtcattaatccccgtaactttacatgtggcaattgaagactggccttagctaattccatgcaatcttgcaaagttggcttaaccccaaatttactctcttcttctccaacattaacttcaattaaaatcgggattattcgattatgctttcttccttctttttcaatcgccttcattagcttaagggaatcaactgattgaatcattgtaacgtaatcagcaatgtatttaaccttattacgctgaaggtggccaatcatataccagttaatgtcggctggtaattcatcatgctttttatctaattcttgaacataattttcaccgaaactgttccatccagctttataaagctctgcaatatctgccgccggatgatttttgctaaccggtaacagttgaacatcttgaggatcgcgaccgctgcgcttacatgcagcaataattttttcttggacatctttagctttatcaacaatcgtcattaaacagtttgctcccttcaattgtgggttaactatattcttacattatagattaacatataattgaaaaatatttaaaaataaaaagactactatttcatgtagaaaagtagtctttttattactattcagcgattgggtaaaccgataccttacgcttactgcgacccatgcgttcaaatttaacaacaccggctaccttagcgtataatgtatcgtctccaccacgacccacgttttcacctgggttgatgtgagtaccacgttgacggtagatgattgatccagcagttacgattgaaccatcagcagccttagtaccaagacgacgaccagctgagttccgaccgttagcagtggaaccaccccccttgtggtgggagaagaattgtaaattcataatcatagttgttcacctccagcaatgaactttaatcaaacatttttacttcaatgttttgtggatagctttcttggatatcacataatccatttaaaaaggttttaagaaggatctgactatcatgaccaaggtctaatcctgtaacttccagaaagccaccattatcattatcttgtttaaggtgaggctttgtatgaacaacttgttcaaggccgttcaccgttgaaatagataatgcagaaaccgcggcacaaacaatatcttgcccatatggaccagattcagcatgcccagtcattttaaaagaagtgatccgctgattcgaatctaaattaaactgtgctcgaatcatgatctcacctccgcattaagcgttgatcttgttgatagtaaccttagtgtaaggttgacggtgaccttgcttagtgtgagtgtgcttcttaggcttgtacttaaaggtaacaaccttcttttccttaccttgcttgtcaacagtaccttcaacagaagcaccgtcaactacaggagtaccgatcttagtgtcgtctccaccgacaaagataacttgatcaaaagttaccttgtcaccttccttagcatcaagcttttcaacatagatagaagcaccttcttctaccttgtattgcttaccaccagtaacgataattgcgtacatactttgtgcacctccttaatatctcagactcgccgtactaagcagctaaataagctttagacttaataacgcgcggttgtagttgttggttcacaaatacaacgtttgtataatatcaaatattattctcttcgtcaaccgtaatctctacttttataacgaaaaaaggactgtgacataagttaagttactttcataaaaaggaaatacgcagtacaacaatggaggctgggaaaaaactcctagtccaaaataaaaaccggatgatgaattttttgaacaattcatcatccggtttttatgtacacaggaaatcgttcctgatatgatgtaattacccctaaaaacaaccaaagggagcgatttccatgtatcaaaattataccataggacaaaccgaattcgtactaaactataactatgatttaccacaaaatcatattgcgcggctaattagtgattttgtcgactcgattccacaaaatgtgctattagaagattcaggagcggctaccggccgcccttcatcgcatccagcaattatgcttaagattctcttgtttgcctactcacgtcaaacttattctggaagaaagattgaaatgatgttggataagaacctgccaatgcgttggttagcccatgattatacttatagctaccataccatcaataactttcgacgcagtcagcacgctagtaagctaattaaacatgcctttgtctactttaccatggctttgaaagatcacggactaattcaaaatgatgcagtttttatcgatgggaccaaggtagaagccgatgccaataaatattcatttacttggcggcgggcggttgaaaagtatcacgctaagttaagagaaaagacgagtaagctttatggggaactagtagaaaaacaagtggtgcaagaaatggcacccgagctggttacttctgccgaaggcatggaagtaatgaaacaagagcttgcggagaaaatcattaagttagatgaagagattaagcaagaaccaaaaatcatcaaaggtggttcagttagaaaacggcgccgtcgttttctaaaaaacttcgccatcaattaagcaacgacctaattccgcgtgccaaaaagtatgaacgtaccgaagatatcttccaaggtcgtaatagctatttcaagactgatcatgatgcgacttttatgtgtatgaaggaagatccgatgatgaatcgggagttgaagcccggctataacctgcaaatcgctacacataagcaatttgtccttgattacgggctcttttcaaatccaactgacaccaggaccttagtgccatttcttacccagtttcatgctttagatttctttaagcatatcgttgccgatgccggttatggtagtgagtacaattacacaatgattcttgatcagtttgaaaagcagcctgttattccatacacaacttatcaaaaggaacagaaacataaatttaaaaacgatccaactaaatcacaaaattggcagtataatgccgaagatgattactacatcgatcatttaggagttcgctttagcttttatcgttatagtaggcgaaccgataaatatggtttcgaacgtgatttcaaactctatcgagcggataagcaccaactgtcagaacaattggatgagttggcaaaaacaccaagtggtcggcaacactatatgcaggttaacccaacgtggaattattacaaggctaaagtaaaagcaaccctctcaagtgacgaaggcaagacaatttatcgtcgacagaagttcgacgttgagccagtctttgatcacatgaagagggattttggcatatgccgaactcatctacgcggacaacgagctgtggaaaatgacattgggctagccctggtggcattaaatctaacgaaattgggacaatcaattagtcgattggcgactaatttcataaataatttaaaatccgaactacgatttttggatcgatcaaaaatcatagtccggattttactgttagagaaccaagaattaatagttaattcccagcctcctattgttgcttgcggggggctcaaaaacgaagtcacgagtgacttctgtctcgctccctcttcctacgattagtcaagaaaaatatttagaaaagaagagtatactaaaccaacccggttcttcttcaaaaatcgagaattagtggtatattaaaattgtgaggtggttatgccttcacagggactattgagtccgtataccgatagtggtattttttatggtgcttaatcatggataagagacatttcagagttttattcatacaagctaccatggcgaccttgttcagttttggacgaggtcgtttttcttttaaacgatagtaatagtcaacaatatgattagaattagcgtgttgttggcggatcatattacctacagtaaaatataagagcttacgggcaatcgggtttccacgcttattaatatgatcttgacctaaataggttccagattggtaacgacgaatatcaattccaacaaaggcattaagctgattagcattgtcaaagcgactaatgtcgcccaattctcccattaactgagccgcagtttgtttcccaattcccggaaaagagcagtataggatatactctggtaagcgctgggcaatagattccatccgcttgatgacctcttcctttttacgggttaaggcaattaattggcgagcgtagtagcgaacttcatcaacctgaatggtatcaccagaaacagccggatatgatttttgggcgagatcgattaatcgatcggcatacttataagctttcatcttagatattcgtttatctgtagaggccattagaatattctttaatttaactctcgaataaggcctaactagtgctggatgaggaaaaagctccacgatattcaacgctaatttagatgttctatttacaaataattgcttaagttctggaaaaacttgttcaagtgcagtatgaagatgatttagacgatagttccaatcagcattgagctgattataaaaccgactaagctcatgtaactgaagatagtcttttttccaaggaactgttaatcgaaaagcattttcctggacagtgagcgcaatccgatgagcgtctttctgatcggtcttaactcgtcgtagactctcggactttaaatgaagttctagtggattaagacggcaaaagcggagaccattagtctcacagaaatgtccaattactcgcgaataaattccagtcgcttcaaagtagataattggcttctgagcttttttaatcatatctcgtagagcattaaaccccgctttcgtgtgtactaaagaaaactcctttaaacagtgtttccctcgataccagacacagtagcttttcctcattgaaacatccaaggcaaatatatcagacataaaaagacttcctttttataaatagagctagatataaccgctatcctagatttgtacttcatttcctaaatactcgaactcgtagttccacaacctaaaagcaaaatatcaaatcaaagatagcggagatcattttataatacggactcgaagtccctgggagcatgatcgatcttagctctatcttcagaataacaaaaaagtccaggacaataattatttttgtcctgaactaatcttaggttgtttgtagtagctattaaatcttttctaaagttccttctagttcaccatcaaaaaaactaaccaaagaaatattctcgctactaaactgattcaacatttttgccacgctttgtgtcatataacgtggagtataaatcatgccatcttctagccaccgacttactaagcccagaaatgctgaatcaacaaaggaaatctgcaaattaagtgggaccttcaactgttggttcttattcacttgctcattaaagtgtgtcatttcatttgctaaccgattgtaaagttgttcataaaagaagttattcttttcattatttaatagaacatcaaaaatatcggcgttattttcgatatactgaaacgctttgcggagtgaaaacacctttaccgtccgttctttcgaaaaattactatcgatcattacttggttaaagaaatcgtcaataatctcttggattgctgactgaataaaatcttgtttatccttatagtgaagatagaaagttccccgagtgatgttggcagtttcagtaatcttttggacgctaatatcttcaagcttttcacgtctcatcagatatacaagagctttgcgcagactattacgtgttttaattacacgtgggtctgtcttattagcagccatttaatcatcatccttccatcatacagcttaagtcctttctactttcgtacttctactgttttaaagtatagttgtcatgaaagcggtttgtcaacgaaagtgcagattttatcttaacaaaataattatattagattattaccattgacaactttgtagtgaaaattatatacttaaatctgtttggagcggtagctcaactggatagagcatcggtcttctaaaccgagggttgcgagttcaagtctcgctcgctccatataaacgttatttacaaaaagaggatagagaaacgtttttgtttcctatcctctttttcagttactctcatctaaacttacagataattttctaatttttcactttcattttttaagtatttcttaaatgcactctcatatgttacaattttgttgcaaaaatgaacatttttcataataatgaatatagagattgctttttgaggtgattattatgctaccatttcttattattgttttaattttggttgcgtcggtaattggtgaatttatgtttggcagtcttagtaaccaagaaactggaaaacatagtgcaactaccaatcgcttacgagatcgaaaagcttaatcttatattccgttcaacacaagaggccgaggaaattcctcggcctcttgtgttttatcttaatgttggtcaatcattgcttggtaagcatcggaaatttgatcaggtgttaactgccaatcactaattcccatttttagcaaaagatgccaagcatgccgaaagctttcttgttgatgattaaaataggcatcacttaagaagtgtttaattgctagatacgatttattaaggtctgctaactttgtagatcttcttgcatctgtaattcgttgccaggcttgattatctagcacaaccagatgcgtccacttcatctttgcactatacaacaaaagtaaagctactgattcaacatacgattttagcaaatcttctttgtctactttactaggattaactaccttataccaccctgctgcttcagccatatttgataaagaaatgtcaaggtcaacaaaaatcgtttgctttcttgtttctggcccaatcattaattccttttcatcatcaatctttaattctaaatcgataatttggtgaagcattttagtaatatctaacattgctatgcctccacaataaaatctactgcttattcttcctcattagaagttggatcttctgatggttctgccgaagatacttcatctaaagattcgtcttctgctacttctgtcgttgctggtgattcttcatcaacaatctccatatgatctgttctcacggctagagcggaacggtttgccaaataccactcgcgaaccaggtcgtaatgaagcaatacatcaaagaacgaaacttgctcatccgaatctttaactaagaaggcccactcttgactataatcgtccgggtcaaaagcaatgtcaagtttggtaccttgatctaatagtaactcagccccattatttcgtggtaaattcatcaacatgtaatcttcatcagcagtcgcaacaaataaacgatcaattactgtcagtggaagttcaggcttattcaacataaagcggcgatcatttgcagttgctaaaatgcctagatcaatcgtgaaatcaagatctttttgcaagtatttagcaaaatcaatcagaggtttaaccgcatcccgtaactcaaggtcagtatgctgtttaagcgcataaacgataaaataatttactaatgcgcggttattaaattgcattaatttatcttctaagcttagatagaaaagtggttcatgctgactttgctctgtaaaagccgcttctccccgactatcgacctcaaatttaaaaatagcttcaccgccaatagccgcaacagtcgcttcaaattcatggtttaattcattttctgcaacattaactgctgtatctccatgcatttttaataggtgatccataaaaatcagataatagtcagccgccttatagtgtggcggaaaattaataaacgcgtttgccaaatccattttggttagtttattagcggctgataatagattcttagcatccttagtctgggctaactggtctaaaaggtcaacatatttttgtccaaggcttaaaacatctttaaaggaatcagaaagagcctggacccgttcactaggagaagtcacgattcgattattgctcatcgtcgtccacctgctttccttctgatccatttaaactggctaaataattagcatataaattgcgattagctaattcgaaatcttcaaagctgccaaaagtatcgataatgctcttttgctcataacttaaaatcgtattttcttttgataaggataggacaacgcgttcattatccttaatagtttgggctgcattacgagcttcttcttcttggtcctctaacttttgcagctgctcaaccagttcctggcgactctccttgttacgacttgattcccaaatgccagatcgtgaactaatttcttttaattgttcttgaagggcttctttacgttcctcacgttctcgttgatgatcaatcaaatcttggagacggtcattttcactagagattttactaatccggtcactattgtaacgtttattgtcacgcgctaattcaaaagccgtccgtaatttatcatattctgtttggtcaaaagaaaaacgaacattcaaaacgtctaattcaccaaattgacggcgattccaccagttaccaaaataaatccggtagtgaccagtttgatattcttcataataaaagaagggataggttttacccaaatatttaattaagttttcactaaggtaattacttaattgatcagccaaatcatcgactaggttcattacacctttatcatttggttgttgttcccgatgttcaatctctttagcatagcgttggttatctagtaattggtagatttcccgatcacgatggtttgaaattgcatcattaaagcgtcgcaaatactttatctttgtaataatttgttgattgatgacttgagtaacatcaagtgaatcactattagtttctacactcgccataagcatgctccttgtctaaataactacctattataataaataactttactaccttttttccactctttttaaatttttttcaaaaactttatatttttagcacagatctgttttttgaaggtaaaaataaaagactttccataatgaaaagcctttattcccttatccaattattcaaatatcaatgaacccctaacgataatttagcaaaacggctcatccgatcaatcgtccaagctggttcccagacaaattccacatcaacgttttttacctctggaacctcttttaccgctttagtcaccatatcagccaatacatttgttaatgggcatcccattgtcgttagcgtcatttcaatcaaacatattccatcattatcgagatcaattgtataaacgagtcccaaattaacaatatcgatatgaagttcaggatcaataactgttgctaatcgttgaacaatatcgtccttaattgattgtttgtctctcataattaattatttttccaatacttctcaataaattgttgtcggccaccagcttcttctaaggcaaaacgctgcggatctttcttataaaagccctgatgatagtcttctgcgggatagaatggctgcgcatcctcaattgttgttacaatctttgcatcaccaaaacggccgctttcctgtaaagccttttttgactcttctgcagttttacgttgttcatcatttttaacgaaaattacaggacgataattgtctccccgatcttggaattggccacttgcatcagtcggatcagtttggtgccaataaatctctactaagtctttgtatgaaattttatcggggtcaaaagtaatctttactgcttctgtatggcctgtcgttccagaacatacctgctcataggttgggttggcaacatggccacccgtataacctgattcaactttgtcaattcccggataagtatcaaacggctgaaccatgcaccaaaaacatccgccggcaaatatcgctgtatctaaactcatatatatcaatcctttccttgattcctcaacgtttatagacgttatgttttttgactaaataccgagatttaatgagaaatatcgagaaacctagaatattttttcccatgattttcccatgggaaaatcattcaattcacaaagtttctctaacttattacttaagtataacccaatatatcaatttagattagttatctatagtgtttactaaattggtattcattcatcgccgcatttctttatgatcatttcgaaaaagaggttttagttttacagttttcggatttaaagctttttgttcgttaatatgtttatgataaatttgctcattatcatttggaagaagttctagcatttttgaaaaagccttactttcggtactaggatctgttgctccataatatcgcattaagttaattgtaaattcagcacgatcaagttcattaaaaggtaggactaaataattttctttctcccaaacattataggctgcatttgcagcaattaacgctgtccgcttattaccatcttgaaaaggttgtaattttgctaactttgcaaatacgagccatgcatcctgtttagtttgcgcagaatgcttaaactcatcaataatcttttgtaaatcagctttataaactacttcgggaggaaaataatgatcttttccagctgtatcaattgtaattgcaatattatcatctggattatacattgaatttcttaaatgaccaggaatagccggatcctcttccttactatatacaaaagatttattgatattaataattccatcaactgtaaaaccatctttttttactgctttaattccagctaaagcatctttaaagattggtacatcctcattatcttgttccaaagcattagtatttcctgtatctaaagccttttttgtctgagcaactgtgcttccataaccattcaaactcccaaatgaggcaataaattgagctaaagctgtattatttgccataactatgctcccttctttcactattatctaataatacacgatcactttttagtttttcttactttcttcgctgagcagcaattttataaatgcgttcccaccattctttatcagactgatttttacattcattaatcttttttcttaattcatctagaggaactttaagaagccaatttttgattaatctagttgaatcagaatttaaattcattgtaccaatccctactttattttcctgaaaaaattctaacaatttatatcaacctataagtttcaacataagtaatatttaacacttatattgaaaagtaaaaatatattcagctaaaaattactattctaactatataaacttcataaactcaagtttatgaagtttatattttataattaaaatttaagtttcaaatcttcgactatttatcatctaaatctgtactgatcattgataaatcaatattagatgaatcagataaatcagcgttcatttgtgattcttgactttcctgcttgttagtttctttagtctgaaaactatcttgtttgcttaactctttcggattattaaagaaagactgctctaaagcgctaattatttcaccctgtgaaaaagataaggcgcaaggaaaatcagtaattccgaacataccaatgactaaaaagattaattgattcactgattcgctaggagccgtctgtgcttcaaaccaagcgctaacttcactatagtccggtattctaattgttttagtcttggtttcaaattttccattttggatattgtcgcttttttgtccattttttaaattactattattaaatttcatttgttgatttgctcgtattttagggagtgtagaaggtaaatctacttccccatacaatgcagtaataaatacaatggattggccaatagatgaaccaagcgagttttgaatatccatccattcttttactggtccttcaatgtacaattgtaaattacgtgctttagtaactgctcctctcggcatatgcttcgctcccattcattatatatacatatcattataacaggattttgtaatctatatcattctttaggacccattaatgctttcaaaattaaaactaagcccatcctatttaatacctgagcatatgatccatcgacccaaacaattggaattatttgatctccattgaaactcataaatttattgttaagtttctcataaagccgagtagttttcattggtactgcagccccaccgaacacaaacccaatcttaatacttgttccaatcttccgtagtgtttgagaagcattacttacaatctcatcagcaaaaggctctgctgctgaacttactactttaataactttttctttactgcctggcgcaaatggattttcatcctcattaagatatttttgtaattgacgaatattatcaaatccataattcttagtttgtaagtaatcaaccgaacgttgaaggacattatcgtatcctcgcataatagaattcgaagccatgatatttggctttccattagtaattactgtacagtcacttgttttaccaccaaggtcaaaacctatcgcatctttaatatttttaatgaattgattattaattttatctgctactttaggatacttttctttaagagaattaatgatgctattagccaattcaggataagcatttggcgaatttttaatcgccgcaaaagcaacttctccctccaatcctacaaaaacatttttgaactgcagcgatacactaattggatttttaaagttgtgaaatgtaacaatatgcgtattatccatatatcttttacgatagtttcttaaaacattaggttgttttgcctcactgattggtaatgcagttgtcatatacacgtccatttttaactgattatctaaatcttctccttttttataagcatcctggactcttttgccggctaaattgcttaatgtaagtaacaaagtaaggtcaacttcagattttcctgataagtcattgtaatcaaaatgcgttaacggcattgtactatctaaagctgcttgaccgactaaaaatcgtcctgcttcactaattgaactactagtaatagagacatccatatggtttaagaaatcgtccatataagcatctttttctgcttctgagctaaattcaacgggagcagttacatctaaggaatctttcatagcaattactgaaggacattctatatcttctccagcactaaaaatttgttttgcagtttctgtaccatcactagtaaagagagttcctttcaacgagtcatttcctgcatcatttgcaaaataaagtttataagtcatttgattacctccaaaatatattcgctacatagatgtcatattgaaacttatttgttacttatattcgctaactaaattataaatttcaatatatataacaattaacacttatatattaattctttttgttttaagtgtcaataactagacaaaataacatataagcaaaaagatttgatataactagagtaactttaatttcaattaagtgaagttctgccatcaagggactaatcttatttggagataataaaaaagacgatagttattctaccgccttaatttcacatttatatcatttatagcctataagataaccttgtccaaatttagacaatgttcatttactacattaagcttgccattatcatcaatcctaatgtactagtattaaaagtaatatgcgcaataatattcatttccagattactgaagtgtaaataaataaattgaaaatataagctcaataaaatgtagataatcccaattgaggctccgtgcatttgcgcaaacactgttgcaactataaatgcactaattccaactctcaattttgaattatcaacccaagatgctaaccaagcatcgacacgatggaaaaaactcttccgaaagacaatttcttccaaaataggtgcaattatcactacgtaagctacatagattatatttttttgaagtaattttacaatcaatgatgtatttgaattaccaattatatgattattaaactgtattacaattagtaaaaatataagttcaaccattaatggtaatagccctaagcctagtgcttccacaaaatttttccaggaaagccggcgaattttaggacgcagccataatagataggatattaataataaagtaaagctaccagctagcaaatatgaaccttcaattcccgtaactatgccagcatatagccaaattagcacataaccaaatatgattacccattcattaaattttaggctttgtcctttaagccataaagcatattttcttatttttgctgtcatattcatcaccactcactaattaacaactgttccaattgtcccaatccgttgaatttgaatcaattttctttgattaccatcaaatttcactaagtaaatatcggttgttttagaagaactatgagaacctttacgtgaagaatatgatacttcaacaatcccactaacaatttgcttttgatctataccactcacataagcattgcttccatcataagatgaagtaatttgttctgcatcaattatgctatgaccagttttatcaaggccattattgaacaacttcttatcatttagcactgaactagttgcaattccatgtactctattcttacgtttaatataagtattttgactatcataagtaaaatactcaataaagaactttttagtaattgcttgtaaatcttggctagcttcataagcttgggtattttcagatttagttttgttagaacttactaaattctcattaagaacactctgacgggctattttttgtctttcttttaagacctttttacgttgatttaacatttgcttgacattcgctgtttctttattgtattgaatctgctgtagcttaaatgttcctaaacaaattagactgacaatgattactatcaagcctataactgaggatattttcttacccatattaatcaccgccctcaacgttcataacttgcttagtcactggtttaattttttgataatttaataccttctcattttgtagatcataattcattttaattagataaacggcagattgattatccatagttttaaagctaaccaccgcagtcacaggcacctgattgttaactttaactttcccataaccaatttctacaccattattttctttgaaaagccattccttagtattaggatcgacattatatactttcaattgctcagctaacttagggcctaaatcttcttcaatttgggtcttattagcattccaatcatcatttgagtgtattcctccaacaaccttgcttaatccttcttgcagtttcttagaagctgttatttcagctgaatagtaattaaaagaatcgttaatagataatttgtttgcttcattttgttcaaccttattgatttggttgttagtaatccttaattgatctttgtaataatttaattgcttttgactcggtatgcttagaacagtagcaattacacacagaatcgcaattatccataataaaatattcggactcattttcctcatttctatcacctaattatttattccttctttaataatcttgattggatcaagccaagttccgtcatcagaatatccgctttgaactgatgaagtaattgctttcttggtaatacctaaatgtagatgcgagccacttaaagttccaattttatctccaactttaatttcatcaccttcattaactgtaatatcccctcgactgttaaacgcttcttgataaacttcattgtagccatctgaagatttaacccagacgtaccaccagccaacatcgttagcaaccttaaatactttaccgtcatgcactgctaaaattggttgaccagctcctacaatcgctgaaccaaaatcgtaaccatcatggaagtcatttccaccaccacgaatcattccggtatggccatattgttgaccattttcatatctagttgggccatctttaggaatagtcttaaatggccacccccatttaccactagccgtatcaccaccatcagtattgcacgcattattttgttgatcctgagcaaccccagtatctgcagtagcggcagcaccatttaagagactatcatttgagctaatgtttgaaccaccaaactcctgataagcccattgtgctcccggatcacgttgttggccgtattgattttcattaccagccataccctcataatcaataaaccaattccatgttgcttgatgaacatctgtcgctttccctaccgatgtttttactttggtataaccatggtttagctcgtattgcattagtttaatttcattgtcaagagtcagttcacttgggtctacgctcttaataattccaccagcaattaggcgttgattttgactccactgaaataagccattataaccaactccatttggcttccaaacatcaagtcccgattcacctattgcattaccgaccgctcctgctgcgccagcaccactaaagcccatctttttagttaaggtttcaaaaatagtctttgctgccttatactcagctgaatttttatccttccaatttccattactaataccgccagccgaaattgttgcggtatcaatactactatcacagccttcgtcgctacctactagcatcgcaataattaaggaaactgcaaataataataaagtaataactcctacaatcgaaataataatgctccaaagatgaattctagtcttccttttcaaatagaatcacctcttttataacaatggcagtaatttttcaattaaaatcagtccaacaataactgccaaaataactaataaaaattgtaattttggtacctgataattaggtacgtcgtcatcttcaattagtctttgcgcctgttgatgaacaactttattagtattttctttaaacgactttacttgatgaattgatcgtcttaataagtgttcttttgagggcttagtattctccttgtctttgttatgatgaattgccattagataccacccccataccgatccccttcttctttagtgatttgaactttaaattgaacattacgatccccgttgatattcataaggcattctgtttttttaagtttagttaatccttgtagttcatcgattgtgactgatccaccaagtgctgtctttagtcgtggcaaatcatcatctgaaatttggaaaaagaagcgaatttgaaataaagaaaacattttttgtacggcaatgatatatggatcatgcgaatttccatttataatcaaatctttaattgttggtgccgccatcgtaatagcacaaaagtttttgcgcatttgttccatcatcattgtgagaaattcaaccccataggcgaacttaggattaacaatattttcgacttcgtctagatttaagtaataccaaggaataaagtcaggatctaatcgaccttcttttaataatcgccgtagatgcataccgttttttacaatatctgcagataataacgttaaaattgagtaaatttgagcattaaatactgcttgtccttgcgctaataacccttgaatgttgaaggtcactacttgttctcgcgaaatatcagggaaacgtgtaataccgtcaaacatatcccctttctgttcctcaattgaactaaaagtattggtaatgcgactcattgattgtgacattaagctagttatatgaatctttgggtcccgttctgctttacgcttgcgttcagcagcatagattacaaaatcctgtaaagttgggtacatatcatgaggaaggccggtaattttgatattcggcatggtcttacgaggattagctacccataagttctgatcaatgtaaaagtctcctaaccactgagacaaaattgtcatatcatcaccagttgcgtcatcacaaagaaacttaaaaaagttagtaagttttgtaatgtgttgagccatcgagttaatctcatcaaccgtcccatcatcattaactactgtaggaaagacctcaaatggattaattaagttttctggtttatcaagacgaataataattcctccttgatctttagtttgatcagtatattcagacgaaacatcaaaattccgaataatcgctcctctcgagaaaacatcatcattcattttcttgagcaatgtagatttacccataccagcattaccagttacaaagaaaaatgaccgagttcggcgattatcccgttggaatggatcgaacataacttccccatttgttcgcgtatagccatagtaagagccattggggtcctccaatttcacgtgattaaatgggaagaaaccagataaattttcagcatcaataggagtcccaattggtttattccccatctcttcttcagacattgtaggaacaaagatggattcaaaatcatcaagctgctcatcagcatacctagccatatggaacattccgttctgacgaattacatcgtgaacacgcttatctaattctgctaaagttggcgcatagacaaaaattcgaaagtagattcgcttcataacttcgctttgctgagtaatcttttgcattaaccgcatttgatcattgtaattacctgcagattgaacattatctagagccttagctttcgatgaaattcgtgttgcttcttcagttgcagctttagaaatttgcttaacaatctgatcacgattttcagtccctaccgaaataacggctaaagtcgatggaccgtttgtgagattaacgccccagaacggggacattcctttagagggatatttataaattctcaagcacgttaggaagccgtctccaaattctaaataacgagcatgacgtttaagattcccctgtggttgtactcgtgctaagaagtctagatcataaccaacactttcataatgcaaaatatcttttttcttcatacctataaatacctctatcgttgcgtattaagattattaattcgtgtcaaaacttcttctttcctttttttgcttagcggttcaagaaataaagcacttcctccccaattcattgctgcattccgattattccttaaaatggtcttagtttttccaaataataataggaagaaatcttctgaaattagttgattttctaccaacatatttcttcgctgagtttgatgaatgtattttaattgcgtcatcaattgatgtttccttctaggatcggtttcttgactaatcgcaatattggtccgattgtatcgttttccccaataaatcttttgctccgtagtatcaactggaaaaggacaaatgataaatttcatatcacttaatgctgcttgtagaaaatgatagaagtcatctagcacgatattagcttctcgttgtgccatcgtacccacgcccagtcctcgaatatttagtaaatcagcatagccatcttccttttcttttaaggcaagaaagtgttcaggatcatcagtaatagctttatacgccaacaaattcatcatgggcgtataagctaatttttcactacggtaatgttctaacggatcttttccgttttctttctgtttacgactaaataaaccgctatgaattttcttttgctttgtaattgtattaattgccattactctgtcgctcctttcttatttcactaaagggcttaaattcgtagtaaccatatgatttgaaaagcttactttgccgatgagtaatcaacatccaaataacttcaaagtttcttttccctgggttagttcgaggatgtaaatccaaataaaaggctagaatcaccgaaagtactagaaagattactgactctaccccttgatctgccgggaataattggtcaagaaaaatacttggccctatcactaaggccaagcatgctatatcggtaagataaagccaccccaacttgactccttctcgtattccggctactacaccataagttttcatatgttccacctcgtttcttattgatagtaattaatcaggttttacgaacaagtttcgccaaaaaaagccttctcatttccgtattaagaaacaaaaagacttttcgttgattttatttaattgttactcatcatcaaagggatcactttcacgaccatggatatgaccactttgacttaaattaaactgccgatttttgagataactagcactacgttgttctaccccttttgaaagatgagtaacgtgttgtccaaatctttctacttttcctggtcgtgtgactgctggcggtggagtaggcgacgagtgtgtggttgtcggtgcgatattagtgtgagcagtattatcatagtaatcactatgtacgcttccttcatcatagttattctgtgggttaatatttgtacctggtgtattacggttaaaggtatcgttttgacttgagtttgtcccatagtgactgctaaattggtcattgcttacattaggattattaacttgcttgctaaaatcattattagcaatattagggtcattcggatccattgtaggtgattgattcatttggtccgcccattggctgttttgtgcatcattgatgccaacagtatttgagctaacttcatttgcattattcatttgatctgcctgctgttggaaattaccgtccgctggttcattccctaatagactatcccagttgcttaaatcctgaagaccgttattagcttcttgtgaaggtgttgatgggtcaatattagcagcagaatcagcattattaatctgatcagcttgatctgcaaaacttgcgttagcaccagttgtatctggatcatcaaagttaattccggctggttgttgatcttgatcgtcaactgcctgaccattatcaactaatccttcatttgctggattatctactgtatctggggctgcagttgagttggtattgtagctgctactgcttccttgactattgccctcataattatccgatgattgactgtttccatatgaactattgttagcttgtccatagctagatgattgaccctgactagtatttgaactattaccttggttatttgtttgaccattgctagttgaagtattagtaccgtaaccgttactttgagattgtccagtagcagtgttggtactatcaggctgtccggttgaattactgttactctgtgcagagttactactttgattttctgacaaaccagtagcggtattttgtgattgagcatcactagtactgagtcccgtattattagatgcactattattagtactattagcaaagcttcccatttgtgatgaatcagtgttgttagtatcagataaaccagtagctttatcagttccatgagattgagaactattgttggtaattccgtgagcattgctcttatttaacataccaccaagcatcgagacacttttacctgcgccacgcattgcaaatccaccaacagcaccggccattgcaccagttgccattaattgcccggcttcttcactaagtccctgagatactccggtaactcgttcaaaataagaaatcccagcaaaagaagcataaccaccagctgcatagataatcgcaatcgctagactacgctcgatccagctcaaattatctggcagcttacttggagctacattaataaagataaaataaactttaataatcaaaaccaatagtactaatgacaggaaccatccaaccactgaactaagaaaatctcgccatttttttgaactccgaacactctgtgctgcaataaacggtgctgccaaattcattaaagaaagttcaaaaatatctttagctaccctaaatgaagctacgatgagcacaattcctaaaataagagactgaccaattaagccaagccagttaacagaatatcgcgaatagtagctgttcatccatttagcaaatttatggtaatcattcttttcaatcgaatagccaccatcggtttgttcatgttcatcaactaaatggtaattcataacggtctcagcatctttatgctttttatccaatcctaatcctttcatagttggttcatccataaagtcaccaaggtccatgttctcaatatcatcatcattatctaaaacgttccagttggcaacgtttttaattttgctagaatctggcttgtactgataattcccccaatctttccgaattaacgtgcttaaatcaattacattatttttgattggttgcacagctaaatcttcactcatacctttattactagcacgattaatatctgaacgcgcgctaatagcaatatctccgaatccagggattgtactactgccaccagctacacgcatcatcattggtaagatagtcaacgtaattgaaaccatgacaatatttggcaaaattttgctccactttgaagcatgtcccattgtttgcatggctactaaaatgattgccaagactaataatgaccatccaattgccgaaacgacaacatacagaccatgcaacggagatctggggcttgataaggttccatcccagcctaataagccaaacatagcatcaaatatcttttcaaaactctcattgatatgaaaaatagtttgaactatcacattttgaaagaaaccagcaacagcatgcaaagtcccccaggataaatgaagataatttcgccaatcttcataaaagcgaattattttcccagtatcaccatctggaatactagaatacggtccaccactaaccgcttgatctaaactacttgaattgatcgctagtaatgataagcataaattcttaatcaatatccacatctattacgcccccttcttaaattgattaataaagtcaatagcattttcatataaagctgaatttccttgaaatagatcttctagttcagtgtaactattatgatttttccaataattataagtgtcctgaaataaccccattgcaacctcttttggttggacactatggactaggctataaatgttgctgctaagacttcttaagcgttcatgatcatttagttccgtatcagtaaaaattaggtcatttgaatctgcatgcgagattacatcatcattaacctcagtaggaatactatcgttaaactgagcttcaaagtctttcataaaactgccgctaactgattcctgtggattaccgcttaaatctaaaatttgtttataggcgagatcataattaattcgcttctcttttaaatctaatcgtcgatgcaaagaaacaattctgatatctgacaaggtagtttgatcgttgaattctttctgtaagaaggtatttcgatatggcatcttagtctttccatgatcaaaaatcggtttggctgaaattgaattaccacgttgatctattcgataaactgatcgtaacactaccatttcaccacccatgaattgcattaattcaggaaccgataaaatatcttgactaattaactgactattaacactagcactgtgccagtttccaacttggccattaatattttcaacagagactgtccgcttcccaattcgtttagaaatactttcagcagttgtcgttgaattggtcaaaatatataaaatattagaacagttgctttcaatggttttagcttcctgttcgttataatgaatttgtaactgttctagattttgtacgacaatatcaaacatcatattaaaacctaaacaaatcgaaattttcttagtcatatcccgaatggtcggcaattcagcaaactcatctaaaataaaatggacgcgacgaaatagctttcgcccattgctttcagccattccatataaaatattgaaggcttggtcaattgcaaacgccggtaattgattatatgttgagttattaggcggcgtgaccaagaataaagcaacaggtgcttctgaatatttaagccttgtctctgattctataagttccccagaaagttgattgcttgtcactttaagtgaaacatccttaagaatcggcttcttagtataagggtctaatttaaactttctccctaatccttgtttagcataatttttgtgaccttgaagtacaacttcttggtcaagcacatctgctgaattttttcgataattgaaactgattttaagtagaaaatcatctggcaaagtagtcttaattgcatattgaagattcccgaccttatcaattagctgtgtacgcttttccaacttatttccatgaagatcatcaaattcaacaactgcagtcttaaactgatatttcggatcagaaaattttactttaagcgttctagggaaaccaagcttagtaaaatcaagcgaattcaaagaagtcattttagcaatatcggattgctgatagattttgattccttccattgcactggagtaaatattcccagaagtttcatcaccggcaaatttactttgagcaaacgcatctaaagccatttgcctaaatttgctatagttcttttcgttgagcttttgcaatttagcaaaataaactaataatttattcttttgcgattttggctcattgtcttctggcatttctaaaagtccactatctacttcatcatcagtaggaataatatctccagatgaatttagtaaaacttctttagaacctaattctgtcatcatatgaaggacattatccatcgtgacttcagcccagttattattgcgtttagcatgatcaacaactgccaaaattaaagcatttagtaaattaatcgatgaattttgccaaaatttatctttggcattcggatctacataaatacttgaagaaaggctatttaccgcttgctgggtctcgtcatagtagccgtctttagcataatcaataatctgttgtaatgggttataactcattgaaaaatcaggattctgaatgttaagaacttcaacctcatagcctcgtttacgtaaggtctcataagacatttgataaagttcccctttggagtcattaaccaccattgaagactttttttgtgcgcgtgacaaaatatcgatcaatggcataacttccgtttcccctttaccagaacgagagataccaattaatagactattaatagttgtttgatcaattgagtaaaaacctttagctggttcaacaaatttcactttcccttttaagccaggaaaagcagataataattgtaaaagcttaggacacagataataacttgtgtaaagccctggatggtacttaataaattcagagtttggtgtaatatgtgcaactgggattccaccatagcctgggaaagaagcgccccgatctgcaatctgtggatattgccgaagtatttccttttctgtcgctaaacgatcgtttccatattgtgaatgtttagttggcttccagcgaattctcatcttaataatcatcggaaccaggatcaaactgaagaaaagttcaattccccagaaaaagccaggtgcttgatgcattactcgatagtttcctaaattactaaactcccagccggccaccactgaacgaaaagagtcttgagggataattccattgagaatctgtgctaaaaactgtccggaggctggcgaagttacccaataatacgaagcactaattccactggctaaccagcaaaccacatagctcactacaatagagtaaataagccatattccaattagaaatatcggtgatcctaaaactttctgatcctgtccgtctttacgatgacgttcacgatcataattttttgccatgacctaacttcctttcatttaaattccatcacagcataaaaaagttacagaaatgtttaagtttcgccaaaaaaagccaaccattttaccggttgactcacgttttacttctttcttgtttttaggccaacataagctccaattgcacctgctagaattaccaccccagtaacagtcaagtaaaatgctagtgaagcctctgtactaccatttggattcatatttggagcagtactaagattattagctttattttcggaactcacagcactgctactagcattagaactactatcagttttatcacttgtagttgcagtcgaattactgctagatgcagcagcaatcatattagatgtatcactagcattattcttggccatatcttgaagctcttctaatgtaattccttcaatagttgcaatcgtttctcctttagaattaagtaatgtaatttttagcggatctgtcatcaatgttttgttacttagcgcagttgagctaagattaactttaaaactgatattgtcattttttcgttgtattttcccagaatcaacagtttgatgttcctgggagccatcgctatcagcatcaatatcagttgctacaaaattaagcttttgatcatttccctttaccttatttgccggtaactcaatcttaattatctgtgaaccatcgtcattgttagttaccgtagcattaagattggtgtccttagtcttataagtatctggtgaagtaatttgaactgtattattaatatcttctgcgtgaacagcaattggagtagctgaaattcctaggcctaagatacttgtggcaagaagtgtattgagccataaacgtttaccaacagaattttgagtgatcttcttttccataccaaaaaccttcctgttattttattcaaaagtttactttgaaaaatgccggtataatcgcctcctttatccgacaccctaattaaaaaggactaatttatttctttaactttcgccaaaagaaaaagccagcacataggctgaccttagtgaaatagatttatttattggcttgagcaaccttatcagctagttgattattattagctttcattaataagctctgtgcctggctagcacggtagcgatcattcatattcaagttgttcattttttgaataacatcgtttgcctgtttcggatcattagcaatgatagccttgtccaagttatagtaagtctcagtcttgtacttatctaactcattggcattgttgctatgtaatgcagcaactgctttagaattaatttgatcttgtgatactgtacttaatctttttgccgctgcaacccgatcatgcatttgttgttgaagctgtgcaacttcttgttgatgttggtggttttgatataccgtatatccagcaacgccaactacaattaataatagggccactacaaatcctattaccatccgttttacgcccttaaccatactagcaacttgattatctactttttcttctgattcagctgttgtttgtgctgaaggactagtttgcggggtctgaatcgtcactgattgtggttggttcattttttgtaaactttgtgccaaaactaactgcataatatcattaacgtttttactattttctttgttactctgttctattcgtttattagtattttcctgttttaaaaggtcaatttcttttcgcaacgattcaatcttattatcacgagactgtaactcatgttttaagttaataacgtctttattattagcatttcttgcagcttccgaagtacttaaacgggcagtcaaatctgagattgtcttatctttttgttccagtttttcatgcggatattcgactcgactcaactcagcctgtgaacgattatgagcaataattgtttgccgtgcattcatatcttcattggtaacgttagttcgagtactatcaagttccttactgcatttctttagcaattcttgtaatacttctgtcgcgtgagcctgaacttgactagcatcttcttgagcttgaatctcataatggcgatttaattccgcttctaacttcttttcattttcgttaacttgtttttcgtgatctttccaagctcgatcatagcgatctagggccttgccattatattccttatctaattcttgttgggccatctttttctgtgttctagctgattcgtcaatttgttctaaagtcttttcataacttcttttagcctcagctttatcgacatttgcttgattatcaatttctttatttttctttgtaagggcttggttataatcattctgaatacttttttctacttcatcatgaatggttgctgcgtcattagcatgaagtttattgtattcagctaatttttcttgaatattttgtgcatagatatttctgcgacctagtagatatttttcatttgagctattgagtttattagctgcttgctctagcaccttgtttaaggtttttttcttttgatttacttgatattcaacatagcccttatgacctggttctaccggatctagaacttcaacagcaaactttggtgcttcaacgtaccctttattgcgaacgtcttcaatcgttttagtgactttttcttcaacgctatgtttctctttccgagaattatacgtatccatcttctttgcgcttggcttatcgttatgattttgaattacttgttcttttggattagacttctttatcataacggtctgtgaagtgttctccggataactattagattggtcaccttgattagagttagttgtttgtgaaaccttttgattattattcataggcactgcttcagaaaattttcctgagactggatcatatacaggcgctttacttgcactatcattttctgttttttcaatattctcaagcgctggaattgaaagagttactctacctttttgtgtatcttcttcagttggcaaaatagcaatgttatcgtcagtagttcctgtggaatcttgataagctgttttcaattcctcacaataatttatcttctcatcataatcgacatctgaattagagggatcattaaaaatttcttcaaagatactcttagtcaagttctggtagtcataatcaatactaaaattacttaaagtaataaattcatgaggattcccatccactgatccttttttccctatttttgctttttgtgttttatcaaattcccaaatggcaaaatatgaaaacgtaacaggcttagctgttgttgcagcaagagtccgtaattcatcaaataaatcttcagctgttttaaaggtagcgaatggtaaagtttgatttaatggagcgacattttcattttcttcactctcggatacctgctcaataatttttcgaatttcatcattattttctggtgcaaactcatcatcaaattctaagcgaacggtgtatggatcatccagcataaattgatttttcttttttaatttcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtttcttaaaaaatcccattatttttactccttcatcgaattaatttacattcttaaatttatctgctatttttcattacacaactttcgccaaaataaaaaaagacgccatgaatttcttcatgacgcaaagcataatggcaagcgattaagcaccaaatgattgactagtataattcttcaaaaattcaacaataacaaaggcaatcaaccctacaactagtccaacagcagccttttgccacttctttttaccagaccgtgcactttcttccccacctgatgtgtagagaattgctccccaaacaacgataaatacagcatatgctgcaagaatgaccattaggccccgtgacaatttattaagtaaacttgaggtaccaccaattggatcagcaccaagagttaactcattcattgctttggcatatgcggttgggaaattagtcattaaaaacttatccatcaaaccgaataacctccttaaaattaagatgtcatcaatgattgttgatgatcagtcatcagtttaaggaggtttttaatttatttaactttcgccaaaacttactttttctggtcagattcaataattttatcttgattattttgatctaaaaaatttgtagttggaattctttctttagcaacttggaagaattcatctagttttttaacactatctaattgccaatatttcataagtttagttgcaaattcgtttagttgcttatccgtctcttctttttgtaaatcacgcagttcacttttttccttagctaatttctttgctagttctttgatgtaattttgctttttagctgttttttcagtttctaacgttaattctttctttcgagccattaaaaattcgtctccaatttctgttatttactatctggaatcaatccaaaattgattttgcgaccgtttttattatgatgttgcaatttactacgttcaaattggtcacgaggatcataaaccttagcactaattttgtggtaggtattatcagatttattttctaattgcaaaataatcattgaaagtggcgctgttacttcattttcaattgttctttcaagcggtcttgcaccatttttaacatccgttccaatatcagctaggtactcaattaggtcattgccataagcaaattgaaagccatgttctttcaagcggtcatttaatatttgtaagtcattttgagcaatttgcttaataactggccggggaagcatattaaatacaattttatgttcaatccgatttacaaattccggacgaaaaatattagttagttccatattgactaacttcttaaatgcagtatgcctccgaatccgttgacgttcactctggtcaatttcgttcccttcaatcgttttctcacttgattggcggtcattgattagttcagctgcaatattggttgtcataatgataatgacatttctaaaatcagttgatcttccaaaccgatcccgtaattcaccagcatccaggatttgtaataggcgatcatgaactgctgaacatgctttttcaatttcatctagcaataaaatacaataaggtctgtgttttatttgatccgttaatagaatttgaaaatgatttagggaatcgcgctcactaaattcagacatatcaaacctcactaaggcgttttcgctatcaaacataaccttagctaattgcttagaaagtgctgtctttccagttccagtcgttcccaagaataaaaaggacgctaatggccgattaggtgcttgcaaccctgctttggcaattgtaatcacattagctactgattgaattgcttcctcctgtcctttaactaccttactaagtttatctttgatattacgtaaacgacttgtatcattacgcaaaacattagtaatgggaattcctttcatttcctgcagtactaatgctacttgtttaatatccacatcaaccacatgattagtagcagcaattgcgccagcttgatcaatcaagtcaattgccttatctggtaaatagcgatctgcaatataacgaactgataaatcaaccgccccagcgatcgcagaatcatcataatgaacgtgatgataatcttcatagtttttcttaattccattaagaatcttgattgatgtattccgagaaggttcttctacttttacttgttgaaaccgcctttgtaatgctggatcacgctcaatgaactttttatattcatcaattgttgttgagccaattaattgaatatctccgcgagccattgctggttttaacacatctcctaagtccatggctcctcccgtttgatcagcacccataattgtatgaatttcatcaataaaaaggatattttccccattagtttgtttaaattcattaatgatattcaacattttcattactgtatcttgttgtcccagcgctgcaatctgaagaactcgaatatgttttccttccagttgtttaccagctttatgtaaagcaattaatcgagctaatccttcaataatagctgtcttccctacaccggcttcaccaatcaagattgggttattcttagtctttcgattaagattaataatgacttgcttaatttcctggtttcgagcaacagctttatactcatctggattcttagctgccgctacggttaaatcatccgtatatctatcaatattaggtgtcttttttaattcttcagtcaattactaacaccccttactatggctgacttaataacacagcttctaacaggctatcagtcttctttagaattttttcatggttctctattccatatagatacgctttaattttgccgtgattcttctcaaaagttacaatgatctgtttagtaataaatggattatcaattaaccattcttcttgattaatttgattactaacaaaccaaaatgaactatcaagacccgccttttttaattcgctatcaagttcgtaaaatcgcaagcggcttagattactctttggccatagctgcttgctccagcctattggcgttcttattttagtatctaaaacattcaataacgcttcttcactccagcgaaatgcattgactcgtgagtactgattaattcgctctgcagtttccgctaaatattctttttctaactccatcacaattccttttccttcttagtattacaaactaaggccttcatcatcatctcggccgccaaaataatcattaatatctatatcatctgctggttgatcagtatcatcatggcctttagcctgttcagcctgctgataagactcatcaatttgcgagctgtcgcctaaatcaaccgtctcctcttctggagccgttttggttgctgtaggtttttttaactggaaatcacctttatcaggagtagttatatcgtagttattgatattaattgttgaatcaagatcctcgtcactttctggctcatactgcgaaacaagatcattcatgctagtttccgtttcattatcatctttttttacgtttcttaatttaattggtggctctgactctgattcttgctggtcattattattgcttgacgaattttccgagctggtttgagccggttgcgttgtcttaccaacttctaatactcgtaatttttcttgtagtttatcctgtaattttttagctgactctattttctcatgcaattttcgattttctgatttgagcttttcaataggttcgaaatagtcaccttttgatagataaagcatactattaatttcttttgcatctttcagcttaaagattatacaattcagttctttgataatgacctcgtctaaagttaatgcccaagtcgaatttaattgcgctgaatgcgcaaagaacttttcatattgattgtcactaactaatatctttaattgagatccactattactttcacattcaaaatctaatagcacatcattaccctcaatttcttgagactttagtattcctgtaattttcatcatttttatttacctcgctttttaaaatccggtataaagccaataaattcccgtcccttatattcacttgggccaagttgaccactcaaattacctttcttatatttgaaagtaattattttcccagcagataaatcctcaagttcctgatctgtaaaagtatgagtaccccacttacgactgatctgaaccgcttttccttggaattgaaccatcactttctctttcttttcatacttaactttctttggtgcccctagaatatcttttaaatgcttagcgtttcgctgcataattggaatatcatgcttaataacctgagttactgtatttaggactttatttgggtccatttcaaatttagcaactacattcattgcatcaaataactgtgcggtgattttaggtgaagcaatataagtgttatagccaattaaagccgacattaatccagtatccgttagatttaacttagctccttttgctttcaacaggccattattgctagtaattgcagccaaagtactttgttgagttgctggcgttccaatcccatattttccataagtagaaagtctacgatatagccattttttggttggccaagcaggcttaggattggctccttcatcaataaatgtaattgcgctgctgccaattggttgttgttgcttggataaattatcttcactatagataagacgataattatactcgactggctgattaaagtgcgttacaaagtccggataattaactacgcatgcttcataagaatcataaacataatcttctgcaagaatggataaggcactagcggctactaatttataaatatctaccgcacaatcttgtgctttttcacttttaccagagactgccttctttagctcctccattgtttcaggaatcttttcaccaggccgattagccccatgagtcgctgagtctttaacaaatttttctcttggttgtcggtgtgttaaaagcgattgatcgacgttaattacagctgcgatttgatcagcattattcatcaactcaataaactggtcattagtaatcaccttgtctcctgttcgcggataagatagataatgtttttcataaagttcttggtaaacttcttcgaccattgcagaagaatacccctttgctgccattgcactatcaattccggtcatatcaattaatgtattagggacctgtttttttcgtgtacaacttaataatttgacttctgcgggcgatgagtaagtgctttgttcttgtttcgctagtttaatatcagcatgacgaatctttttaattagttcttcgtcttcttttcttactttgcgagcatagacatggccattattatccttaaatttaacttcgtagtaaggctttttttgataatgcttgattcgctgcagttgatcaaaagtaaaagcaagcattactgactttaatcgtccttgattaataacttttacccgataaccttcactacgagctaatgttgtagaaacccttgttgcttgcatagacgcaaaatcccatcgctgccgtaaaaccgctttaatgtagtcaccatcttttttctgactagaaatatctcgtaaattccttaatgctttttgaattccctttttactttcatcatcatgatattcacgataaactggtcctcgccaattgatagcattaataatttcccaagcaagaagttcaccttctccgcttggatcattatcagttgcaataacaattgcttgtgcttgacgactctcattagcaatttttttaatcattttctgtgctgatccatttttcgctttttttcgccatgttaaatcttgtaagttccagggcaaatcttttaactcccaagattcatatttatctttcaagtttggtgcaacttgatctactggatctaagaattctagtaggtgcccttgagcatgagttagttgatatgtatggccattaactgttcctgtttctccaccaagagcagcgacaaagttatcaaatgctgatttcttttcggttaagattaaataatcaaacataatttcacctgattttcttatttcaactgaatttaagatacagtagctattgatttaccaaagtttcgcctaatttcgtccaaatttggacaaagtaaaaacgccatgaattttttcttcatgacgtgatcatttgaactttaacgttcttttcgcttatcttcaaaatgttgtttaaaactagctttttgtggatttactttattggttattgctttactgtttcccatattaccagctagcatttcatccataatttgtcgaatccgttttactcctaattctttagtcttacgattagcaaagtcgtgcatggactcagcatagtattgcttgtcattaagtttcaaggcatcgttccaatctttattattgctgttgggctgatctactataattttcatattatcccaaccttgttcttttctaagtgtttcaagcctcccattaatgcgtataatacccttcaatcctgctgtatcagtatctaacgctaaatgaatttcatctggaacaccaaatttagttatgtaattactaacggtatttaccttggtagcagcaccattaagcgatagaaaagttttagcacctggttggttaccatgcatttgaaaataggacagcatatcaattgggctttcaaaaatatatagctttttagtgtcatcgttttttgaattggcattaaaacgaaagccaaattccctagcagaaccttttgcaatcattttaatggtgccacgtttcccaaatcttttatgatcaactatcgttccctgcacatcaccaccaatttctttcatatttttatctctccaggaaaagaatgcactaccgttacgtaattgcctaattaagccatgtttaatgagaacttgaatcaagcgctcgtctaacttacgagttttagtgaaatagttaatcatttgttgattttgccgactacctggccacttttctggttggtattcaactacctgataatggtgttgtggtgcctttgctaattctggagctagtttttctaattgatctagtgctattttcttttctagtccttcatatgatcttaaaaaattatacagatttcctccaacgccttgcgaattccaatagaaagtctcgtatggcttctgtgaggttattcttgtatcgacaactagcgaatcatgatcagttagtcttaaataatagccttgtttttcataaggaattcctttaatatctaaatatttctgaatagattgccgacacaatttatctacgtttgataatttctcttctgtaactgcagccattgttgatcacctctccacccgcattagccgttgcttttggagaagctgattaagtttatcaggacgaaatcccgaccattcttctgtatctgtaatgactacaggcaccttaagatgccccttatcatgaagactcttagcatactgaggactttgagaaagatcaatatcgataaatttgatgtggtgaacgataaaaaaatgcgtagtcattagacaagctttacaattaggcttatagaaaactcgaatcatgggttatcactccttaactttttcttcaaaagtaaattggaatgagctttttagtatctttcgccacactttaactggtgtaaactttgtatttacataaatgtaaataaagtgtaaaatagaggcaacaaataaatagaagggcggttacatcaatgttaaatttatataacagaactattggcagaatagataaaggttatattttttctcactatctatcagtttattttgttatctttattctttataactttactgataaaaaagatggtatcttttgtttaattctatgtgttctagcccttttttaccctttcgccacatttggatgggattatttattccaaaattttaactccaacgtattcttttttactggctttacttttattctttggattttctggaagattagtaaatttttctttctactagccttcgcaccattaatcgctattgtagttttattctttatctatctttcaggaaaataaaaaagcgacagtaaccaaataccaccgctgaaaaagctatttgaatagtcgcatagcttttttaattaactttttaatgtgcttattagacacaaatgcgtcataaggagttgcctcctctctgcactagtcaggtttcctacgcctgctcaaatgtgcctagttattgggccatacttattttgtgttataatatagttactaatatgataaggccgtgtgttgtgggtgctttctagctcacaagtagtcggttgagagggcgtcctaataggcgctctttttttatttattgtctgaaaattaaatttaagaaaattatgtacaaattcacagtaacttaatttacttaattgttttcattacctgttaagaattcgttgcctttgccgttgttgaaatcctctagcaataattaatcttttaaccttctcatttggattaggctctaacgctaaggcttctatgcaagcacattgttgttctaatggcagtttagcttctaaagctaaccaagtagcagtgtctctattcattccggcttgactgaattttaattgggttaatgataattgatcaattgtgtttttcataatcttctccaaaaagtgattcctgataactaatcttcttattctttttgctaaatgtattcctaattaagtcaattgctgtttgataatacatccactgagttatttctttacttgaataacgcgatttactagaaacccaccggccatattgattacatgatgttttagattttatttttaacttattagcaattcgtccgatcatattaggagtagtcccaatcatttttgctacctcactagcgctgtattccttttgctgagtaattgacatgaccattgtttcattataaataaggcctggcgttgaaatatcaatttctttaatcgaatagttgcttttatcccttgtctcaagtcctaattcttcaaggagatagtctattgcatccgtttgagaataggcagttactaagtaatataacttattatctgagattcgataaagttttaggctaaattctcttttatccatttttaatcccgtccaatatcaaaattgctctatatattaaaatccactattacactaaaggagaaaaaaagaagtttcgccattgacactgttcacgcaaaaaggcccagcaaactgctgagcctttttactttaaaggagatatgaaatttttatgtgtaaaacaaactaattaatttcgctttttcttaagactaaatgcgcctagacttactaggaatccagctaatccagctgcaactaatccactttcatttgcattaccagtttgtggcaatgcttcttgaggagccgcagaacttgattgttgtggtgctggagtggcaacttgagcaggagttgctactgcagccataaccggttcttgtactggcgttacttgtggagcaggagttggtgttggggttgtctttggtgtttcagttggcgtaactggagtttccggcgtcttaggtgtagtagatggtgtttctggcttcttaggttcttccgtttccgtagttgttgtaacagtattagaactaaagtcaatgttgttaattgagtttgtgtacttgttttgtactgttccactctttactcgcttcatcttaagataagctgttgctccaaacgatgacttagaaagatcaacgcttgccaagaagtttttatcaaattcaatatcaactttaccattttctgtatcaacaacttgtgttgtgtattttgtaacatcggtattcttcttaagcacagttccatcttttaacgtaatatcatcatttaagaggactgtataacccgcattatattgatcatgcgtttcatcataatcatcgtgaaaaccatattcattaagcgctgttacactagccggcaattgtgacccaaccaacttataatcaaaacgttggcctaactcaatcttttggccattgagacccttttgattatcaacactaattactacatccttcgttggatttggtaagaaggtttcaatccaaggagtattagtcttaaccgtatgattattgattgtcgatgatccagcattctcaagtttagtaccagatggaacatccttgtgaatgttaaatgttaatagcaattgtgcattaccgcctggtgtctttgcagggtctttccgcgttgcgataacaaaaccgtcacctttttcaaggttatactcactagttgctaacttaccattctcaaggacttgaacatcagtaagatcaacatccttagcgaatttcgaataatcatctttgattgacatattagtaagtggatcagttaattgtgatgggtccggtaaggtagtagtgaccttagcatgtgctacggatccatcaataactacccggccatcaacaatttgatcatcttctacccaatgtttttcagcttcttgggtataggtagtaattgatggtgtattagttggaattgtctcatcgttaattgttccggaaccgtgattttcaagaacagtaccattaggaatatcacccttgatcttgtagtcaaccttcattgaaacttggccaccattaagattttcagtgtcattccgagttgctgttacatgaccagcaccatcatctgaaacagtgtagttagcagtggcttctttaccatcttcataaacatgaacagctcctggttgggcatatttgctgaagttagtataatcgtcggttactgctaccttatttaccccttcgctagtttctggaagttgcatatcaacttgtgaattgatcttgccattagctgaagatacatgagtttgaataaaggaagcattgaataatccggccctagcggcaaaaaggttattgtttaagttaccagttgctttagtgactaaattattagtatctaaggaatccttagcattcattactgcctgcatagtaactggcaattcaccttgatgattattaaccttagatgggtccttgcgggttgcaacaaccttaccatttggatcaatagaaatatcatactgatcagttacatctttatcaccttcaaagacatggactccttgcacttcaacatctttagcaaacttagagaagtcatcggttaattgaattttatgaatcttactaccaagagttgaggacttaggaagggtcatatcaacacgagcagtaacaactccatcattgattgcaagcttattatcaactacttggccaccattattaacccaatgcttatctgtatcttgagtataagtcttaatttgacgatcaggggttggaaccaggtcatcattaatttgaccagaacccttgttagtaagaactgttccagttggaacgtccttatgcaaagtccattgcgcccgtagaattacgattccgcctggcgtcgttgcaggatctttccgcgttgcaatgatttgatgatccttagtcacttcaaagttataaagatcattagcatcttttccgttttcggtaatggaataccccttaagatcaaccttatccgcaaagtccgcaaagttatcaattacttgaaccttcttgagcttttcagccaagttctgtggctctggcaacgacattgaaaccttactgcttacattatcaccagctatgaagaccatattatcaacagattgatcattatcattggtccaatgtttatcggtttctggagtaaaagtaactacatctggtgtattagtcttaacgcggctgcggttaataattccggtacctttgttagtgaatttagttcccgaagccacatcgtgattaactttccaagtaacgttcatggttaaggtacctgcaggcaccttagatggatccttacgaacagcagtaatcacgccatcctttaaggttacattatattcggtactagcatcttgaccattttcataaagtttaactgttggtagtccaactttatccttgaagtcactgtaatcatcttcaattgctacatcttctaatgattttgctaagctattaggctctggtaatgacatcgaaatttctgaatgaattacatcatcattaataacagtcttactgtcaacatcttggtctccagctttccagtgcttttctgctgtttgtgtaaagacataaatgttacgatcgggtgttggaactagatcatcattaatctgtcctgaaccacggttagtcaagaccgtaccgttagggatagcagtattaagtttccagttagctttcagataaactaccccacccggtgctgagctagcatctttgcgagtagcagtaacaattccattttcattcttaacatcatagagtgaagttacgtctttatcgccttcgtagacattagcaccctcataggtaaccttatccataaagttacgataatcatcaataacgataatcttagaaagtggtttagctaactgctctggttctggcagtgtcattgagacattcccatgcacttcatcaccagcaacataagtcttatcatcaacgtcttgattaccctcaacccaatgcttatctgtctttggggtaaaggtaacagtgtcgacagtaggaacgtctacacgactcttattgatcaaagtgtaaccagtattgcttagtttagtaccactggcaacatcatgattgatcttccagtcaaccaatagtttagcaatgccacctggtgctgagctagcatctttgcgagtagcagtaacaaaaccgttattatcaactactacgttatattgatcagttgcatccttatcattttcagttacacgataactagtaaccttagccttgtctttgaagtcagaccaatcatcaactaattgaatttcgccaagctttttagctaattggcttggatctggtaaagcggtagagatttcagcatgaatcaaatcatcattaatctgagttaagccatcaaccttgcggtttccttcaacccagtgcttatcactatcattatggaaagtatagattgttcggtccggtgtatttacagttttaccattaatcgttcctgacccactgttaactaactttgttccactaggtaaaccagtatgagtggtccagataacatttaattgaaccttaccagcaggtgctgcaccagggttcttgcgggttgctgtaactaccccattctcgttaacaatgttatattgatcagttgcatcattatcattttcagttactgttgctgacttgtagtcaacatcattagcaaatttagtgtaatcatcacgaataattacattagataatggtttggctaaatcgcttggatttggcaaggacatagtaacttgaccattaacattgtcaccatcaacgtaagttttatcatcaacaacctgattaccatcaacccagtgtttgtccgtagtttgtgtataaactactacataaggtttgccggcttctactgtatggttgttaattcgactagaacccgtatttactagtttagtaccagaaggaacattatcattaattttccaaactgctactaggcgtaaagtgccacctggcgctttgcttggatcgtttcgccgtgccgttaagtgtccattgttatctgttaccgtgtattcactagtaacgttgctgttgccttcccatacttggtaactttgtaatttagctttatccataaagttagtgtaatcatcatcgattgacaggtatgttaatggtttagctaaactattagggtcaggtaaagtagttgtaatgtttgtagttgctacatcatctgcaatataggtcttagtatcaacggtattggaaccttctacccaatgcttatcaacgctttgcgtaaaggtaacaattgctggcgtattagtctcaactgtatgattgtttagccggccagatcctcgatttactaacttagtaccattaggaacattatcattaatcttgaatgttccgattaaaacaacttctcctgctggagctgctgaagcattcttgcggacagccgttaaatgaccattttcgttagtaatattatattgatcagttacattagcaccattttcccataattgataagaaagaagatttgtcttatcagcaaaatcagtatagttatcgtcaattgacacataacttaatggtgcaattaaagtactttggtctggcaaagtcatatgaacttgagtagtaacaatatcaccgttaatttcagttttatcatcgacaatattcttgccttccatccagtgttttactgtttcttgttcataggttttaatttgtgcatcattcgttggtacagtttgatcattgatagttccggatcctgaattttcaaagacagttccagttttaacatttggcttaatcttaaagtcaattactaaggaaactttaccaccattagcagattcagggttctttcgtgtagccgtaacctgttggccattattagtaatatcataattacctgtcgcaagttcttcattctcgtaaacttgtgctccagcatagtcaacattattagcaaatttggaataatcgtcagtaaccttaagactatgcaaaccaccttcaatctgatttgaaccaagataattcatatcaactttggtagttaccacatcgtcattgattcctaccttgttgttaacgctttgaataccattaacccagttcttttcaggcgtagtcttaacatttaagtcatgaagttggtaattgactggttgatcaccaattgtagtcttaggtaccatcactgggttgtagtgatagttggctgaagtggtatttagtttgggtaacgtaacagtagccaccggtgcagtttcaccccattcggcccacgctgggtctccataccttggataatcatgctgaatgcttgttccagaacgatcataaattgtgattaagctccaagttccgtctggattctgtatagcatcataactgccatgataatccttaatagcctttacttcttcctgcgtcttattattgtgcgcgtagaaggcaagtgatcctgggaaatatttctcctttaacgagtttccgtctacaccagttgcatctccttgtttcccaaaaggccatcttgttggatctttaactggtgcaggatcaattgcacgtttaatgacataagtgtcccagaagccgccacctgttttaggtgctaatcctgatggaatcgttaagtgaacgttagttacgacaactttcttacgctgtaagtcgtagtgccatgtaatatcataagttggatgagcattcatgtatccaccattatcccaattaacttgccctgtaacgtgttgatcttttgctaaatcatttaattgagattggtatttagcatagttttgtttctgagtatcgatagcattttgaatactctgagcttggtcattattgctttgggtagcattattaaccgcttcttggataccttgtgtatcagaagctttttttacagtggtttgatcttgatcatgtacaacagttaatccggggattgattgtgcctcttttaccttagcatcaagttgggaagtatcccccttagagccgttaaagttattaacattggacacttctgtttgatgctgtcgagtaatcgtttgaatctgttgcgcttgcttagcttcatcattttgaatactctgcttggcagcatcaacttgatcctgatttacagtctgtgtagttgttggttgctgatttacagtcaatccagcttgacgagcttgatcaacagcattattcagttgcgaatgatcaacattaactggctgcgtaattgtgccagcttgtccagatgttccacttgtagtagccgttatcgcattaccaccagtagcagtttgctgtgtgttattagctgttgtggttgtatcagcatgtgctgtctgcaactcacctgcagcaaccatcatacctgccattgataatgtagtaataccagccgttagccataattttccacctttatacatcttgtaatgtgtagatgatttttcgattggaataacttttgatttttgtcttacaatcataaaaaaaatctcctttgcaaattaatttatttttcaaaggagaatttattctatttttctatatttcaaagtttcgccaaaatttagtgttttttcaaactatttaagaaatcattctaaaatcattcgtacaattgccattaaatatttaaattataaagataattaattgagttactcagaaacaaaacaatgatgaatatcagcaagaattaataaaatggaaaaatagtacaccaagtaatccaaatggtgctaatccaaatgaaattgttcaaaatttagttttgcaaaatgaaccaaatgcttcagttgatatatcttcaaaatatctgattacaaaaaatcatgttgctgctgatggcagcaaatatgatacgatagacttttcttctgctggaaataatcagaccggattaatcggtacagtaaccttcactaaccttacacattcgttttatatagacgaaactggtcaaaaacatgccatcgttaaggaagtagtaactttaagtaatggtcaatctattggttcaactgcaaataaaatgttgcaatctgttcatgtattcaataatccagtcaagtttataaattataattctggacagattgatacggatattcagtactatgatgatcagggtaaattaattgatttttcaaaaatcagtgcttacatttcaccaatgtctcttaatggcggtcgttatgactatatggataatggagtagaaaaaatgctggaaatgtttttgaagcgtgccaagttcttgctggtggaaaagcctttgcaatagcaggctcatcagttaagcttcataacggtaacgacttttatgctgattcagataatcaatccaagcagtggggctcaccatataatttagatgaatgggataaaactggttcgccaatgcaatattatggtgctggacttatcaagttaactggtacaacgttatctctacgatggcacgcacatgcaactagtgatttagctcttcaggcatctcgaactaagcgaaaagacggcgttattgatcttaatgctttccctgatagaagtgtttcgggcgcttgggctgaattaacaaccgttattccacaaaacggtagtattccacaacgaaaaactactgaagtacactatcactacaacccatccgctattgacttatattttccgaacaatatagatgatttagtgttttaaaacaaaaagagcgcctattaagcgccccaaccggttcggaataagtaaccaactgattccgttttgcactccggctaatcattctaatataaacattataacatactttttttatggtacaataattaagcactctgagactaccaatctctaattataagtgcaactgggggtgaaccccatgagccatatttggccaatcattctaattgtgcctagtaagcacattaaacatctaattaattggttactcaagtagtaatcttagcgctgactttggttggcgctttttattttgcggtatgaagaaagaaactattctcgtctattgttcgggattataagcgaatgacggatgggttgtagtgatagtgtgtttcggaagtcttacgaattggttgtttaatttgtgtttcaggtaaggttgttccagcagtaaaccaagcattatttaggaactgattattatactgggaagcaatatcagctccaccccatgagactaaaccctgtcgtaaagaaacactagatccagttaattgaaaaacaatcgcaccatagtatgcattaggagatccatccatatcccagccagaaccaccgttatcagtattgataccattattcataccagtaccactataattattgaaaccggcataagcccagccatcatcatgaacactaattgatgatccagctaattgtttaatttgagcaccggaaatcagtttaacgccttcgctaatcccacttgttggattaccttcatttttacctccttgataatcatttccctgatcaaagtttagagatcctactgaaagccatgcattgtttgttccggaaaaatcaatcaagttaccgtttgcatcgtaatactgataagttgctgttacagtagttgaatgcatatctccccgcactgggtcttcgaaaactactaaaaagttatcgttagcaccttctgtaacagcatttaatccgctttgagtaatacgattgccagtaggggtgctgtcagaataagtaactacgattttgctaatttttgatcctttgtatgttgagttttttaagttcgtataggtaactcgtagaaattctccgtcaatattgttgacatatgcattatttttatcaaaaatctgatacccagcatacttagtaccttcttcaactcgtttaaatgtaattcttggatttagtgcttcgatatcaacagttgcattattttccggttttaacgacaaagcttgattaacactgtttgttgtaatgaccggcgcgtttgcgccttgattcagttttgccatttctgcattgtactcgttcattgcattatcgtactcagcattatttcgtttctgagtaagaagccaaaattttacagttttatgtaatctttcctaatttaaaccgaataattactaagttaaattcaaaatggtaaggtattttcccttttggttcgtccaaatttggacaaagtttaagacaatcgaatcatattttctagtattttttgattatctcgcgcttctaactcctttactatgtgtaaataagtttgctgcgtagtgatcgtgtttgaatgacccaatcttttcgccacactaggaattgaaactccatcatagattaataacgaggcatgagtatgccttaacccatgcacagaaataacatcaactccggcttttctacaatatttggtgaggtgattattaatagtggaaatatatattcgcttacctgtttgtagaaaaatgggcttgtcaggatttaaatctttagttagcatttgaaactgttctgatgtaatcgggtctacactgatggttcttactgaagaattatttttagtctcttgaaacttgccatttttggatttgtagtcccatgttttattaatttgcaactgatgattttcaaaatcaaagtctttaactgtaattcctaatgcttctgcatatcgtatccctgtctttgctatcaataagattagccaatctatatttaaatcagcctttaagtccaactggttaactaaacgcttcaagtctaacaaactcaaatatttaattttctttgtttttggacgcttccccttgatcgttaagtgtctagttggatctttcacaagtagtccatcttcaattgcatccatgattgctgctttacaatgatgatgaaatcccttaacggttaggtattcatgagtttcagcatattcattaattaacttctgataattataatgattaatgcttttaactttcatgagtggccaccttttttgtaattctcgatgagttaagtagtacttatctaatgttacttgccgtactgatccttctttatacatatgaatccattctaaataatagtccgtaaataatttatccattattgtaaactcccctttaaactaaaaaaaatctgtgttcctcatcttaacaaggaatacagatttttctttagaaaaccttactttacactatcaaatctcattaaattttaccaaaagcttctatcttatcttttacttggctcttcttttgatcaataaattgattcatatattgccaatctggcactcctttttgaattataggtaaatgaagagtcgatgactttaatttatttttgttaacagcattagcccaattataatagtaactatatgctctaaagatactagctaaaaataaataaacattctcggttgcatactgcttatattcaggttttaatcggataataagattatggctatcattagatacaaagttttgacgttgatatgaaatagagtaagtttttcctccaattagtaaacagtttccttcatcaacgggtaaattgcttgcatcaatataagacacaactccattattcatactacttgctgttatatagggcattgaaccggtaccgaaatcgacttcacgtcttaaaacatttgtagagttatttactgtaaataactctgtaaacttaaagttttcccaattttggctattgatagatgttggttgaatattaatgttattgataatgtttaatttttctaacgccctttgacgtaattcgttaatatatagattcatgtattgccaatctggcttattttgctcatttacaggtaattgaaatgaagtattgttaacaattgaagcagtcataatagtattgaatgttgaccgagtgtgcaattttttcctaactattgttaataaaaataacgcttcattttctgttaattttgatgtatcaatataataaacatcccgtcctgtaacgtaaggttctctttgatagaaaaactctccggtttcaccgccaaagctaatagtatttttaggaataatattaaaatttggcttcttaatgactcttaattttacaccattattaaatttaccacgtgtaatataattaatagtttcacaatcaggatcaatttcagaagctgcctcaacttgtcgtaaatgaagtgtaggagtaccatatgaatttatttctagatctggcaatttaaattctttccaatatctatcattattcaattgattcatttgttactcccttctttattttaatatcaatattttgcttattttctactacttggctctgataaagtacagtttgttttaaagcatcttgcaactttgaactattaatattttgtttaaacatttcatagtccataacagttttcataaagtcctcatcatagatcacaaaaggcttctgagggattggaacgcttaattgtttataattttttaaatcaggtgtaatccattggcaagatttatctgcttgtgtatcacaacgcttaatagttctaacccaaaagtcttcaattgctgaccatcggtgttttatatcttgtcgtccctgattcttaacagtttcaagtccatcctccgcaatctcgcaggtgaatattccatcatcaggatttgttggctgaccagtctcaaatataaaaattgaaactgaaacaccttcactattaaatgtttctttaggtagtttaatgatctttgttaatcgattatgttctagtagatgctttactttctttttcccttctttttcaagtttaaaatcaggcaaaagaattgcagcatcagtattttggggaacattatctaatacattatttaaaatatctaaaggatgatacttatgttcatatggaggattcattaatatcttggttatatggtgaggtttcaattgattatcattctgtattaaatattcatcattatcccgctcaccttcaggatctagccatgaaatattatgaatccattttgctgcttctggggtcattgcgtccacacggttaagattagtcttaccatctttatgaatcatcatattagcacatgctaaggcaaaaatagttttatcaaactcaattccataaagcttttgttgcttgattatttttgcttttttagcatcaggcccaccagcttcagtaatcatattagacattgaattggtaagaaaagttccggaaccgcaggtagcatctagtacagaatcatccatactaacatcaattaaacgatacataaaattagctatatgttgtggtgtaaaaacctgtccattatcacttttagctttatatttattaaattcattaaagaaaatagccattacatcttcaccacgccagtggcttgaatttatagattgactaattttatttatattattaacaaaggttttaatggcttcttgacccgggtcaaaattcgtttgaatatcacgaaaaacctcaattacattattaagttttaaattctgttttagtgaaggttctagacttttattcagcttggataagatagaagtctgtaaaacattataatcatcatcagggtcaagctttgcgccataacgtacggcgactaaagctcccgctgtaaaaatcatgcgatcatataaattacgaatgccaaatttaaaatgcaaagcattattaattctcgccgtcaatgtataaatttcatttacatcaacaggtttatcagtaaagactttaatgtaataatccttattctctaatgttttagataattgagcttcaataaatgtatcgcttcccggatcctcattacgaaaaacacgcacatcctgtccattataagcaatccccattacgtttggatatcttttaagtacaattgacatatttttttgcaactcaggtattgccacatcgtctaagtctttagtactagatttagtttctaaaattaaggccggcttatttttatttttaggtaagtaccatccatcaggcttattattattgctcttccaaggattttgagaaaaacttttacctagtgtattgaaacttgttaattgcccagttccagcaaaagcattagcatcattttcaaaatgtaatatttgctttgcccgatctcgaacttgatcttcggttagtaaagtcattttaagccaccgccctttttaaagcagtagctaaaaatgtaacagctagagggctggcgttaccccccccccatcactttatttatatttttaatgttgttaaacatagttttatgctcctttttaatataactgcttcttatagccattacgcaaaagtaacaattctatactaaaagataattacattttggtcaattcgtacatttactcatgacttcttaaaaaaaagctgtgttttattcatcttgacaaagaaacacagcttttttatcgatactctaagttcactttattcctgaaactgtactaatttgatcatcctttatgagtcttaaatcagtacccttgctcccaataatatgtctaggtactcctcttgataacccataaatatatattcgatccttattttcttttataattttttcatagagagctttacgaatcttcttactatttgcttttccacctggacataatactatctttgaattgctaagatacttagatatatattttgagataaactctatactcttcatatagctttcagcttgaacttgcttcaaatcacttgcttgtaaggttccggttgcacatatatcaagaaaatatatcgatcctaactcgttaaaatcttccaaccttccactatgatttaatgcacgattccatgcagaaccgttagcaacgattttttccaaaggttctttagctttagctcttttcttatataccgctaagggtgatccatttctagctggattcaatccaatgaaaacaatatttcttttcccatttttgatattaatctttgcatatgaataatcatcatcaaacgcttcctctacattaaagattcgacctttaggaaacacgtaggttaaatttctttcttgagcttcttgatgaagtctttttacaacattctcaaattcttcaggggtcatatccataaaacttctccttaaattttagacaaaaaggttcagccaatttggttgaacctttttacataataatacttacattttctaaattagtattcacgtttcttaataccgaacaaactcaacattgctgcaagtgctactccagcaagtgaaagaacagcactatcattattaccagtttgtggtaattgattattgctcttcaattgttgcttgtattgttcgcgggtttgcacagtagtagttgctactggatttgctgattcagttgcagctacagtcttaacactattagcagtaacactagtttgtggttgtacttgacctttactatcaacattgacattggtggttacagaaacagcgggatctacagtagcattagttggactaacaatttggttgcccttaactgtccagccattgacactattacctttagcgtcaacaacttggttattttcgatatggtagccattatctttagcttccttttcagcagctaatttagcttgttcttccgcaacctgcttagcaagtgcttctttttgccgtaattcagttaatgcttgttgtgcttgatccaatacttctttagcagcatcttcattattctttgcttctgcaagagcttgttgtgccttagaaacatttgttgtagtgccagcagcagtctgcttaaggctagttaatttatcattagctacattgtaagcttcttgtgcatcagctaaagccttttgagcagtcgcaacttgttccttagcagcagctaataacttaggagcgttttgtaagtcactaaggttattctgtagttgaactagtttatcattatcaactttaagggtttcattatcattttcaactacttgtttcttttgggctaaattgttattagcatcacttaaagccttattagcattatctaaatcagcttgagcaattgctaaacgtccttgttctgctttaagactatcagtagccttttgaaggtttgcttgctttgttgcaaggtcagcatcaaacgaatcaaaagtagtttgagcttgcttttggttagcttgatcagcacttaattgattttgcagagtagctaaatcattttgagctgtagttaagttgtcattagcctcttgagcagtagctgtcttatctttaacatcattttgagctgctacgagtacttgattagcagaagataaagcattttgagcatcatcattagccttttgctttgatgcttgatcagtttgcttgattgataaatcgtctttggcatcagctaatttttgtgttagtgcattaattgaaggcaatgtataactattttcttcaactttttgatttgcttcaactaaatcatagtgtgtattgtagaacttatctaaagaaaaaccaacagcttgcttttcagctgcaaagttatcaattccagcaaaattagtagcgtgaccccaagctgaatctgcatcatcaaacatcattgaaataaaatcatcataaatcaaatgcttgagatcattaattgtttgtttatttccagttggtaatttggttccatcagtcaatacggtatagtctgttgtaaaaattgactgatccagccccatattttcaccgttccagcttatattaagttgatcagttgcattattgagagcactttgatcatgctttccgttatctgcagaattccaattatctttattataattttgtgatacctgttctgcataatcatctgctgcaggagatgagatcacaagatttgtacccatttgtgtccgaacttgattaataagtgaagcaacaaattggctaagctctgctcgatctgttgaattaagattatcaatatctaccactcgatcatcacttaaattatccttaaatttattctggctcattgcctgatcacgatatttaagaagatcttgcgctaaattattcgcttcatcttgattatagttactattaccaaaatagttatagtatgcaattaagtcatctttgtatccagcaggcaaagtaatagtattaaagtttgctaacttgtcgttgattgcatctaccttagcttgagcgtcctttactgcagtatttgcatcagctaatgctacacttgcctcatcagcaattgcttgcttagcatctttattcttttgtgcagaagtttgcgcatcattggcgttcttcaatgcctcatctgcattcttcttagcttctgctgcattgttaacatcagtttgtttgttgttaacggcagtagtatcatcagcaactttttggttagccttgttcaaagcatcttgggcttcctttttagcctgatcactgttgtcaagaatagcttgagcattcttaactgcatcactagcagtatcaacattcttttgttgattgtcacgagcagtagttgcatcattaactttcttttgcgctgcatcaactgtgctttgtgcatcgctaacggctttgttagcgtcattaatagcatcggtgtctttactaatttgagtttcttgattagcaatagcatcttgtgccttttgaatattagctggtgaagcttgatctgcattttgttgtgcctttgtttcagcatcttgtgcattgcttactgaacttgtagcagcatcgactttagcttgtgcatcattaacaatcgcttgttgactgttaacatcagcttgtgctgcactgttagccgcattagcactatctagttgtgattgggctgcgctagtggcttggctggctgaattaacattactttgtgcttgatcaaccttagcttgtgcttgttggtcagctgtttgtgacgttgctgcagcctgagcattatcagaagttgtatcagctttcacctcatttgttgaagcaactactcctgcagtagcaaccaaactaactcctgctaatgtaacaattttctttttactattcatagtctataatcccccaacttcttaaagtcattgtattaaattatttacgattttattttaacaccatttacgaatttgtaaatactattttgacaaattatcatttaaatttggtttaaatggtaattgcttacttaacgcttttagcagacttgaattttcttcttttaagtcactaataattactgtcgcgattgcttttgtataatctgtaacttcaatattagctacattagactctaaaagcttaatcaattcctgcctggtagtcttaaattgtttatcttcacgctgaactgtatcaagaatatcttgaaatttaacaaccttgtcgtagagcatggccgctttatttacaaacgaactactcattgtttctggatgctgaatgtatttatacaacgttggccgtgaaacatcagttattttagagaactcagtaagagtcatcgctttaccattaagctgtttaagcttgtcgatattctgcaacaagaaaattgccttttgaaaattattcaaattagcctcacctcttattttgatgctacatatattttacactattttacatcaatgtaaagataaatacctaaaaagagtaaaacaaaagacggtagctagttgctatcgcctcatcccactttttgcccttatttaattagaagttccaattaatgcgctgcctatacctacggctcccgtaaaaattataaatgctttaagtatcggtatattaatcatgttccataaaattacaaacaagataattgaaactataataaatactacaataataactaacgagattttcttatgatatgaatggttacttaaacatattaagattatgattacaataataaacgcaagaatcattagagcagcccatattaaatatttaccgcctccttcatcaagaatactttttgatgttcctaaaatatttattttatttacaagagcatctgtaagaccttcgtcttccattcttttgttaaagataccgagaagaattaagtaaattataaacgtaataacatataaaacagaaataattaattcagcaattatttcaggttcatgtaaccaatcatgcgcacgataactattcattttctttttccttaataacttcttttaacactagacagattctgcgtttacgcgagatatttgctatgacaagataaataagtaaagccaagataataatcaaaatggctaccaatataccagatagcagattggccttcattacatattcttttggaatcgtcttaaccgaaattaaccttaatacataaagctctgttgcagtctgaaaccaggctaacacacttttccctagtcctgacagcagtgcggaaaacagtaaccccaaaatagcagtagcagctaattcattccttcttactgaaacttcgtagtcaatcagaataccctttagtttttgcaaagaataaccctcataatcatttttcaggacgtaaaaatactttgcttttcgattatcagagttctgtgggctaaaataagtcaaaagatttagtactgacctaaaaaatactgaacattttcgcgaaccgttcaaaaaaccaccttcgttcctttttagttaaatttaaggacagatctgttcttcactaattatttgatcataaaatattcttagttaaccattccattcagcaatctagtgtttgataatcatcactaatgctataaattccgccaacttcaatattatcagctttctcatctgggataatcactttaactttccgaccactaggaattaaatttacctgcgctaccccataacgaaagtattctacttcagctaattcatcactcatcatataacttcctctgctcttttttcttaattatacttgtttaacgtttaattgtcttggatctgtcaagcggtaaactaatattcttagatattgttggttgaagtttcatccgcaaattcttttcttctttactagctgcttcagttattcgtaaatacataacttttaataactcaggaacacctttatttaataattcacgctcctcgttagtaaagcgaaatggccgtcgattaacctgtccgcttaatgaatcaagcaagacatatctttcagcacgcttaaatgctttagtaattgtattgtcactattttttaatttcaggctagtttgatctaaaagtttggtaactttttcttgattatactgtttttgcggtttgcctaatgcttttaattgctttattaattctaagttatcactggtctgttttaataaatcgggcaaactatacatttcagatgatatccaacgtttatttgatttctgcacaaaccctcgcaccttatgaactccttgcgctggcgttaccttcaaccgtttaagttctcgtgctggcaccattactggcagtttctccaattgcaattgatctaatgctaataagcgattaggattattcatttgcattgaagtccccgtaacactaatcaattgttctaacttctctggattatccgtccatcgctgcagagccttaaccgataaatctttaagtacatgcgcatcacttaaatcttcttttgtttctaacggctttactttttcaaattgtgacgtatcaattgctagttctggcttaatttcctttagctgtggaatttgatcaaaataattaaataatcgttctcttaaaccactatcaaaggcttgatattcgatagctcccgttttagcgttatattctttttcttgaccaattaaatttccacgtagcttagcactttcataggaccataattcaaagcctcgtgcaaatacttctgttggcgtagttaagtattcaactttactatcagacagattggaacttgctaaattttttgtatattgcgtaatcagtggtttgaaattattttctaatgataaaggccacttacttaaatgatagtcaagataatgaccatactcatgaataaatgagctaattccaaccgtatcaccgtttgagtctttacgtacttcgctttgtttcctaaattctaaaacgattgtatctaatgagggcacatacataccaagcgctcgatgatttcccagtttacgtaagcgtaaaatatttttgtcatttgctaatggcatatggctcatcaagcgctttacttcatcttcaaaataaccaaatgctttcaaatcaacatcgttatccaattcgatcttactaaaatatcgatgaagactactcctatccataatttgttgggtggctttatcaatattctttttagtttcccaagatttagcatgagtttgtttatctaaatctctttcgtagcgttgctgccgcacaatgttataagtcttttcaaggtaatttttgataaaacgattaatttgatttgcttcataagccgtttgccagctcctaaaacgaaccctacgtcctaaatactgttccgcaagctgctcgttattctgtaaagcagatgctttaaaacgtctagagattctttttaattcttcaggaccttttcctaataaatcttcctcattttcgacaatcggttctgtcatggtcataaattcttgataactcaaattgcctaaagctgtctcttgaaaccgcgtttgccaactctttttagcatatttatgagacgttaatcgataaagttgagccttaaactcatcaagcggaacctcttgcttagtgctttgccattcctgcattaaatcgttaaggagcttaccgtaccctaatgtataattttgatttccaattacccaagtaacgttggggtcatagaccttataataattatccccctgatggctccaagatttattatcttgatcaagaatgaaataaagttttttactattttcatctttataattgattgtatacgtatttcgatttgttcttagtacttgttggccaccaggatcttttactatgcttgcaatttctcttttgtcagtattacctctgtcagtattttccaagtaggatttaatggcatctgcataatcttgatcattccattctccatttttataaatatagttcgcaatttttcgaaaaacaacaaatagtgaatcatcagagtttaatctcaaactgctttgtttagtaaccccatacttttgcttcattagggttgccaaaggatgtttaatttcatcttcagacattaaaaagcccccttatatgctgtgtgtaattccatcatataagcaggcttgcttcattttatcttttgccaactatcgttcacgtgacttagttgtaggtctattcagttgtttgtcctgattatgctctttttctttaaaaaattctctttttactcttagattcaacttacgacttaatttttgtgcttcattaaagattttttgccgttcattaactgatagttgcttaaataattctttctcatcatttctaagtttaaattcttcttttaagccagcagaagaagtggttaaatacctggcaatatgaagcgacatggctgccttaggattattcaggcgttggttagtcaatatgaggactttatttgtctgtcttcgccgatctgcagctgactgatttaagaaacgactattttcccgagcgattgctaaagcatttttcatcaattcgggatgctttttaccaatttcttcgactgcataaactgtagccggatttagttcgattattccttttttgatttttggtacaaagaccttagttccatgtaactcttgaaaattaattttacttaacgaattatccttttgatactcacttgcaggtgcatagaccgtccctagctgatgattagctaacaataattgattgccattttgattgaatttattaccgtgcgctctaagcgctcccattcgatttaccgttcgttcaaaactctcaggatcatttaatgttgcgtccaacaaccggttagctttaacagtcaaagtattccgatctttaacctcttgtgttaattcaagagaagcttttaagtttgcaccactatcaattgcgcgtttagcttcctcatagctatgatactcaactggttcttttaatttaccatcgcgattatctagaccaaagtaagtaccattttctttatcaaaggcaatgtaagtacccttatagtcgccctcttgctgctccgtcctcgccaggacttcaccaagctcatacatatcaagtactgttttacgttgttttggcttgatttttggcattttaacatattcgtctacttgataatccaatcgctttatcaattctctttgggtctgtgataaagactgattaactccgattaaggcttcctgagtttccggaacgaccctaatcaaccctgtcttagcatgtaatgcaccccaaaacttttctggatcacccgtataaagctctttgccttctgaaataagtccttcaatcatacggtgatcttctgtccgtgacccgtactcgtaattacccgaaattaagctcccatcacgtaaaatatataacgcttcttgaggattcttagttaactgatactcattatcttgcaaataattttttattgcatcatcagttaccatcccgtttttactttcatattcggtcataattgccacctcagttactttttgcattcaaagtaactgagataacgaaaaatcaatcttacgccaaaagaagaagccagccgttaagctgactttattttttcattcacctcgttcaaatttggacaagttgattctgctaacttcacgtctatgtatcaactacgtatcgacattacgctgaaatggtgtataatgtagttgtagcaactaagctacgcaaagctggtatgtttaatgaagaatgttggagggatttatcatgaaaagcacgaaaggaatactcactttatcaaagtggggtaatagtttatctatacgaataccaaaaaatgtattagatattctaaagttaagtaacaatgataaagtatcgtatcaactaaaagacgataaaattatattaaaacctgagaagaacgaaagcccattaagaaaaatgttcgatggttttgataccgaagcatatttcaaaaatgagcctaaaaacaaagaaattgattggggcaagccacaaggcaaagaaatgttttaattgctggagccagcacgctttcggcgaaggcaataaaatatttcttagaagggagatttcattaaatggaatcttataaagacttaaagcaaggacaaatcatcaagattagtcttgacccaactgaaggacatgaacaaagtggatatcgtcccgctttagtagtatcaaacaacgattttaatcagctatgtggtggtatggtaaagattatgccaatcacatctaacgaaaagtatttcccgttgcatataaaactaccaaggcttgataacattcatggcgttgttgaattggagcatgagcggtcccttgatttaagttttcgatctttcaaacctgttgacgaagttccagaggactttttagcagatcttttaaagaagaattctgctacatactaaaaaatccatcagctattaagtgatggacagaatagactatgtacttgtataacaacttaagtatatagtctttttttatgctcgtaaagaaaacagatgtttacttaccattgttgaccaatgtgttactgaggccgagaaaattttagtttttctcagcctcaaacttgtgtatctatttatcataatgaatggtacttaaattgaattatttgtatttctttactcgttactccatataccattcgatgttcactattaagcttgcgagactagaagccagataaattatgttgcaatggttcaggtttaccaagaccagtaaatggatgacgaatagtatcactaataattttatctattcgttttaccattttttatcatcctttttccaatttaaatattctttccaagcatcttgtgtaaaatcaatgttaagcttggtcattagctgctgccatcctctcaaattcttccggagttaagaaatgatgtttagtagaatcatctagctgattaatagaatgtgctaaagcttcttgatttgctttgctctttaaaaggtagttagtttcttgccaagagttatattctttttcagatattacaacaacattcttttgttctggacaggcaacaatgattgcttcattataatttgctacgtcatcagcatattttttaaatgatcttctgaaatcttttgttgtaactgcttgtaccatagcgtatcacctctatttatattagatcagcccctttaatatttgtacacacatatgtacaaatatttgaattgatgtaataaaaaagccagtcaccgttgaactgactttcaattaattattaaaagcatatattgctgctccaccaattatatacacggataagagtgcccttaaaataggattttgaatcatataaataataaaaatcatatttattatcgtaagtatagcgagtataactactgtcaaaagtaagtaatctttagtagctgcctgccacaaattacgatataaaaagaaaaggtatagtagccctacacccagtaatactatacttcctaaaaggtataaaggagctgaactatttattgcaatatcaaaataggttctacctttcaatgccttatttaaattgtttaaatttatcaaataccacccagaaagcacttcatatataacaaaaagaattacttttaagctattattttcccaccaacttttcatgacttttatcttccttcatactctttatttttttattaatcaatgttaagtgattataaattatatttttttcagactggataataatttcaattattgctaacaaaattagataagcaacaagaataatcagcaaagttccaatcatacttggaagatctttagtatgctgagatgtagcaaactttctaagagaaataatgccacttgcaataattcctaccgttaatgtagttacaatccaccaatatattttttgtattaaatctatatttctttttttagactcaaactttagctttattggagttaagtcgttttctttagcgtaatagtcatccaaataactattgaagattttaacaggaacgtttcccaaaaatcttaagttatttttcaattgtttttggtattttttcatctaatatcacctttataattataatttacattcaaattatgtgaaagtcgaatcacaacattattgttgataaataaagtcagtatgatccaagttaatcgccacaaccatgtagcggcttaatgattgtttaacctcttctcgcatttttatctcaaatggttcattagtacctataataacgcccgttgcaacgttactggttaagttagtaattagcccaatatcatattcattgtccataatttatcagtctccctaaaagcttaatctattatttagtaaactgatattttttatgagaacaaatttcgccagcaatattatctatcgttcataaatttcttctcgttctaattcacggtcttctctttcaatatcatcttcatcgtttaaatgctttcttaacgcaagaactcgtttccgaccatcttgattaatttgacctaaaagccgactcaaattactgttaattatcccttgatactttgaatttttttggtatttcttttgattattattaatataagtcaattgatgttccaactcagtatcaattaattcactgttttgagcaaactcatattttttcttaaggtcagtgaaaagtggccggttgagttcattgcgtctagctaaatcattttgatatgcttgattatttttatgaatttgtaattttgcatctaaaatatcttctaagttcttgtaataggcagttgcgttcattattcgataatcgctattaggattaggaattactaaagaaattgatggatcatctgtattactttgaatcattgcaatttccgcagctagttgcttcttcctagctaaaactgattttgtagtcaccagattaattggaactttatttacatccatataacgattttttaacacattaaaccgttgcattaattttgggttttgggttaaacgataacgaggtaactttcttaattgaattagttctttttgttcatttaaagaatggaggaaaaattgatttaggttcgttgatggtgcgccttgcaattgaacaatccgcatatctaaactttctttttgtgcatctaaattaatctgccgaatgtagtacttccttaaaccaatttgcatttttaatcttttggcttcttttgacttcgggtcaagcttcttcaatctttccttttctaaatttaataatttcttattctcagtgagaccttgtgacttaatttgtgccattaagtctctttttttattgctactgttattcttctgatattgttcctcgttatcccttcctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccctcgttatcccttaataaatcataaattcgattagcgagatactctcttaattttttatccgctggattaaccgtatctttaattttttgaccatattttttacgattaattgcatctttggcttttaagagatttatatattctaaatactcattatttaagcttgtttgcaataaactattaactaattgatccgttagttgcttagcctccttaaaatcaacgctatgatttgaagaacgccattttcttttgtctttataatccggtaaagcattagcaatttgctgtaagtaatttttttgttgaatagttacatcgtttgttaatccgttagttaattttttcttagtagcatcaagtgctttctcaatttcaatcatccttgaacgactttttttattttctaattcatgatggatttgagatttaaataaacgaatcgatttattcttaaacattcccttaggaacgccattttttaatggacgtgtgttatggcgttgactaattgccaagtggacatgaacatgatctgtattcaaatgaatatcaccccaccagaaagtttcttgattatctaatccttcgtttgcgagaaagtttggcatcgcatcttgaattgctttcttaattaatttttgatttacttttttcgttttcggatcatatagcccagctttggttaaaaattctgggctaaaagatataacgccagcccataacatcgatttattagtttgagcctcttttaaattatttattaattgttgatgctgttcttcagataattcatagacaccttgcgaaaaagtagggtagtccccctttaattttttatccaggtcatcttccatttttgtggcagctttacgatcagtatatccaagataaccttcaaagttttctggtaaatctggatcttgttgaaaatttttattggtaatttcaacatcttctggactaggattaattgcttctttacgttcggtatattggagatacctttctccattagcaattccgaattgttgggtataaataatatctggtgcttgattattttttatcatttgttaactcctaatcaaataattacgacttaattacaatgattttttctaaataagcaacctttgccaaagaaaaaagccagctgttaggctgacttcaacaaatatattagcaaaataaatttaattagtttatacattaaatcgcaatccgcttatcctgtttcattagtccttcatatcatcaagctttgtcgacgtaatctattatttcttccgcaagttttatacttttttcacactcttttgcaattttatgactactagcatgataatccgcatccactcggaaatcttttagtgtcatggcattttgaaaatatctttcttctgactcatctctgaaggcttctctccacatatcatcatgtgaattagggccacggaattctgtcccatatattcttctatgtttcgtataattaaatgctgcataataggcacgactaatagcaattctttgactacattcatctgaatttttagcaagttctttcgcaacatttaaatattctttccaatcaaacataaatactatcccatagctaaatgacgatttttagttaagtcttttggcaaatcaaaccaaacattctcacgaaaattccaaaattcgtcaaaaagtttctcttcagatattctagagttttttaactctaaataggtaactggtttcccaaattctacattcacaattaagccagggctaaaatactcgctcatattttttgcaagcaacttaaaattacttgcatccattaacgacgaatttgcattattatatataaattttatatcatagaaagtttcagtaacaatatcttgaaaataatttttcctggtttgatttgattgtacataaaaaacagaaaccatttcgtgatcgtgatttttaatcgtgttaactgtattagcaatcataatcaacttcctcctggttaactagatttttaaacgagtttaacgcttttttataaagctcattcatgtcgttactatcttttcctttcttagtatcatgcgatatagctgaaaaaagcgaaattttatttctttctgatctaatcgatactactaattcgtccccatttaattctgacgtgaaagatatatcaaaattaccaattgacgttgtctcattatctgaaaatttatctgttattgctggaaaaacatttaatacacttccgatatttaccggattatttatttctaacgtattttctaaaacgccttggatgccaagaccatacgtaaaaaaggttgttttttcattattgtctagaatataacgaagaatttttttatattgctggagtaaaccacgcaattttatattaccagtaatcaaaatccgatgatcatcaatagataatttgatatcatcactttcttcttggaaaaactcttgcggtattgctatctgttgatcatgctttttaaacgtaattaaaagtattagcttctcagcccgttcaatataattcatattaaatctcacattctaattatttctaattcaattatgaaacattttgacaagttcttcaactaaatttcacttggacttaaatgttttccgaaacgatcacgaagttcaacttcaaacttaggatgtattttttctcctggtttcaatggctgatagtcgtgacgaattgtgctttcgggaatatttaatatttgcgaaatttctttattacttaaatcgaatcttttatagtaagttaccaataatctaattgcatcttttttagctgcacttctccatagttgcggatctgtttgcaacttatctcgaacttcttttaataaatttcgttccttaataacatcttttactgcagtatttaaatccccatcatcaatataggtatttaaacgactctcttggccaacatggataaaccaatctggatccaaatcctctagctcatgtaacttgtcgtagaaatccttattgttttttatattcaccattttagtcattctattacccccgaaataggattaacttatttacccttttgaaataattttttgttatctgtttctaccatctgtgataacttagcataaatttcattttcttttgtcccaaattcaaacattgattgcatgtttttccagtcatctttatcaactcggacgactgcttgattagttgccattaacaaatatagaatttcattaattcgattcatttgtttttgttcatgcttaattaaattatttagttttgtgtcatgcgtcgataaaaattcttgataaatagtttcgtatctttttcgaggacttttattccaagcattaattattaaagtaagataatcatttaatagcatattaatcaggccattatttgaggatggaatatttttaattaaggcaggatcattttcaagtttagcttcaaaataattaattttactttcagtggattttgtcattcttaaagtagttcttgtcatgttagttttcctcctcaccatcgtattcatcaaaaaagatccgtaaatgatcttcacaataattaactgatcgttcaatacgtttttgccgttcaccaattacgttcagaatttcaattaattgcttcaacgtatctatatattctggagttaaattcgcaacagtttcatttttgaaataatcactgaccaccatgcgataaaattctgctttggtcatgttatatttctttacctccttttgcaccttgccaacttgattattatctaatctaaaatgttgaagtgtttcgccatctattttcttcataaaatcatgtcctttcttttgagtgccaacctaattcttaaacagtaaaatttaagtgctagtctaattaatgagcataagggaaaacgatacctggcaagccaggtacccgccagtggcggggttttcttgtgttaccccaattctctcgtctgccgactatttgacactcagaaaaatgcgcttttgcatcacgtaaatctacaaaaagcatcatcatttgtagtatatttattgctgatacttttcaaagtttcgccaaaataaattaataaagagagactaagcccgtgaaaaagactaaatttaattatctaatactaattcttggaataattctatccatatatctactcaaaattttttctccactttttatgcaaatcttctctcatcctctaaagcattctgctttttcttctatagtagttggtttttcccataataaaatgacctttatatattggattgtagtaaccatcgtattacttttaggatcgagcattttttcatgtattatttatttacttctctgttcaatattttctaatgaaggacaatgctttaaagtagcaattactatcgccaaaattctttcaatcatttcaattataacttcattgcttttagttctaagtagtgactatttcaatctaatatctgctataatttctagttttgcattgtatcaatacctttttccaaacctacatcaagacaaaagatagtgtattataattattccagtctgacttaaattttatattttctaacagaactcattcgtaacggcaactgatccataccacctttcctcttaccagattcataggccaatgataaataacatattaaggactaaaactatcttcaaattagttagtttttgtatttcactccattctaaatatttatttttgcgaaaacttataaagaataattccattaggttatatataaatattaaagtgctcaaaaaaataaaaagatatattaccagtttcctattaaatccgcttatccataaaaaaattaacattctttcattccttcaaccttcttaaactaaaaatgaaatgtttattagttataactaaagccagcctttgatcgactggctttttgaatttatttaattcttttttccttattccatcttcttagttgcaacctttgctgggaacttatacttacctgattgagtatcatcaatttgtttttgataaagcttaatttgtaatttactttgtttaattaccttatttacgttcttaatattctgcttttgagtcgcaatatctgcttgagcttgctgaatattatcagaattactatctttatcgacttgatattgttgattattctttgcttgagaaattgctgcttgatctgcagctaattgtttctgataggtagtcaaagctcctttttcttttcgaatttctctgttcattaacttgattgattcttgtaatgattgaaccgcatattctttttgggtttgtctagttaaacgattatcaacaaattttttatcttcattaatgacaaatttgtaactgtttttgcctgctccagtctggccattcccactgcttgatgatgaaagttcgctatcactagaacttaaagattctggatcaatactagaagaagcatcataagtaatttgcgaactgtctccttgtttattaatagcttctagctgaattgctttgtatcctttcggtaagttatcaataactactacaaagttattattaacaagcggaataacttgataagaagcatcttgttttgttaatgtacgaaccttaaatttaatatttttaggatcgatatattgaccagattgtggtgccaccttaaagcgcgcaaccaggaattgttgcttagcattatatttacgagaagttagtgctattgtggcattactatcattaccaaaactctctgctgtatttaatggagtatcggcaaatcgcgatttgcttggtgcaactcgtgtgccaacaagcagccctatcattgttaaaaagagcgtgccactaataattaatttacgttgcatcgcgtggtcatcataccaagtcttaaatttagcaaatctttttccatacttatcaatccaaaattggatcttttttcgccattttcttttattcattggttacccccctgctgtttttctgtcggtttatttatttgtaagtaatggtagatgttagcaattacctgcttattagtacctgagtattgataaatatcaattccattcgcattagcaatcggttgtggttttccattgcgataaaccataaatgttggtactgaattaacattgttttgcttaaatagccttttatcttcattattttgccattgtaaatataaattcttatggcgatatggtgatggcatcaacttaccaatcgtggcttgagttgctgttacttcccaagcatttttatgaacatcaatcgctacttttttacaatctggacacgttttagagtagtacattactaccaccggctcattgcttttaagagctgcttgttgcgtttttgtactacttcgatgaagcactccaattccgtagagaaagcccgttataagcaatatgacggctaccgttaatacactaaaagtaatcactctacgacgatgcaataattctggatcatatctattcattaaaaatttaccccacttaatctattacttagcatcaaatcacttacagaaagctaagttgttgagcctgcatcacaggtttttgttctttcaattgcaataattcagctttaactaaattcattcccaagtcatgagtactattaaaggaaccttcaattgttaagcgtgtatctttatttttataaaggactaagtggtatcgcttttcgttatatttttgaaatgttgaaaactctaaagtgctttcttccgcattcaaaagatatttgcctaaagctaaatcatgctttaattcctcaaggctttcttctttgggtaaagtgattacagcgtagcctttataatcatcaaattgaaattttaatttgtatttcaatttttgttcaccttctttacctatggttcaccatcattttttaagctaaaaacattaccaacgattcttaattccgtcgacctgtaatcgcatactggaataaatttgccgtgattaaatctgacagttcctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggccctaagcaccttttagcttgcggatgagttcgatgatgcttacgtttaggtttttcaaagagatctaaattggacgtacgaagcacaccctcattaatccattgatataaagttacaaccgactttgggatcagggtgccatcattcattaaatctcgagccttataaatgaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctaatgtcacgccgaatggcgttttttatttaccaccaactgggtggctaacttcattctacaatccacctaaatctgacagtttgctttataacaggtttttgatcatgaattatttgaacaatatcgccttcataaattttcttcccgttttgatcattaactcccgtgtacatcataattttggaaagtgagccatttgcaatccatgaacttccctcatcaaaaggagaaaagttaaatcgcagttcgttttctccttctaacctagttgaataaagcaattgatttaggccttgattatatttccgcaatttaatttctttcataacttcaatttcctccgttcaagtcaaaataatcttaatcattgctgcaaatagcagtaagaataccaatagaatcaagattaaaaatgccaacaacatggtatacagaatatttttaggtaatgcttttttccttaactcccgtcgatatatcgaccgttttggtggcaattttttcctaatcatgatttgatttttccttataactcataaattttgtccccttagtcactgaaaaaagtgatacaaattccaaaaaagcaaaaaaataaataaggtcaacacaaaggttcctaaaataggtgttatccatcgaccagtattttttatgttttttagttgtgtttcgggctcattttcttcctcgtcattccaagatccactaatcatcttatgattagctcgttggcgtagttctgctcgggttaatcgtctacgataaatcattgcttctagcctcatttaggaaggtggtgaacattagggtcaagtttacgatttagacttggcaaatgaagagctgcaatttcagcaaccgtaatattttttaagtcgtctggaaaactctgcactaacttaaataattcgattggtcgcccgttacttgcttttaagatagcaattaaattacctacacattttccactattaggaagtgttttgatgattttaggctccacttgagctatccttacatatttccgtcgatcactaaccattactagtactgattttttcttgtaaagttgcatggccaacttaaaatcccgtaatttattcgaggaaaccgcaaaataccagggtcttctttcaagcccatttgcgttaacaaatcttcctttcacgtacatcatttcttcattctccccctcaagcctccttaaagtccccgtcaattacttgtttactattatgagtggctaatagtttttcacgaatttctgatcccttactttcaaacatttctgctagttttactaaatcagtctgggctaaatccttctgacttaagaatttggtttcaggtaaaacttgcatcaggtcaaaatcttttactaaatttgctaacatttcagatgaaaatgatgaaacacgcttaaaagctttgtcatgtttactttctactgattcctgttgcttaatctgtgttcgcaaagcattatttttttgaattaagtcattaacttgtttagcaagatcatcaacctgttgtcctgattcttgagcagcttttaactccgctttaacttttttgagtttttcttcccgatcagcaagcaagctttcagcttcttctttatcagcctttaattcgtcataatcatcaggtgcaacctcaactaattccggctccttgtttttttgctcctccagttgcatttctaagtgtctttttccttctcgtaaatcattcagctcattcataatttcagcccgagagttttcaacgtctgctaaacgattagctaaacgctgattttcagaattaagtttttgaattttgtttgattgacttttagcgagctcatttttcttgctaatcgacttagccatttcctgccaaattcgcgaattacgagcttctacagttgcatgtaataaatatttttcctgttccggatcagcctttccggttgcgattgctaattgggccatcttaggaaggcttagataattatcaagcattagctcttcatccggatcattctgtgccttaattcgataatatgcttgcgcaatgttaatagcgttataggcattcccctttgaaacatgatgagctttaatccaccgctcaaatgtaatcttgtctttatcacggtttccttggcggctagttttgtctttaatttcctttagaattgtgccaaagcggataatatagtcacgccggttattatcaacctttcgttcaattccaagccaccattgccgttcctcaggagataaagctttatagctctctgacagttcactaggaacaaaaacagcctgactttcagtatttgttatttgggtaaaaccattattcgagttttcaatttgataccccgcttgtgaagcattactttcttgcatttgtaacaagccccctaaatattttgtggttttttctcaatagctgattttaaattagccgtcgagactcccatcgcttctgccattgtcaaaataaaatcagtcttagtaatttcactcttaaaatttaattgtgcaaaacggtttgctgaatcataaagtccattcactaacgcaccatgtgaaattcccctaccaccagaagtgattgaaatcatatcttgttcctccggagattgtgctacgattacccagccatcgaatggactatcttttaaaatttggctaactaattcaagcgagttccgttcttgttctttaaattccatatactcaccctcatttcgcaatcctaatacaataaaccttgcagctttcgtacttgcaaattttttatttttttaacacctacagcctctagaaaacttatgacagcattagcagattgaatagtcttaaatactgttgccaaaccaagagagccccgattaatttttagaacatcagcttgttttactggatcttcaaaatcaatcttcagaaaattacaatcttcatcgctaattacataagcgcttgcacttgacagctgatttctgtttttcatccagtgctttacagaactatcaagagtttctgcagtccaattactaagacataattctgagcttaatgaataatctttccccattttgttacctcctcgaccaatctttacttaaaaattgctaagacaatctaaattgcaacatataacataatcaataatggaataagacctatttttctaagatacagtctaaaaagataaagttttgattgtttgaattctttaaccgctgatggatcccagtcatcaagactccacttttgatgtagcagtctcttctcaattctcttttcactaataggcctaactggaattttagtaattgttgcattatatgaactatcttttgtgtaaagcgttgaatgagcagcgtccaaagcatcttggtaaaactcttttctaccgcaatatgatacttcataaacataattttcaactgggtacgcttcaagtaagtgatgacccactgttactttcactgcaaactcacctcctatgaagtccaaataagcacagttttcattgtattttctctattccccactttcgttttgaataatcaataacatcagggtgccacctaaaatagtgctgagcagcaatgctcccaaaaccgataaaactgtgttaacgctcagaaattcaattagccgtttaatcgccacaatcaaaaaaatctgaaagtaaaacgcccagccaatcaataaaattgcagcccaattcaaatgtttcatcgtcgcttaccttcttaaaggcgcaaagaggatgatggcaaagaatattgcatctagaatgcagcaaatccctaaaagcatgaatatcgtcaaaatattgtcaatcaatttatccccattcattttcaaaatctccctcgaattaattttcctgaaatacgcgaatcaaaaaacagtaagtcttaatttcttgtgtaagcttaatgctgacgctagctgacagactttcttgattacttagccgttcacttctttttgtgattaagtgagctagtcgagtaataatttgcgcttgtttcttcgtccccatatcgttaatcctccccaacttgcttaaccagaaacttcctttcgccgcttattgcgattagcaatccgttctttaagcttacgtattgcttccgggtctgcctttttgtaaagctcttcttgcggttttcgactccattctggcattggctctttaatcggcttatgacgcttatattgctttgaattacctttgctaggcatatttcgatcaccgctcttaacgtcttcaaccgtcttaattccctgagcctcatatcgtcttaaaatcgatctgagaaagccccacgaagggtactggtaccttgtttcttgtttagcaacctcaatcgcatttaggactagcttagggcctaaatgcctgacaaactcattaagagcctgctggtctgctccgcttaaattgatttttgctaaacatgctgctcggtaacagatagcttctggttcgctttttattaaatttttaagatcatctttgcgagatgatttgcctttgctaggcgtagtagtagaatcgctttgcttagctctttgcgagagctttgaacgatgtaaattcattgcatcagcttctgctgcttgagaagctgtttgaacgttgttttgccgataattgtcaaatacctttgctaggtaggagcctgctgctgatgcttgctccactttccatttggcatagttaaaggcatgggcgacaacgtcaattccaaattcattaacccactggctaatttgcttttcgacgaacgctgaaggtttaccccagatatcattccagagattatatgcttgtgaaataccttttggatcgtctagtgaatgttctgaacgattctttgcaagaatctgttcatcagtttgtgctgctttgctagcagcatacttactacttactgagtaattagtgctatgagtaattagtagtaggacgttatccaacattggaaaacgtgacataggttttcgataaaatacacctatgtttgaaaacgtgacataggtttttggcgagaaataagccaatgtcacaaaacagaacataggcttttgaacccatgagtaaaattttacttgatgcttccttggcttttttctttccattctcttcttttttgccaaaactgaattatcaccaagtgtccctaaatcatctaatacccaatcaccagctgttaattgccccttttcgttacgcaatcgacttcgttttaagtaaccaaatctttcaagttcgtctaacgctttccggagcttcgttctaccagaagctgaacgttgaacaatatcaatctcattaaatgaccaatcgtcaggtaagtgccatagcaattgaaaaacacccattgattcgagctgcagacggcggtcatcatatggagtattgcttacagttgaatacccttgacgtcttcgatgcttaattttcggcataaaactacacctgctttaccggaagtaatttccaaataaagttagccttgctattaagttttttagcaattaaatgatgttgttccaattcactcagtatttctaaattatgctcttgtgaatccctcgatttattattaatatcctcaaggctaacctctttttgtttgcgacttagtaaataaatatacagtccaattgcgtctagagttagtccctcatcaaatacatagtcaggaatttgaatttggctatttttaaccgctttatgtttaatctttataattttaggcatagtacctaccccactttcttttactgttatccatttccattcattgaaaactcgcttaaatactctttcaaccattgtgcaaaggttattgccttaaacattcaaggagaagtactatggggtttccaagtagttccttttacctctatccgtttaaggtcatctaggtaacgaaagttgtttagaatattcttccacacccatttatcacctttgttcaatttttgagtaccctcataaattttccaagttctgccaatttatgattaatccttatatttttaatcatacttacctctagttaaacgacccgatttttccgacttctcattacggattttttctgatcgccacataaggaacttctgataaagcggttcaataataattgcatacttagaggtgtcgctaacaacggcgctgctgtatggagattcaagacattcacgcattcgatcaccaaaagttccttcactatagccataatctttcataatttgttccctactcttccaaccgtttgccatcatcagaattacctcctctcccgaattaacaaattccttattattcttaaatatcctgtcatcttttcttgacaataagggtaaaaaaatatacacctatctcgtctgaccctatatctaatgcattcgcaattgaaagaatctcgtcttgcttaaacataatcctattattaatttttcgatttaatgttactcgctcaatgtttgtagcttttgcaagagatacctgattatatctcagttgttgcattcgatccttcagtttatcataattaaaaatcaaataaatcatcctctttttgtcatgttagctttacaaaagcaagtttaacatgacagtgttgcaattacaatcattttctgtcaatttttctttactcaatatgttatatttgtattttaatgttaaaattagctttaaggagttgaaacaattatgattaggaaagttgacagctttcagcataggttaaaaatagcattagatgatgcaaaaatttcccaatccgaacttggcagaagaactggtataaaccgtcaactaatatccgactacctcaaaggaaaatatgaagctaagcaagataaattatatgagctagctaaagtattaaatgtggatgaaggatggttaatgggggtaagtgataagaaggagcgccggcacccagaagaagtacaaaatactaataacggaaatggtgatattacttccgaagatattgatcattattttaatggattacgttcttacgaaggacttcaaattagcgatgagcaaaaagcatttatgcgcaattcaattaagtcctttttagaatcacaaaaggcaatgaataacaaacaaaataagcaaaaataataattacaatacatagactaactgaatataaataaaattgatgagaaaaaaggtgacgttgatgaacaagatggaagatcttattgagtggttaaaaggtgtagctaaggaacataacattactgtccttactgaaagccaatggccaagtgactgggtaccacaatcgcaaattgaattgcgatgcgtttggtacaatcctaactggtttccagcttgcgaacgaccactaacactagctcatgaaattggacacattttatctggtgatgaagttagtcttagttgtaattattgcagtgttaatgaaaaagccgaaggcgatggtgatctaattgcaattatgttgcttttagattattgccgtacacacgacatcacttttgagactaagcagcaattaattgaagcctttcgaattcctatttcaatgacagaaagcgttgatagagctactaattttacattatttgcgatgcgcaaaaaatatagagaattagctatttcttctactggcgtttttatttagcactctaaaagaacgtatgttttgcacaatataaactaaaggagataaaaatgtgggttgaaaaatataccgtacgtggcaaagttagatatcgttttggcgaaaactataaaagtccattaacaggaaagtataaaaaagtctctgttagttatcttaaaaataataatcaaactaaaagagcagcagccatcgagctggcaaaaaaaattgaaaaagctaagcaaaaggaatacttcacagataaagatatttcacttcgaaaccttgctgacaaatttttaactatctataaacaaagagttgcggttaacacttactataatgcctttcgagggcttaaacggatttgtaatgacttaggtaacgatacccttgctaataaaataactacagaaatacttaatcgctatttagatcaaaagctttatgatccagataagcctttaaccaatgcttcaatccaaaattacaagaaatacttatcaatgacatataaatttggcgttaaatatggatatcttaaaaagaatccggtcaaagatgttgaaataacatggcgaagcgaaattaaaagaaaacgtgatcgtattgaaaataaatatttgactgacgatgagtatcacgcaatccttcatgcttgtgagaaaaaagatcgtaatgatatcaagcttttcctagagtggctttatttgactggtatgcgttgtggagaggcggccggactttatgtaaaagacataattaaagaagaaggtaagtataaagcaattattgatggctccctttcacaccaacgagaactattagggactgtaagtaaccctacagttaaagtttcagtcaagaaaactgacggtgcaaaaacaattgctagtaatcgagaagtactattaccacaaaaggctgtcaatatttataaagaacttagcctcaataaagatccaaatgacttgatttttattaataaagattcacgaagtaatcgtccatttgatgcatcacatttagatcgttttctccatcgattagaagcaggagcaaaaattgataaaagtgttactacacatttttttcgccatactcatgtttcaaaattagcagaacttggagttcccttatacgttataaaaaatcacgtaggacatgaaaatagtaaaattacagaagaaatttatttacacgttactaaagaaatggaagagtcttggctgataagttaagtaagctttaatatacattttcttaatccattgctcagaacgtatgtttgataaaaatgactaactatgctatattaatatcgaacatacgtttaaaaggagctatttttatgactattttataccgaatgaagaaccctcatactaataaatatttctgtaaatctgcggatcttattaacgaagccccccttgaatattcgctcgtctatacagaagaaacggcccaaaagattattcacgatgcaaatgtaatgggtaaactcttgtttgatcatttaggatataaagaagatttcaaaggctatattcttgaagaagcttcattagacagtattcaaattccagaagaatggaaaccttatgtaaaacgaatctcccggattgaccatatttctatttcagaagctcagaaagtattccgccaagaattagtagattattgggataaatgggctatgtatgatccctttactggaaaagagatgccaactaaacgtgccccatttgaataaaaaataagcagcaagtttccttccgtgtagagggcttgctgcttaattcatttcttatgagttcataatactaccatttattagtaaaactgtatattatgtaatcttattttgatataaatacagtaaattttccacatgaaaaaccggctatgcattcaataattaaaattggttcattatcttaataatgttgattttcaattattgaatctgaaatatgcttaagatctggatatactgtcccttcattaattccaagactatttaatgtcctttttatttgaaatttactactcccatctattattatcgaacccagtttcaacttttttacagagtacgttatggactggcgataaccagcataattcacgtcaaacatcaactgaaaacaattatatttaaagtcttctttaagttttaaatcactaccagataatctataattatcaaatttatgcattatttgttttaactttattaatcttttctctttttgatgagaaaactcctttttagactttactaatgtgtctaatttcattcttttattttttaacactattttgggaagcttgttatgaactagtggtttgttaactagtcttttctttaactccacatattcttttattaaattgttttctgctttatagaagctcgaataaatatacttttgaagtttttttgagttatctcttttttgaccacttagtattgatggagttataaatgctccttgttgacgttttattctgtcattactaaacgtacttaaataaatctgaggtaaatgcatatcaaaaaatattgctaatggtttatttaacctttctctagtttttgcgatttgattcaatttttccataaaatcaatcaagtcaaaactcggcatttctttcatcatctcagaagttgtcatatgccttaactcagctataacatttgcactattatgaatgggataaggttctacattatttaactcatattccaaaccgttaccataggttgagcattgtataatagcttctcttacgtttttaggaaatttacgactgtttaagaaggtgtggcaatatttataaaaattatttattaaagaaatatccataaaattagctgctgttttggtagcaattgtatgtcctgaatcaaaaaaaactttgccattaaatacatgtacaatgccgtcttctttttcatcggtattttctactgcaaaaaataaagcaattaatgcattgcttgtaatatctaaaagtctactttttgcgccataatgttgaagagtcgccatttgatcaataactgagatattatctgtattttgtattccaagttcaatagataagcgcttatagtagttagttgaatcatcgataagcttatttaattcacgatataaatttggaataattgttccataatctttcgattctcctctaaagaaatattctttaccgtctgaataatgacgttctatttcagttataaactccgaaactgaggttattgctttattattactattcatcttattctcacctaataaaaatttaattccacttaaacaataaaaaagtgcgccgatcaagttttcctttctacttttagttaagtagttaattaaagtcatttattcttaggatatgttcataatccttagaacttatcaagctcactatatcacactctcgtttatcaaaacaaactttattatagctatatctctatgcaattctaaagtaaataggttatgctaactacttaattcttttgttacttcataagattttttgtcatatcatttattgctttcttgtgccctatctgaataaaaataagcaacaagtatcttccaatttaaattgaaagcttgctgcttattttcattaaattttgtattattaaatctcaacacatattaatcaactaatgacatttcaattttttcaatgtttccttcagaaagcttaattgcatatttttcacaaattttttcaaaaacttcttcatatgaatatactgcttcagttgaattatattcaataggttcacttttattactcaaaaaattttatattgataatgttttgcattaactttttcaccattttcttttaacactttacttttcatcattaattacctcacatatttttaaaattttaaatgtaaataaaaaagagcgcctattaagcgccccaaccggttcggtttaagtaatcaactgaaaccattttgcacaccggtgtactaattctcatgtatatattataacataaataaattgtgatacaatggttaagcgcaccgaagacttaatcaatctttactaagcgcaagtttggaggtgactcccttgcattggtgtgtactgattctcattgtgcctagtaagcacattaaacatctaattaaatggttactcaagtagtaatcttagcgctgacttttgttggcgctttttcttttataaattattgttattcacaagaatatctcttctttagataaataaaattttcccataagtttcccatggaattaaaataaggtgtttaacaacgtgttattactaatatagcgccattctcgatatatttattcaaccatgcaccaaaagcacccgcctgcaaatattgctgtgtctaaattcatatgtagcaactcttttctttttttaatacttgtaattaattaggatatctggattatttttattttttatttttattttatcaagaaaatcagaaaaaacaatttcagtttgccctctccatgcccccccatttatttaagcgatcatgttcataattgcattttttatagactgaactataatattagtaacagttattttacttttgttaataactgttattgttgaagcgtttcagaaaaagaggcgaagttattatggcacttagtaagcaagaacgtaaggaaatggctcgtaaagctatggaaaagcgtggcagcaagaagccagatggttctggttttgcaaagattgatgctgacgccaagaaactgagcgaataactcttttgaagcaattcacttatatattaaagagacagagatgtgttaacaccgctgtctctttcttttaagcattattttgttctttttcacaaaattccgcaagacgatccattccctttttaatctgctcaatacttgtagcataactaaagcgaagatatccttccccacctttaccaaagtttgatccagccgttacggcaactttggcctcattagcaagttgataaattagcttattgtcatcctgatcaaggaatggtggaatcttggcaaaaatataaaatgcgcccattggttgactacattcaaagcccatctctgtaagccgcttatacatatagtcacgccgtttaatatattaggcgtccatttcctttgttgcctcgtccccagccttttaaagcggcttctgcagcatcctggacaaatgttgcgatatccgtcacagcaaatgcatgaaccttgaacagcagatcggttactttagctggtgcgcaaaggtatccaatccgccacccgatcattgcataggacttcgaaaaatcattagccaaaattgtctggtctggaatgatcttagccatgcttgagtattcaccgtcatagtttaattcactataaatttcatcacagattgcaaagattggcttacccttaattaaggctgctaattcatttctgcttgagtataggcaattccagtcgggttagaagggttaacgaaaatacctccttttactcgatcatcatatttatctagatactgtttaagaagagcaggcgttgtttaaacccagtcttggatgta

SEQ ID NO: 45 - DNA, 38177 bp, Artificial Sequence
  Based on Lactobacillus reuteri
taaaaattcaaaaactaatttcttctaaatgaaaacgaaataaattatagaaaagtaccaaaaccataaacaataagtttgctcgtaatatatcttttgaccatttatgatcaacaatataaatccagatatttttaatcacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtcattaataatacctcatgctaaatttgcacaaaaaacagctaccaggaagaaaaatagcgcagtaagatacgaaatcttcaaattatttctcattattaaacctttccattattgaattagtattagatatttttataataaaaattaaactaatatcttacaagtagttagaagagagaattcaaattgaaattagcaacaaaaaatcttatttatgtagtaacttgtttaatcgtagctactattggaataagtcccaatttgcgtaatcactataagcaaaaggaacaacaaattgttattgctacagctaacaataggtctaagactactaaaaatacatcaaatccagaagcaattagtagccatatgcgtactccaattgattggcacaaatcatctgaaactgtcccttatccagatttatcaaaagtcaaaaatttctggataaaggttagcttgaagaagaaccgaacatacctctatgatggtcaaaagttaatctatacaatgtacagttctggtggaatgtatactaagaatcctcaaacgggcaaaactgaaagtatgacacccatcggaacttactatgctcaagcagaacgtggtaacagtttctttaatcaatcattaggcgaaggagctaattattatgtttcttggctaaatcacggtacctatctctttcacagtgtccctactaagacaggcggaacatacaacgtaaaagaagccgataaattaggaaaatctaccggctctcatggttgtattcgattatctattccagatgctcaatggatgtcttctcatttacctgttgggaccaaaattaaaattgttaactaatttaattccgatcaagcaagcatctattattagcaagacaacgataatcccaccaactctaaggcggaataccggaatcacaaagctaagtaggttgtaaatgattagtcctaatacaacaaagatgtctgttactgctacatgtttaataaatcgtggtgttaattgatttttcattgttatctctctatctaactattattgcagtgcccttgggaacctgtcttagccatttggcatcaggtcttgagacttcgattgtgcatggcaaagaatatttattctttatccagttaccacgtacccggtgattattgatagaatagggtgattcaatataccccaattttctaaaattaagccaattattgcttattccctgattattaccattaacatggaaagtatattcaccacgagcagcattaatagttgtcactgttggggcaatattaaccttagcatttacaatgtaaatcaccttatgatcgctaatcacatataagcgatgggtccctttggtcgccaacaatttgattttcttttgcttttttagttgcgggtatttacctacctcagatgagcgggtaagattagggtgctttaaacgatttaaggcgactctttgactacttattgtagcttcattaatatacttacttgagtttaagttgatgatattaatggcaactagcaggattacaagaaggcttaaagcactataaatcataacctttaattctttattcatattcaaaacatattagctcctggagattgtattttgaagaaaaaattattactaattctaactatctttttactaacatttagcgcaagccttccagttcacgctgcttctaaaatagatgcaaaagcagcgattatggttgatgcttcaactggtcagattatttatgaacaaaacgctaatcagcaattaccaatagcatctattactaaacttttgaccatcgctgttgttcacgatgaactgcaacaacacgccattacagataataccaaggtaacagtaactcctgatattgcagctatttctaatgaccctaattattctagtattggtcttgttagtggtcaatcttattcagtcatcgaattagtgaacgctgcaatggtcaaatcagctgatggggctgttgttgcccttgctactgctgacggcaactctcttgatgagtttgtacttaaaatggaacaaaaggctcatgacattggtcttaaaaaagctaacatcattaatcctactggtctaactaacagtgaaatgaaaagcctaagttcaagtaatgtttcagcaaatgctgagaatgaaatgagcgctaaagatgttgcaatcttatccaggtacttgattcattcttatccagcaattctacaagtaacagcccaaaagaaggctaacttctttatcagtaagaataacgtcaagtccatcgaaaaccttaataagatgctcccaggtgaccaatatactgttcctggtgtcgaaattaacggattaaaaactggaacatcagataaggccggtgcttgctttgtcagcacgggaaactatcgaggccatcaaatcattacagtagttcttcatgctaatggcaataataaagataaccgattcatacaaactcaaaagttgtacaaaatgctgaaacaagattaccacttaaaaaaggttaacctacctgaaaggattactaatgttaaggttaaatatggaacacgacaaacaataactaccactccgaaagaacttaccatttggagcaataaacctttaaagtctttcactatttcccaaaattttaacgataaactgattagtaatacccagaccctacaagccccaataaaaaagggtcaacgtattggaagtatcaaattaaccagtccaacactaaaaacaatatccaatgaaccactcacatactcactatacagcaatgaaaccgtacaaaaaggaaatctattagaaagattattcaactaaaaaagggtacttctccttaacttccccaggaagcaagcactgcttgcgcagccttgctctctcgaaacctagcctatctgtggctaaaaagtttcaagagagttcgctctcattcaacccatcgctcatttactcaactaacaacttacgctattagctcagcaaataagcaatgcagacagtttaagcgcactccgcccttgcccttattcacctcagggttggttttaggttttctctaccttcaaagagaatcttctgcgagaacccgaataactcgcatagtaaataaggttgtccgtagcatttccgaagcttcctatgccactcttttagcattatgtgataaatgcagggattggcgttcccatggttgttaactacaattcctacacgtccaaggaatcacgggcgatttcgagatgcgactacgatgcagtgccactgctagcgagtttatcggttgcgacccaaaagaaaaagccggctagatcaactagtcggctttttatagtttttagggtttaatttcactgataattttgtgtagctatatcttgaaatattagcctatttccactacaattaattgtattgaagaaatagacaaccccgattgactaccttctctagttaatcggtagctcgttaagaaactgcaatttcttaacgggctttttctttactctgatttatttaattattaactgtgttaatgattacacatctttatatttaatacaatagttttttaaaacacatgtatatatacatatatatttatatacatatatatgcttgaagagtttatcaataaaagctatgatagtagtgcaattatcattaggaggtattaacatgaaaacttgcgtaatgtctttttgtaatcaaaaaggcggtgttggaaaaacttccacaaccgccttagttagttataatcttgctaaaatgggatataaatgtttaacaattgactttgatccccaggcaaatcttacttctctttttattaaaacaaaatctaaatatagttccagtgttactccaattaagacttcattaatgacagcaattaaaaataatattgatttctcacaaataactattccagttattgataatcttgatttaatccctaatgcttcagacttcttcctttactcacgttttcttgaaaatacctttaataatgaagcagagcgggtccaatatttagctgacaagataaataccgatttacgaaataagtatgattttatctttattgacgtcccgccaacatttggattagctaatgactcggcattttatgcctgtgaccagttagttattgttttacaaactcaagaacgagctttagacggagctaaagtattggtaaactatctacaatcaaatttaattgatgaatttcattcaaatgttgatattcttggaattttgccggtactttcaaagcgaaatgcacaagttgatactgagattttaaattctgctattcaagaatttggttcagaaaatatttttagcagtcacattatgaccatggaacgtgttaaaagaatggacattaccggaatcactgatggtaaaactgatatttgggataaacgaactcataatgcatatatagacgttgcgaaagaaattcttaaacgattgggagcagaagaataatgtcactacttcaacataatagaaaattatcggataaggtaaacgtacacgtaaagaatcaggttagtcgtgatgaaattgtacccaaaactcaatcagtaaccttcacccgtaatctacgagtcgataatcatattactaaccaagtagccgctctaattgatttaggagtagccgaaaataccaagcaattaattaacgacttagtacaatcacgaattaatcaattaagcaaagaagatcaaaacagattaaataaggtagtacagtcattggaaatgaaagatttctatactgttaaaagtaaactaaagaattaatatatgattgccatcgcataaaatctactagtttaattttcaaataatcttatcactcacctgttttacaggtgcttttttatactcactttgttctaatattcagcctagtataaagtcactattagcagctattctctataaaaataggtagtttacaatgtttttcaagcattttcctctaagtttatagaattatacatttgaccccatttttccatttcaagaataattggtattaaggtcttcccaaaactagttagtctgtattctgtcttcggtggaataacagggtatacctttttttcaataattttatctttctctaattcattaagttgcaaagataacattctacgagaacagttttgcattttcttttgtaattcaccaaacctacataccttattctttataaggtgatataaaataacactcttccatttgccagaaattatttgtaacgtactttcaacagggcatccttcaccgcaattaaaaatatatctttgcaagatataagcactcctttcatctgactaaatattattatcatacattaatttctaatttatcactattagggaaataattgttacataggaattttaaattctcttcttgtctctcttttttattaagttactatttgtaagtatagaaaagaaaagaggaattgatatgaaagcaattggatttactgagcatttaaatattaataaaccagaaagtctacttgattttgaagaaaagaaaccatcacctaaggggcatgatctcctagtaaaagtcagtgctgtatcagtcaatcccgttgatgttattgttcgacggagcggacgtagcaaattaaaaacaccaaaagtaattggctgggacgcttgtggcattgttgaagaaacaggcaagcaggtatccctttttaagcctggtgatagagtcttttacgcaggttcctttaaacgtcccggaagtaatagtgaataccaattggttgatgaacgtattgttggttgtgcaccaaaatcattaaatgatgatgaagcggctgcaatgcctcttacgtcattaacagcatacgaggctttgtttgaacaattatcattacctactaatagtcaagctaatgaaggtaaaacaattcttattatcaatggtgcaggtggtgttggttcagttgcaacacaattggcagctaatgctggactgactgttatcgcttctgcttcacgtccagaaagtatcaactgggttaatgaacatggtgctaagtatacagtaaaccacagaaataatttagttgatgaggtcagaaaccttggctacaaatatgtagattatattttagagttaaaagatcttgataaccattggaaagaaatgtgtgaattaattaagccagaaggtgctattgcttcaattactgaaaataggcgaccaattaatttgcgtcttttaactacgaagaaggctacctttgcatgggaatggatgtataccaagtcttattatcatacagatgatatgcaaactcagcatgaaattttaaacaagattgctcaacttatcgatgaaggcatattgaaatgtactttaactcaatccttgtcccctctaaatgctactaatcttcgtaaagctcatagtttaatagaaagtggacacatgattggcaaagtggttgtttctggatgggaggattaaatgtatgattgaaaacgatagatattaccgccgttacgttaaggatgttgaatcaggctatattttcttacaaactggcttagtaaaaaaaacaattcttgacagcttatttgaaattagctatagattagctatccaaattgcaaaagataagaaatttacagatcaaacattctttaaggatactccatacactcctatctttgataaaacacctttgaaatatgcatcacgcttaattaaacaattcaatcatattcaagatttatatcaggataatcacactgctaaattagtaagtgatataacacaatttttaaagaaactaaataatattcctgatgtacaagaactaacccatagctacttaagcttattaaaaaagactaactacgtaatgccattcttgtcatctaacaaaaccggttatgctaatcttattaataagtatgatcgtttattactattagttgatctaagaaacacacagcaaaataatcctactttaaactatcccgaattagataatgctaaattcattaatctagctagcttactggatatggaagttcgtcatgaaaacagaaatccaacattacaagaatacctcactcgacaaattgcttttgaattgatcaatattcgcggatataatgaagctccaattgtcccttggggaaatagtggttttagaaagattcaaacacaagcatcaattaccgatcctggattggggcacttaacaggtactattcgtaagatggactatattaatggtaccaatgtccatattgaatatcttgaacgtggagaagagaacgatcgtgaaattgtggaaccgtaccgactaccagatatggccactattggtaaagtaaaaatgagcgtcggtagagatacatccgtttcttcatatgttggaaggccgatgtttgaagatacgtttgacaattcatttatcaaatctgttcatacaacaattgcagtttgctcaggaatttttatgaatggcctctctgaatgcaaagtagctattgaaagaatgacagtttcacaagcaataaaatttatgcgtactgtatctgctaatgttgtccgtgatgaaagtctccaagtacttgctgcagccttttgtatcaattatccccttatagatgatcgtgaaacaacgcttaaaaccaataatggtaagccaaagaaaatcaccgatcgaatggagattgctaaactaggtattgagattgctaagcagggtaattttgacaaggtaacatttgatggtacagcgaactggtaccctagtgatcctataatggaacaacttggttataaaaattcattggaactcgtacacaaagcacatgaagtgggactattaacttatttctctgcagggtttagatttaagcacctaactgacattgtacaaacaggtacagatggtatcggtttaggtggagcacaaattttacgatttatggattccaagaatggattccaagacccatttaaacaggaaaatgttaaaaagattctcgatatcaacaaaactgctgcaaatagcgttatcggtcaaggggccattcttcttactagacttgatcggatgtattttgaaggttccttaccagaatgggctaatggacagcgtaatactttatacaaagcactattaaataaggacgaagaaaccactaataatattcttgatagtcttcaagaaataatgcaacttcctatcgatctcgtacatccattggtagcatgggggcaacggattatctctaaccaagatgatgcaattgcctttactaccatgaaaaaggaagaaaaagaacactatattaatctacttaaaagacatattaaacaccatgactataacgaacttaattctgtcttaaaagaaattcattctaataaataatattaagaggagaaataccaatggaaacacaatttaaccaacttagtacaaaacgtcgttcaatttataatctcgggaagaatattaatattgccgataagggtctctttagtgtaattaaacaagcagttcgaaactcaccaagtgcttttaacagtcaaagcgttcggacagtcgttcttcttggcaacaaatcagataaggtttgggatattactgaaaaggccctcgaaaaaattgcaaaagatcctcaaagtttcgatgagacaaaagaaaaaatcgccagtttccgtgcaggatatggaaccattctttttctcaccgatacaactaccgtgcataaattagaaaatgattttccaccatatgcagaaaactttgctgactgggcagaacaatccatcggtggtacacaacaagctgtctggactgctctagctgagttaaatatcggtgcaagtctacaacactataatcctttaattgatgatgaaattcataaggaattttcattacctaacagttggaaattacgagctgaaatgccttttggttcaattgaatctccagctggatcaaaggactttttgagcgaagataaagtatttaaattttttaagtaactagtactgaactagctgattacttatccgaacttacggggtaccttaaaaggtgctctttttttatatttaaattcattctccaaattagttttgatattataaagctagatattaatattggccataataaagctgctatgtaatatagagtctattaatataaataacttccagaaatcaaaaacgcctgccgcacgcgacagacgctgttttattctgctgaagtgctaaagtagacgctttaacagttcaagaatgaacttaatcagttttttcagttgcttcttacttaaaaaaggcaacaatacaaagatgaagatacaatgagtcactgggaagaacctccttcccacacacaaattgaatgcttgatgagggcactctggtgtgctttaacattgtatcatagaaaactttcggctataatgtaggtacaaagatgaagatgctggtgtgcaaattggatcagctgattacttatccgagccggcggggtacctgaaaaggtgctcttttttataccaatttttcttatctagggtctatttgtgataaatagcccctcggaaacgttgaaaaataaacccctagctagacgtaatgcctagttaggggttattattttgctatattgaattattcaccctgattttgtgggttaatggcaactgataagatgtaatgtgataactgattatcggcaacatcttggaccttaaacagtgtccaaactcgttcggctggttgcgtatcttgtaagtaacgacgaatgccggccaaataaggcttaactctttgtaaatccataaacagcataccgttttgtaataaacattgccgttctgcactactaagctgcaatccagcttgaagttgtaagtcctcatcagtttctgcaataatttcactattatttttaaccatcatgagtacctcctaggatcatttctattcacaaatcctattcggcgctcgtgagcgcccttagtaaaaattacttcctacccaaggtgcttctactgtcatgatataattgaaaggctgtcacatactcacttagaatctactttctaatgttgggaggtgagaacctatgaataatctgctaacctatcttttacactatttatcacaattatccctcgtggtaattcccgtttgcctggcgtattggttaaaccatcgcaagtgataaatagtcagtgacagcattcaacccacaattaaagccccttggtaattatggcggattaccgaggggcttttgtgttggtgagaacttaatacataatcctcaactatcttttacacttatattataacatgaatcaaacaaaggacaattaacatgaaacaactagtactaccaatcaaagacagtaatgttctacatgaagttgaggatactttactccataatttcaaagctggccgccgtaattacaccatcttccaagttggcaaggctactctgctccgagtgtctgatttattagctctgagacgcaatgaaatcttcaataatgatggaactatcgctaaaaatgcttatattcgtgataaaaagaccggaaagcccaatattttgtacttaaaaccagtaaaacaggatctaatatactactttcaatggctaaaccaaaaaaatatctactccgaatggcttttcccttcaactaaacacccagatcgtcatattacggagaagcaattctacaaaattatggccaaaactggtgatctgctcggtattgattacctcggtactcatacaatgagaaaaactggagcttatcgggtctacacgcaaactcattataatatcggtctagtaatgtcactcctcaaccactcatcagaagcaatgaccctcaagtatttaggactggatcaagtcagccgtgaacaaatgctcgatgaagtgaggttcgattaagatttttcacctattgttatactcaaatattgtcgatttatctggttgatatttatcaagcattttagataatattttttctaatggtatcaaattttcctctaaccataaggcatctggaggcaatacatacacctgttctctttcgggtattttactatttctcttattacgacgctcttctatagcatctaacacataattatgagcactaataagatttccatgaatatcaccattacctttaatagtaattgaattgcctggaataaagtcttctggtttataaccagctaattccaaaaaataaattgcttttaatatccataaccgatattggtgcttaactgctaaattacttggtaatttctccatattattcaaaacttctttcttattttattctactacgtaatgagtaaagtttactaagtgtataaaaagtattgcttaatcagcatacgtctttacatatacgattaaatcgtatatactgattgtggaggatatatatgtgtaataaagtaaaatttatctttggtcagtcttttatggaacaatggtatgcttgtggcttaaccaaagaaaaccgacaagaattaattgatgatatttcttattatctacgtaatgctccagataataaccacggtaagaagtttcctggtgctattattgaaggaactgggggagctattaaatatcgcttcactccagataattatcaaaagggcaaaagtggtagttttcgaacaatctactttgtttatgatgcttcaatcaatcacttattcttcttgacagtttatcctaagaataagaaggccactttatctaaacgagaaaagcatttaattaagaaattcattgaagctaaaaaacgtgataggaaggagaaataattatggcatcaattattgaaaattcattgaaagaataccaagactttttagatggaaaagatactaacgtagaagttattgaaacatctattcctataaggccagaatttgacggtaacgttatcaaaaatttgcgaaagcaaataaacgtcactcaaaaaggtttagctggccttattggtgtttctccccggactgtagaatcatgggaaatggatcgaactgaaccaaaccgttcatcacaaaaacttctaacccttttaattagaaataattccttagtaaacgaactacgtttaatctaaaataacttaaaggagaaatttaaatggataacgattttttagaagaaatgcttgaaattttaaatccctacgttggtacagaagaaggtagtggaagtaatgaaggggccgtatatggaaactacatcgaatggcccgacttagaaactcttgaagacgatcaactaaatcaactagcagcttattttgatattgatagtgataaatatagtgaagatgaattagtagaccttttacgagaaaaaggagttcctgagggcacaagttatgaatatgatgctgattttcctgatagtgcaaagtactataattgttaaactaaaggaaacctttttcactaaaaataaattgattaatatttcaataattcaaggaggtaattataatgagcgaaacagaagaactaaaagcatttaagcaaaagctcgaattaaaatatggtcgtttagcaaaaaaacgtttagcaaagttatccaaagttgctaagctagataaacaattaattgatatgactgataaagaatttgatcaacaattaaacaattggtttaatcaagataattccaaaaatattcatggtgaacaacaattacaagaacataataatcaacaaccattttaaaattagagttcattacgtaagttttgaactcttttttaatcttaacttttttgaaaagttaagcaactgtttgagcccttttcgttgatgaaaaagtactttatttatccaaacttgtaaccaaatttggtcggtgttcggttacctttgacgaattcaaaaggtaacttgctgatgaaacttgcaagtaagtttctgtttgttttgtttactttttcgacaaggaaaaaagtaaattgtcttggctacttcacaacaagaagtagcactaaaagggtcaagggaaagatgtaatctgttcctgcaagcaatacaagtgtcactaattaacgtagttaatgtgtacacgaagtaaactgcttgctcacgctgataagtgttataatttgaagtgagattgggacgcttgactgtaggtcaaaggacttttcgaactctcaaattattcttgatgtggaggaattataatggcgaagttggtaaacaaacacattagaattacggaacagcaagaccaacacttatcagcgttgagcgccaagacagggtataacgtcaacgaactaattcgtaaaatcttagataacgttgatgacgttaccctgacgacagcgctcagtcgacagcaagcaactgctaaccgtgaaatacagttacttgctagtcgaaaatacattatggatacattatcacggacacaagtatttaataatattaatcagattgcccactatattaataagtatcctaataatgatttaggaaaggaattggttaatacatttaatactgtaattaaagagatcaatgaattacggagtgatattaatgagcattgttaaagttattagttctactaacgctggtgcaaatcttaattatttaattaacgaaaaggcacataatactgaacttactagtcatcgttcactaaaacttaacggacaaaatgtatatagggactatgccaataaatttaattcccggtatcttgctgatcaatactgggcagtcaggcaacgagctaaaagtccaaataaaaaggttcaagttcaccacttgattttcagttttagtcagcaagaatttaatccaactaaacaaactctactcaaacaagcccagcaagcattaaagttagttaatgattttttacatcaattattaccatcaactgctcaatatttagaagcagttcagtgtgactccaaaggtaaaaatctacatgtccacgtttcctgcaattcgattcttaccaatggaaaagtacttgatactaatttgattagcgttaactcccgaactgtaattaaaaataaaaaacaagttcattatctcggtattcgtgatcaatttgataattacatgaccaaacatttcgaaaaattaactggtcgtgaattccatcctgttacaaaagataacaccaatctcgttaactccaaagccgttaaaattgatgaacgtggtggttacatctggaaagaagatctaaaagaacgtattcttgatgccttcaataatactgataattttgaagactttgaggcggtcttagaagctgataatggggttaaagttaaacatcgtcgagcttcaattggtaaagatgaacacggcaaaaagatctatcgtgatgccgttacgtacacttttaccgatataaattctactccccactcagcccgtgattttgcctatactaaaaatggaggtaaacgaggtcttggtctctcatttacgccacaagctattcagcatgagttcgagcagcgtcaggagaaggatcagcagattgataaagaacaagctgaggctaatcctgacacttcacagcaaataaatgctgaaatgcaacaacaactgctattgcagcaacagattaaccaaagattgctaaacgaagaaagtgaggatgataattatggcaatcaaacgcggaaatcagtttcagtccaaaaatacgaatcaggaggcaccagcacaccagctgaattcgacacaagggcatatgacgccgaaacccaacggcaagaatctgacaacaaacgtaaacgagatcaaatcagacgtcaaggctctaaggaagcaaacaaacacgctgaacggccaagccagcaacaacagcaagagcctaacaagcgtccttcaaaaccaaagcacgatcatcagccaacaaacaacaatcaggaaccaaacagagttcaccgctcagaaccaggacaatctgaaccaatcactgagcaacaccaacacgacactgaagggcctaggttataaagttgataacgtccgtggtgatcaatcactgttacaatcactaattaaccgtgttaatgcgttagagaaaaagccagatgagcaaaaacggttgcttgatgaatacgtccgtaactgggattctctaacacaacaagtaggtaagatccaggatggtcaagtgcaattcagccaatcggttcaaaggttactaagtagtatggcttattatgtaaagaataagcaaattaccgttgatgcttcaacaatggaagcattacgtgaagtcgtagaagctaggactaataattcccttgataaatatgttggaaaagttcaagctcaagcaattgatgctaacttccaaaagttagttaatgctatcaatgctcaagaagaaccaattcaacaaaaactagatttaattgatcaacgattagacggtatagatgatcgagtggagcaacttgatcgtgtatttacaatactaatgtacgtaacctttgcaatgcttcttgcaggagccttcgcaggtatgacactttggatcaacgcactcaaccatcaccccgtattagcttggatcgtacttttagtaatagttgttctaggtatttggtcatataagcgagccaaaaaagaaagtgaagatgaatagtatgacaaacaaccaaaaagaaagttggaacgttggcaactataaaatcaatgtattaccagatgatgagttccagcaattgttaaagaaccaacgccaacttcaacagatcattgaaagtatgccactaccaaccgaccccaatgttgatctagttaaaaagattcattcccaactccctattacaaactgggcttgggaattaactaaacaacgagaacatgaggaaaagttaaagaaacaaaagcagcgaattgcacagcaatcgcttaactatccaacaaacctcaagaaaccggataatggcctttccctataagccgatatcgacttacctttcagataaactaaatagtaaaggagctaacgtaatttgctagctcctttattacttactttatttaaatattactgtcagattcattaataccaatcctactaataagactttcatatttaatggacccatatgtaataaaacataaaatattattattagtagtagaaatccatttgcgataatcaaattctttttcaaattagaattcattaatggcctccttgtagtaaaaatgatactgatattatcaatatgaaataaaacaatgcacaatacattgagtttaaggcatcttttctcacaacttattctcctaataaattattaccggttctcctttagtaagggcatggaaaccgtctcctgcattttccggatgcatgttaatacagccatgtgagccaccatgagtctgtttataagctgttttagaccaattatgcctccaactagcatcatgaaagccacaccctgataaagtaaacggagaccaatactgaacaggactactatacttggaaccatcatcattagtcccacgtaaaactgatggcgtttgttgatacatgatataccaaacacctttaggagtcctattattagcgtcatctgatccactaacaatatctgtactcagtacacattttccatttttataaaaccaagcatgctgtttagctaatgatacagccacataagtattaccaagcccatgattattcacagccgaatatccagtaccaagatgactatagcctttaccgtaaatatcattttcggcattaacgctcttaacattattagctaacgctttagagagtgtttgtcctgcctgcttgctacttattttccaaccatatgttccctgattagatgtagaaataacttttccagaatcagttctaaatttaaagctctttcctaatgttgcttgcttattatttatattggcaatcttggatttaacgttgtcagtttcaaaatggtatttcccatgctgataagttgctttagaaatgacattagacgctttaaaattatattttgttttctgaacctgataaacaaccgatcgattttgtagtttactcaggtgtttcttttcatcttgaactactttactgtttgccgataaaggagtaataaccttaggagttaaatgaattgtcccattaacaaattccttattagcaatattacaaagtccttgttcactatatcgtgtcccatcaattgctggaataactgaaactttattattctggtaaacggcgtatgcatcacgtggggcctttctgcctatattgagctgatgaatcctagctactattgccgaatcaatattatttaacgctgacttatctaaatcagctggctcaactagcaaattttcatgttttcgtgagggaaaaaaagtgtattggtaatgtaacgccttactaaatctttctttatcagataacttaaaacctgagtcagtacttttacctgaataaactaactttttgttaatgtagatttttgattttcttttagtattacttactttattatatgcctgttgaacagtaagacctccgactggaatattattaatcttcacgtttttgttaaagtgtgtcttttgatgaaggtgcatacctaaaagaaataccattagcatgcctaatgtaataataattagttttttcaatgttaatttatccataaatagaactccattttagtatagaaaagctctaccttactacatacataaggtggagttctttttatattaagctatatatattacaatactcttcttgcaaaggcaggcatgtaatagcgcattggttgttccttaactgtttgaccaggttgcggtgcaaataaaacattaccgtttccggtatagattccaacgtgatatgcactaccatactttccccagaacattagatctccaggttgaagattattaaagcttacagcatgtccacaatattcttgttgagttgtagtccgtggtaagttaacaccaacttgacgataaacatactgcacgagtcctgaacaatcaaacgaattaggaccggttgctccccaaacataaggtttacctatttgttgacgtgcaagagcaacaacttgttggcccttattaccttgcggaactgccggagtactagaaggattattatttgatgttactggagtcccattaaatgaaaagttatttgaatcgtaaccgtaagttgttccattactcaaattcttaatcgcaacataacgacgtacgccactataactcatgtatgatacccaaagatacccattagcttcaatctttgaatcatatgtaaagctttgaccaccattgtaatacgttacaatagctgccgatgtacttggtgcttggcgtacatttaatccataagcaactttgaatgttccatattgcttctcagttgatgaagtagatgtacttggtgctggcgtacttggcacattagtagatggtgttgaagatgcaggagcactgtatgagaagttattcgaatcataaccgtaagtcgttccattattcaaattcttaattgcaacataacgacgtacgccactataactcatgtatgatacccaaagatacccgttagcttcaatctttgaatcatatgtaaagctttgaccaccattgtaatacgttacaatagctgccgatgtacttggtgcttggcgtacatttaatccataagcaactttgaatgtcccgtgttgactcattcgacttgagctaggagttgttgctggtgtactaggattttgttgtaccggtgctgatgtagaaccatgactttggaaatactgataccagtattgagcctgttgaccacgagctggctgattcctatttgcaggtcgctcaaagttattaagccaaatcatacctaaagtatatgctgaagcataactatgcatatattcattagcggtcattctagagtaagctgatggataatactgctgtccatgagtcatttgatattcaatatatgcacattgtccttgcaaagtacgataatcatatccattattacgacaccaatttactacactattaaatggccattgagctaacccataaccaggcccaccaccatattgatgtaagtctgggattaaacctgactctgaaacaaagttaccaagcattccagcaatagcatttggtgtccatccttgatttataaagtaatcatgaatagtcgtcgcattattgatctgttgttgagtgtaattcgtaacatactcttcggttgttagttcagatacatttattgcaggctgttcctgcgtatttacgttaaatgactgaatattatcggaactagcagaattagccactgccgtggaatcgctagaagcaatgttcccaatattatcagcatttgattcgacattagtattgtcagtatccgattttacattattcttttcatttatctttgctacagaactagaattagcattagaactaggatttacagtaatttgagcttttgcatcgtttgacattacaacattttgttgagtctttgtgtcattagtttgcaaactcatattactgattgtctggttactattactttgaatgttatcggcatgcacgtttgtagctgataaaaccagtagagcaaatggcgctgccaagaaaactcctaatttatggtttaattgcatgaaccgaaaacttccttcaataatttttcggtgattataatagcatcattttctaatttgttaatctttaaacaaattgttttggagataaatcattaatatcatctaacaaatttgttaagtactgtattaaaaagcaaacacgcattcattaaaataaatagttttataaaaattcaaaaactaatttcttctaaatgaaaacgaaataaattatagaaaagtaccaaaaccataaacaataagtttgctcgtaatatatcttttgaccatttatgatcaacaatataaatccagatatttttaatcacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtcattaataatacctcatgctaaatttgcacaaaaaacagctaccaggaagaaaaatagcgcagtaagatacgaaatcttcaaattatttctcattattaaacctttccattattgaattagtattagatatttttataataaaaattaaactaatatcttacaagtagttagaagagagaattcaaattgaaattagcaacaaaaaatcttatttatgtagtaacttgtttaatcgtagctactattggaataagtcccaatttgcgtaatcactataagcaaaaggaacaacaaattgttattgctacagctaacaataggtctaagactactaaaaatacatcaaatccagaagcaattagtagccatatgcgtactccaattgattggcacaaatcatctgaaactgtcccttatccagatttatcaaaagtcaaaaatttctggataaaggttagcttgaagaagaaccgaacatacctctatgatggtcaaaagttaatctatacaatgtacagttctggtggaatgtatactaagaatcctcaaacgggcaaaactgaaagtatgacacccatcggaacttactatgctcaagcagaacgtggtaacagtttctttaatcaatcattaggcgaaggagctaattattatgtttcttggctaaatcacggtacctatctctttcacagtgtccctactaagacaggcggaacatacaacgtaaaagaagccgataaattaggaaaatctaccggctctcatggttgtattcgattatctattccagatgctcaatggatgtcttctcatttacctgttgggaccaaaattaaaattgttaactaatttaattccgatcaagcaagcatctattattagcaagacaacgataatcccaccaactctaaggcggaataccggaatcacaaagctaagtaggttgtaaatgattagtcctaatacaacaaagatgtctgttactgctacatgtttaataaatcgtggtgttaattgatttttcattgttatctctctatctaactattattgcagtgcccttgggaacctgtcttagccatttggcatcaggtcttgagacttcgattgtgcatggcaaagaatatttattctttatccagttaccacgtacccggtgattattgatagaatagggtgattcaatataccccaattttctaaaattaagccaattattgcttattccctgattattaccattaacatggaaagtatattcaccacgagcagcattaatagttgtcactgttggggcaatattaaccttagcatttacaatgtaaatcaccttatgatcgctaatcacatataagcgatgggtccctttggtcgccaacaatttgattttcttttgcttttttagttgcgggtatttacctacctcagatgagcgggtaagattagggtgctttaaacgatttaaggcgactctttgactacttattgtagcttcattaatatacttacttgagtttaagttgatgatattaatggcaactagcaggattacaagaaggcttaaagcactataaatcataacctttaattctttattcatattcaaaacatattagctcctggagattgtattttgaagaaaaaattattactaattctaactatctttttactaacatttagcgcaagccttccagttcacgctgcttctaaaatagatgcaaaagcagcgattatggttgatgcttcaactggtcagattatttatgaacaaaacgctaatcagcaattaccaatagcatctattactaaacttttgaccatcgctgttgttcacgatgaactgcaacaacacgccattacagataataccaaggtaacagtaactcctgatattgcagctatttctaatgaccctaattattctagtattggtcttgttagtggtcaatcttattcagtcatcgaattagtgaacgctgcaatggtcaaatcagctgatggggctgttgttgcccttgctactgctgacggcaactctcttgatgagtttgtacttaaaatggaacaaaaggctcatgacattggtcttaaaaaagctaacatcattaatcctactggtctaactaacagtgaaatgaaaagcctaagttcaagtaatgtttcagcaaatgctgagaatgaaatgagcgctaaagatgttgcaatcttatccaggtacttgattcattcttatccagcaattctacaagtaacagcccaaaagaaggctaacttctttatcagtaagaataacgtcaagtccatcgaaaaccttaataagatgctcccaggtgaccaatatactgttcctggtgtcgaaattaacggattaaaaactggaacatcagataaggccggtgcttgctttgtcagcacgggaaactatcgaggccatcaaatcattacagtagttcttcatgctaatggcaataataaagataaccgattcatacaaactcaaaagttgtacaaaatgctgaaacaagattaccacttaaaaaaggttaacctacctgaaaggattactaatgttaaggttaaatatggaacacgacaaacaataactaccactccgaaagaacttaccatttggagcaataaacctttaaagtctttcactatttcccaaaattttaacgataaactgattagtaatacccagaccctacaagccccaataaaaaagggtcaacgtattggaagtatcaaattaaccagtccaacactaaaaacaatatccaatgaaccactcacatactcactatacagcaatgaaaccgtacaaaaaggaaatctattagaaagattattcaactaaaaaagggtacttctccttaacttccccaggaagcaagcactgcttgcgcagccttgctctctcgaaacctagcctatctgtggctaaaaagtttcaagagagttcgctctcattcaacccatcgctcatttactcaactaacaacttacgctattagctcagcaaataagcaatgcagacagtttaagcgcactccgcccttgcccttattcacctcagggttggttttaggttttctctaccttcaaagagaatcttctgcgagaacccgaataactcgcatagtaaataaggttgtccgtagcatttccgaagcttcctatgccactcttttagcattatgtgataaatgcagggattggcgttcccatggttgttaactacaattcctacacgtccaaggaatcacgggcgatttcgagatgcgactacgatgcagtgccactgctagcgagtttatcggttgcgacccaaaagaaaaagccggctagatcaactagtcggctttttatagtttttagggtttaatttcactgataattttgtgtagctatatcttgaaatattagcctatttccactacaattaattgtattgaagaaatagacaaccccgattgactaccttctctagttaatcggtagctcgttaagaaactgcaatttcttaacgggctttttctttactctgatttatttaattattaactgtgttaatgattacacatctttatatttaatacaatagttttttaaaacacatgtatatatacatatatatttatatacatatatatgcttgaagagtttatcaataaaagctatgatagtagtgcaattatcattaggaggtattaacatgaaaacttgcgtaatgtctttttgtaatcaaaaaggcggtgttggaaaaacttccacaaccgccttagttagttataatcttgctaaaatgggatataaatgtttaacaattgactttgatccccaggcaaatcttacttctctttttattaaaacaaaatctaaatatagttccagtgttactccaattaagacttcattaatgacagcaattaaaaataatattgatttctcacaaataactattccagttattgataatcttgatttaatccctaatgcttcagacttcttcctttactcacgttttcttgaaaatacctttaataatgaagcagagcgggtccaatatttagctgacaagataaataccgatttacgaaataagtatgattttatctttattgacgtcccgccaacatttggattagctaatgactcggcattttatgcctgtgaccagttagttattgttttacaaactcaagaacgagctttagacggagctaaagtattggtaaactatctacaatcaaatttaattgatgaatttcattcaaatgttgatattcttggaattttgccggtactttcaaagcgaaatgcacaagttgatactgagattttaaattctgctattcaagaatttggttcagaaaatatttttagcagtcacattatgaccatggaacgtgttaaaagaatggacattaccggaatcactgatggtaaaactgatatttgggataaacgaactcataatgcatatatagacgttgcgaaagaaattcttaaacgattgggagcagaagaataatgtcactacttcaacataatagaaaattatcggataaggtaaacgtacacgtaaagaatcaggttagtcgtgatgaaattgtacccaaaactcaatcagtaaccttcacccgtaatctacgagtcgataatcatattactaaccaagtagccgctctaattgatttaggagtagccgaaaataccaagcaattaattaacgacttagtacaatcacgaattaatcaattaagcaaagaagatcaaaacagattaaataaggtagtacagtcattggaaatgaaagatttctatactgttaaaagtaaactaaagaattaatatatgattgccatcgcataaaatctactagtttaattttcaaataatcttatcactcacctgttttacaggtgcttttttatactcactttgttctaatattcagcctagtataaagtcactattagcagctattctctataaaaataggtagtttacaatgtttttcaagcattttcctctaagtttatagaattatacatttgaccccatttttccatttcaagaataattggtattaaggtcttcccaaaactagttagtctgtattctgtcttcggtggaataacagggtatacctttttttcaataattttatctttctctaattcattaagttgcaaagataacattctacgagaacagttttgcattttcttttgtaattcaccaaacctacataccttattctttataaggtgatataaaataacactcttccatttgccagaaattatttgtaacgtactttcaacagggcatccttcaccgcaattaaaaatatatctttgcaagatataagcactcctttcatctgactaaatattattatcatacattaatttctaatttatcactattagggaaataattgttacataggaattttaaattctcttcttgtctctcttttttattaagttactatttgtaagtatagaaaagaaaagaggaattgatatgaaagcaattggatttactgagcatttaaatattaataaaccagaaagtctacttgattttgaagaaaagaaaccatcacctaaggggcatgatctcctagtaaaagtcagtgctgtatcagtcaatcccgttgatgttattgttcgacggagcggacgtagcaaattaaaaacaccaaaagtaattggctgggacgcttgtggcattgttgaagaaacaggcaagcaggtatccctttttaagcctggtgatagagtcttttacgcaggttcctttaaacgtcccggaagtaatagtgaataccaattggttgatgaacgtattgttggttgtgcaccaaaatcattaaatgatgatgaagcggctgcaatgcctcttacgtcattaacagcatacgaggctttgtttgaacaattatcattacctactaatagtcaagctaatgaaggtaaaacaattcttattatcaatggtgcaggtggtgttggttcagttgcaacacaattggcagctaatgctggactgactgttatcgcttctgcttcacgtccagaaagtatcaactgggttaatgaacatggtgctaagtatacagtaaaccacagaaataatttagttgatgaggtcagaaaccttggctacaaatatgtagattatattttagagttaaaagatcttgataaccattggaaagaaatgtgtgaattaattaagccagaaggtgctattgcttcaattactgaaaataggcgaccaattaatttgcgtcttttaactacgaagaaggctacctttgcatgggaatggatgtataccaagtcttattatcatacagatgatatgcaaactcagcatgaaattttaaacaagattgctcaacttatcgatgaaggcatattgaaatgtactttaactcaatccttgtcccctctaaatgctactaatcttcgtaaagctcatagtttaatagaaagtggacacatgattggcaaagtggttgtttctggatgggaggattaaatgtatgattgaaaacgatagatattaccgccgttacgttaaggatgttgaatcaggctatattttcttacaaactggcttagtaaaaaaaacaattcttgacagcttatttgaaattagctatagattagctatccaaattgcaaaagataagaaatttacagatcaaacattctttaaggatactccatacactcctatctttgataaaacacctttgaaatatgcatcacgcttaattaaacaattcaatcatattcaagatttatatcaggataatcacactgctaaattagtaagtgatataacacaatttttaaagaaactaaataatattcctgatgtacaagaactaacccatagctacttaagcttattaaaaaagactaactacgtaatgccattcttgtcatctaacaaaaccggttatgctaatcttattaataagtatgatcgtttattactattagttgatctaagaaacacacagcaaaataatcctactttaaactatcccgaattagataatgctaaattcattaatctagctagcttactggatatggaagttcgtcatgaaaacagaaatccaacattacaagaatacctcactcgacaaattgcttttgaattgatcaatattcgcggatataatgaagctccaattgtcccttggggaaatagtggttttagaaagattcaaacacaagcatcaattaccgatcctggattggggcacttaacaggtactattcgtaagatggactatattaatggtaccaatgtccatattgaatatcttgaacgtggagaagagaacgatcgtgaaattgtggaaccgtaccgactaccagatatggccactattggtaaagtaaaaatgagcgtcggtagagatacatccgtttcttcatatgttggaaggccgatgtttgaagatacgtttgacaattcatttatcaaatctgttcatacaacaattgcagtttgctcaggaatttttatgaatggcctctctgaatgcaaagtagctattgaaagaatgacagtttcacaagcaataaaatttatgcgtactgtatctgctaatgttgtccgtgatgaaagtctccaagtacttgctgcagccttttgtatcaattatccccttatagatgatcgtgaaacaacgcttaaaaccaataatggtaagccaaagaaaatcaccgatcgaatggagattgctaaactaggtattgagattgctaagcagggtaattttgacaaggtaacatttgatggtacagcgaactggtaccctagtgatcctataatggaacaacttggttataaaaattcattggaactcgtacacaaagcacatgaagtgggactattaacttatttctctgcagggtttagatttaagcacctaactgacattgtacaaacaggtacagatggtatcggtttaggtggagcacaaattttacgatttatggattccaagaatggattccaagacccatttaaacaggaaaatgttaaaaagattctcgatatcaacaaaactgctgcaaatagcgttatcggtcaaggggccattcttcttactagacttgatcggatgtattttgaaggttccttaccagaatgggctaatggacagcgtaatactttatacaaagcactattaaataaggacgaagaaaccactaataatattcttgatagtcttcaagaaataatgcaacttcctatcgatctcgtacatccattggtagcatgggggcaacggattatctctaaccaagatgatgcaattgcctttactaccatgaaaaaggaagaaaaagaacactatattaatctacttaaaagacatattaaacaccatgactataacgaacttaattctgtcttaaaagaaattcattctaataaataatattaagaggagaaataccaatggaaacacaatttaaccaacttagtacaaaacgtcgttcaatttataatctcgggaagaatattaatattgccgataagggtctctttagtgtaattaaacaagcagttcgaaactcaccaagtgcttttaacagtcaaagcgttcggacagtcgttcttcttggcaacaaatcagataaggtttgggatattactgaaaaggccctcgaaaaaattgcaaaagatcctcaaagtttcgatgagacaaaagaaaaaatcgccagtttccgtgcaggatatggaaccattctttttctcaccgatacaactaccgtgcataaattagaaaatgattttccaccatatgcagaaaactttgctgactgggcagaacaatccatcggtggtacacaacaagctgtctggactgctctagctgagttaaatatcggtgcaagtctacaacactataatcctttaattgatgatgaaattcataaggaattttcattacctaacagttggaaattacgagctgaaatgccttttggttcaattgaatctccagctggatcaaaggactttttgagcgaagataaagtatttaaattttttaagtaactagtactgaactagctgattacttatccgaacttacggggtaccttaaaaggtgctctttttttatatttaaattcattctccaaattagttttgatattataaagctagatattaatattggccataataaagctgctatgtaatatagagtctattaatataaataacttccagaaatcaaaaacgcctgccgcacgcgacagacgctgttttattctgctgaagtgctaaagtagacgctttaacagttcaagaatgaacttaatcagttttttcagttgcttcttacttaaaaaaggcaacaatacaaagatgaagatacaatgagtcactgggaagaacctccttcccacacacaaattgaatgcttgatgagggcactctggtgtgctttaacattgtatcatagaaaactttcggctataatgtaggtacaaagatgaagatgctggtgtgcaaattggatcagctgattacttatccgagccggcggggtacctgaaaaggtgctcttttttataccaatttttcttatctagggtctatttgtgataaatagcccctcggaaacgttgaaaaataaacccctagctagacgtaatgcctagttaggggttattattttgctatattgaattattcaccctgattttgtgggttaatggcaactgataagatgtaatgtgataactgattatcggcaacatcttggaccttaaacagtgtccaaactcgttcggctggttgcgtatcttgtaagtaacgacgaatgccggccaaataaggcttaactctttgtaaatccataaacagcataccgttttgtaataaacattgccgttctgcactactaagctgcaatccagcttgaagttgtaagtcctcatcagtttctgcaataatttcactattatttttaaccatcatgagtacctcctaggatcatttctattcacaaatcctattcggcgctcgtgagcgcccttagtaaaaattacttcctacccaaggtgcttctactgtcatgatataattgaaaggctgtcacatactcacttagaatctactttctaatgttgggaggtgagaacctatgaataatctgctaacctatcttttacactatttatcacaattatccctcgtggtaattcccgtttgcctggcgtattggttaaaccatcgcaagtgataaatagtcagtgacagcattcaacccacaattaaagccccttggtaattatggcggattaccgaggggcttttgtgttggtgagaacttaatacataatcctcaactatcttttacacttatattataacatgaatcaaacaaaggacaattaacatgaaacaactagtactaccaatcaaagacagtaatgttctacatgaagttgaggatactttactccataatttcaaagctggccgccgtaattacaccatcttccaagttggcaaggctactctgctccgagtgtctgatttattagctctgagacgcaatgaaatcttcaataatgatggaactatcgctaaaaatgcttatattcgtgataaaaagaccggaaagcccaatattttgtacttaaaaccagtaaaacaggatctaatatactactttcaatggctaaaccaaaaaaatatctactccgaatggcttttcccttcaactaaacacccagatcgtcatattacggagaagcaattctacaaaattatggccaaaactggtgatctgctcggtattgattacctcggtactcatacaatgagaaaaactggagcttatcgggtctacacgcaaactcattataatatcggtctagtaatgtcactcctcaaccactcatcagaagcaatgaccctcaagtatttaggactggatcaagtcagccgtgaacaaatgctcgatgaagtgaggttcgattaagatttttcacctattgttatactcaaatattgtcgatttatctggttgatatttatcaagcattttagataatattttttctaatggtatcaaattttcctctaaccataaggcatctggaggcaatacatacacctgttctctttcgggtattttactatttctcttattacgacgctcttctatagcatctaacacataattatgagcactaataagatttccatgaatatcaccattacctttaatagtaattgaattgcctggaataaagtcttctggtttataaccagctaattccaaaaaataaattgcttttaatatccataaccgatattggtgcttaactgctaaattacttggtaatttctccatattattcaaaacttctttcttattttattctactacgtaatgagtaaagtttactaagtgtataaaaagtattgcttaatcagcatacgtctttacatatacgattaaatcgtatatactgattgtggaggatatatatgtgtaataaagtaaaatttatctttggtcagtcttttatggaacaatggtatgcttgtggcttaaccaaagaaaaccgacaagaattaattgatgatatttcttattatctacgtaatgctccagataataaccacggtaagaagtttcctggtgctattattgaaggaactgggggagctattaaatatcgcttcactccagataattatcaaaagggcaaaagtggtagttttcgaacaatctactttgtttatgatgcttcaatcaatcacttattcttcttgacagtttatcctaagaataagaaggccactttatctaaacgagaaaagcatttaattaagaaattcattgaagctaaaaaacgtgataggaaggagaaataattatggcatcaattattgaaaattcattgaaagaataccaagactttttagatggaaaagatactaacgtagaagttattgaaacatctattcctataaggccagaatttgacggtaacgttatcaaaaatttgcgaaagcaaataaacgtcactcaaaaaggtttagctggccttattggtgtttctccccggactgtagaatcatgggaaatggatcgaactgaaccaaaccgttcatcacaaaaacttctaacccttttaattagaaataattccttagtaaacgaactacgtttaatctaaaataacttaaaggagaaatttaaatggataacgattttttagaagaaatgcttgaaattttaaatccctacgttggtacagaagaaggtagtggaagtaatgaaggggccgtatatggaaactacatcgaatggcccgacttagaaactcttgaagacgatcaactaaatcaactagcagcttattttgatattgatagtgataaatatagtgaagatgaattagtagaccttttacgagaaaaaggagttcctgagggcacaagttatgaatatgatgctgattttcctgatagtgcaaagtactataattgttaaactaaaggaaacctttttcactaaaaataaattgattaatatttcaataattcaaggaggtaattataatgagcgaaacagaagaactaaaagcatttaagcaaaagctcgaattaaaatatggtcgtttagcaaaaaaacgtttagcaaagttatccaaagttgctaagctagataaacaattaattgatatgactgataaagaatttgatcaacaattaaacaattggtttaatcaagataattccaaaaatattcatggtgaacaacaattacaagaacataataatcaacaaccattttaaaattagagttcattacgtaagttttgaactcttttttaatcttaacttttttgaaaagttaagcaactgtttgagcccttttcgttgatgaaaaagtactttatttatccaaacttgtaaccaaatttggtcggtgttcggttacctttgacgaattcaaaaggtaacttgctgatgaaacttgcaagtaagtttctgtttgttttgtttactttttcgacaaggaaaaaagtaaattgtcttggctacttcacaacaagaagtagcactaaaagggtcaagggaaagatgtaatctgttcctgcaagcaatacaagtgtcactaattaacgtagttaatgtgtacacgaagtaaactgcttgctcacgctgataagtgttataatttgaagtgagattgggacgcttgactgtaggtcaaaggacttttcgaactctcaaattattcttgatgtggaggaattataatggcgaagttggtaaacaaacacattagaattacggaacagcaagaccaacacttatcagcgttgagcgccaagacagggtataacgtcaacgaactaattcgtaaaatcttagataacgttgatgacgttaccctgacgacagcgctcagtcgacagcaagcaactgctaaccgtgaaatacagttacttgctagtcgaaaatacattatggatacattatcacggacacaagtatttaataatattaatcagattgcccactatattaataagtatcctaataatgatttaggaaaggaattggttaatacatttaatactgtaattaaagagatcaatgaattacggagtgatattaatgagcattgttaaagttattagttctactaacgctggtgcaaatcttaattatttaattaacgaaaaggcacataatactgaacttactagtcatcgttcactaaaacttaacggacaaaatgtatatagggactatgccaataaatttaattcccggtatcttgctgatcaatactgggcagtcaggcaacgagctaaaagtccaaataaaaaggttcaagttcaccacttgattttcagttttagtcagcaagaatttaatccaactaaacaaactctactcaaacaagcccagcaagcattaaagttagttaatgattttttacatcaattattaccatcaactgctcaatatttagaagcagttcagtgtgactccaaaggtaaaaatctacatgtccacgtttcctgcaattcgattcttaccaatggaaaagtacttgatactaatttgattagcgttaactcccgaactgtaattaaaaataaaaacaagttcattatctcggtattcgtgatcaatttgataattacatgaccaacatttcgaaaaattaactggtcgtgaattccatcctgttacaaaagataacaccaatctcgttaactccaaagccgttaaaattgatgaacgtggtggttacatctggaaagaagatctaaaagaacgtattcttgatgccttcaataatactgataattttgaagactttgaggcggtcttagaagctgataatggggttaaagttaaacatcgtcgagcttcaattggtaaagatgaacacggcaaaaagatctatcgtgatgccgttacgtacacttttaccgatataaattctactccccactcagcccgtgattttgcctatactaaaaatggaggtaaacgaggtcttggtctctcatttacgccacaagctattcagcatgagttcgagcagcgtcaggagaaggatcagcagattgataaagaacaagctgaggctaatcctgacacttcacagcaaataaatgctgaaatgcaacaacaactgctattgcagcaacagattaaccaaagattgctaaacgaagaaagtgaggatgataattatggcaatcaaacgcggaaatcagtttcagtccaaaaatacgaatcaggaggcaccagcacaccagctgaattcgacacaagggcatatgacgccgaaacccaacggcaagaatctgacaacaaacgtaaacgagatcaaatcagacgtcaaggctctaaggaagcaaacaaacacgctgaacggccaagccagcaacaacagcaagagcctaacaagcgtccttcaaaaccaaagcacgatcatcagccaacaaacaacaatcaggaaccaaacagagttcaccgctcagaaccaggacaatctgaaccaatcactgagcaacaccaacacgacactgaagggcctaggttataaagttgataacgtccgtggtgatcaatcactgttacaatcactaattaaccgtgttaatgcgttagagaaaaagccagatgagcaaaaacggttgcttgatgaatacgtccgtaactgggattctctaacacaacaagtaggtaagatccaggatggtcaagtgcaattcagccaatcggttcaaaggttactaagtagtatggcttattatgtaaagaataagcaaattaccgttgatgcttcaacaatggaagcattacgtgaagtcgtagaagctaggactaataattccttgataaatatgttggaaaagttcaagctcaagcaattgatgctaacttccaaaagttagttaatgctatcaatgctcaagaagaaccaattcaacaaaaactagatttaattgatcaacgattagacggtatagatgatcgagtggagcaacttgatcgtgtatttacaatactaatgtacgtaacctttgcaatgcttcttgcaggagccttcgcaggtatgacactttggatcaacgcactcaaccatcaccccgtattagcttg

SEQ ID NO: 46 - DNA, 27631 bp, Artificial Sequence
  Based on Lactobacillus reuteri
cttaaaagaaaaggaagatggctatgctgatttaactaaatattcgaggactgggcgtgggtacgatggcacaacgagaagctaatatcgtgctagatgacttctatcattttctacaagcagcattaagtgatatgaaatttatcatttgtccttttccagttgatactacggagcaaaagatttattggggaaaacgatacaatcggaccaatattgcgattagtcaagaaaccgatcctagaaggaaacatcaattgatgacgcaattaaaatacattcatcaaactcagcgaagaaatatgttggtagaaaatcaactaatttcagaagatttcttcctattattatttggaaaaactaagaccattttaaggaataatcggaatgcagcaatgaattggggaggaagtgctttatttcttgaaccgctaagcaaaaaaggaaagaagaagttttgacacgaattaataatcttaatacgcaacgatagaggtatttataggtatgaagaaaaaagatattttgcattatgaaagtttggtttgaatctagacttcttagcacgagtacaaccacaggggaatcttaaacgtcatgctcgttatttagaatttggagacggcttcctaacgtgcttgagaatttataaatatccctctaaaggaatgtccccgttctggggcgttaatctcacaaacggtccatcgactttagccgttatttcggtagggactgaaaatcgtgatcagattgttaagcaaatttctaaagctgcaactgaagaagcaacacgaatttcatcgaaagctaaggctctagataatgttcaatctgcaggtaattacaatgatcaaatgcggttaatgcaaaagattactcagcaagcgaagttatgaagcgaatctactttcgaatttttgtctatgcgccaactttagcagaattagataagcgtgttcacgatgtaattcgtcagaacggaatgttccatatggctaggtatgctgatgagcagcttgatgatttgaatccatctttgttcctacaatgtctgaagaagagatggggaataaaccaattggactcctattgatgctgaaaatttatctggttcttcccatttaatcacgtgaaattgggaggaccccaatggctcttactatggctatacgcgaacaaatggggaagttatgttcgatccattccaacgggataatcgccgaactcggtcatttttctttgtaactggtaatgctggtatgggtaaatctacattgctcaagaaaatgaatgatgatgttttctcgagaggagcgattattcggaattttgatgtttcgtctgaatatactgatcaaactaaagatcaaggaggaattattattcgtcttgataaaccagaaaacttaattaatccatttgaggtctttcctacagtagttaatgatgatgggacggttgatgagattaactcgatggctcaacacattacaaaacttactaacttttttaagtttctttgtgatgacgcaactggtgatgatatgacaattttgtctcagtggttaggagacttttacattgatcagaacttatgggtagctaatcctcgtaagaccatgccgaatatcaaaattaccggccttcctcatgatatgtacccaactttacaggattttgtaatctatgctgctgaacgcaagcgtaaagcagaacgggacccaaagattcatataactagcttaatgtcacaatcaatgagtcgcattaccaatacttttagttcaattgaggaacagaaaggggatatgtttgacggtattacacgtttccctgatatttcgcgagaacaagtagtgaccttcaacattcaagggttattagcgcaaggacaagcagtatttaatgctcaaatttactcaattttaacgttattatctgcagatattgtaaaaaacggtatgcatctacggcgattattaaagaaggtcgattagatcctgactttattccttggtattacttaaatctagacgaagtcgaaaatattgttaatcctaagttcgcctatggggttgaatttctcacaatgatgatggaacaaatgcgcaaaaacttttgtgctattacgatggcggcaccaacaattaaagatttgattataaatggaaattcgcatgatccatatatcattgccgtacaaaaaatgttttctttatttcaaattcgcttctttttccaaatttcagatgatgatttgccacgactaaagacagcacttggtggatcagtcacaatcgatgaactacaaggattaactaaacttaaaaaaacagaatgccttatgaatatcaacggggatcgtaatgttcaatttaaagttcaaatcactaaagaagaaggggatcggtatgggggtggtatctaatggcaattcatcataacaaagacaaggagaatactaagccctcaaaagaacacttattaagacgatcaattcatcaagtaaagtcgtttaaagaaaatactaataaagttgttcatcaacaggcgcaaagactaattgaagatgacgacgtacctaattatcaggtaccaaaattacaatttttattagttattttggcagttattgtggactgattttaattgaaaaattactgccattgttataaaagaggtgattctatttgaaaaggaagactagaattcatctttggagcattattatttcgattgtaggagttattactttattattatttgcagtttccttaattattgcgatgctagtaggtagcgacgaaggctgtgatagtagtattgataccgcaacaatttcggctggcggtattagtaatggaaattggaaggataaaaattcagctgagtataaggcagcaaagactatttttgaaaccttaactaaaaagatgggctttagtggtgctggcgcagcaggagcggtcggtaatgcaataggtgaatcgggacttgatgtttggaagccaaatggagttggttataatggcttatttcagtggagtcaaaatcaacgcctaattgctggtggaattattaagagcgtagacccaagtgaactgactcttgacaatgaaattaaactaatgcaatacgagctaaaccatggttataccaaagtaaaaacatcggtagggaaagcgacagatgttcatcaagcaacatggaattggtttattgattatgagggtatggctggtaatgaaaatcaatacggccaacaacgtgatccgggagcacaatgggcttatcaggagtttggtggttcaaacattagctcaaatgatagtctcttaaatggtgctgccgctactgcagatactggggttgctcaggatcaacaaaataatgcgtgcaatactgatggtggtgatacggctagtggtaaatgggggtggccatttaagactattcctaaagatggcccaactagatatgaaaatggtcaacaatatggccataccggaatgattcgtggtggtggaaatgacttccatgatggttacgattttggttcagcgattgtaggagctggtcaaccaattttagcagtgcatgacggtaaagtatttaaggttgctaacgatgttggctggtggtacgtctgggttaaatcttcagatggctacaatgaagtttatcaagaagcgtttaacagtcgagggatattacagttaatgaaggtgatgaaattaaagttggagataaaattggaactttaagtggctcgcatctacatttaggtattaccaagaaagcaattacttcatcagttcaaagcggatattctgatgacggaacttggcttgatccaatcaagattattaaagaaggaataaataattaggtgatagaaatgaggaaaatgagtccgaatattttattatggataattgcgattctgtgtgtaattgctactgttctaagcataccgagtcaaaagcaattaaattattacaaagatcaattaaggattactaacaaccaaatcaataaggttgaacaaaatgaagcaaacaaattatctattaacgattcttttaattactattcagctgaaataacagcttctaagaaactgcaagaaggattaagcaaggttgttggaggaatacactcaaatgatgattggaatgctaataagacccaaattgaagaagatttaggccctaagttagctgagcaattgaaagtatataatgtcgatcctaatactaaggaatggcttttcaaagaaaataatggtgtagaaattggttatgggaaagttaaagttaacaatcaggtgcctgtgactgcggtggttagctttaaaactatggataatcaatctgccgtttatctaattaaaatgaattatgatctacaaaatgagaaggtattaaattatcaaaaaattaaaccagtgactaagcaagttatgaacgttgagggcggtgattaatatgggtaagaaaatatcctcagttataggcttgatagtaatcattgtcagtctaatttgtttaggaacatttaagctacagcagattcaatacaataaagaaacagcgaatgtcaagcaaatgttaaatcaacgtaaaaaggtcttaaaagaaagacaaaaaatagcccgtcagagtgttcttaatgagaatttagtaagttctaacaaaactaaatctgaaaatacccaagcttatgaagctagccaagatttacaagcaattactaaaaagttctttattgagtattttacttatgatagtcaaaatacttatattaaacgtaagaatagagtacatggaattgcaactagttcagtgctaaatgataagaagttgttcaataatggccttgataaaactggtcatagcataattgatgcagaacaaattacttcatcttatgatggaagcaatgcttatgtgagtggtatagatcaaaagcaaattgttagtgggattgttgaagtatcatattcttcacgtaaaggttctcatagttcttctaaaacaaccgatatttacttagtgaaatttgatggtaatcaaagaaaattgattcaaattcaacggattgggacaattggaacagttgttaattagtgagtggtgatgaatatgacagcaaaaataagaaaatatgctttatggcttaaaggacaaagcctaaaatttaatgaatgggtaatcatatttggttatgtgctaatttggctatatgctggcatagttacgggaattgaaggttcatatttgctagctggtagctttactttattattaatatcctatctattatggctgcgtcctaaaattcgccggctttcctggaaaaattttgtggaagcactaggcttagggctattaccattaatggttgaacttatatttttactaattgtaatacagtttaataatcatataattggtaattcaaatacatcattgattgtaaaattacttcaaaaaaatataatctatgtagcttacgtagtgataattgcacctattttggaagaaattgtctttcggaagagttttttccatcgtgtcgatgcttggttagcatcttgggttgataattcaaaattgagagttggaattagtgcatttatagttgcaacagtgtttgcgcaaatgcacggagcctcaattgggattatctacattttattgagcttatattttcaatttatttatttacacttcagtaatctggaaatgaatattattgcgcatattacttttaatactagtacattaggattgatgataatggcaagcttaatgtagtaaatgaacattgtctaaatttggacaaggttatcttataggctataaatgatataaatgtgaaattaaggcggtagaataactatcgtcttttttattatctccaaataagattagtcccttgatggcagaacttcacttaattgaaattaaagttactctagttatatcaaatctttttgcttatatgttattttgtctagttattgacacttaaaacaaaaagaattaatatataagtgttaattgttatatatattgaaatttataatttagttagcgaatataagtaacaaataagtttcaatatgacatctatgtagcgaatatattttggaggtaatcaaatgacttataaactttattttgcaaatgatgcaggaaatgactcgttgaaaggaactctctttactagtgatggtacagaaactgcaaaacaaatttttagtgctggagaagatatagaatgtccttcagtaattgctatgaaagattccttagatgtaactgctcccgttgaatttagctcagaagcagaaaaagatgcttatatggacgatttcttaaaccatatggatgtctctattactagtagttcaattagtgaagcaggacgatttttagtcggtcaagcagctttagatagtacaatgccgttaacgcattttgattacaatgacttatcaggaaaatctgaagttgaccttactttgttacttacattaagcaatttagccggcaaaagagtccaggatgcttataaaaaaggagaagatttagataatcagttaaaaatggacgtgtatatgacaactgcattaccaatcagtgaggcaaaacaacctaatgttttaagaaactatcgtaaaagatatatggataatacgcatattgttacatttcacaactttaaaaatccaattagtgtatcgctgcagttcaaaaatgtttttgtaggattggagggagaagttgcttttgcggcgattaaaaattcgccaaatgcttatcctgaattggctaatagcatcattaattctcttaaagaaaagtatcctaaagtagcagataaaattaataatcaattcattaaaaatattaaagatgcgataggttttgaccttggtggtaaaacaagtgactgtacagtaattactaatggaaagccaaatatcatggcttcgaattctattatgcgaggatacgataatgtccttcaacgttcggttgattacttacaaactaagaattatggatttgataatattcgtcaattacaaaaatatcttaatgaggatgaaaatccatttgcgccaggcagtaaagaaaaagttattaaagtagtaagttcagcagcagagccttttgctgatgagattgtaagtaatgcttctcaaacactacggaagattggaacaagtattaagattgggtttgtgttcggtggggctgcagtaccaatgaaaactactcggctttatgagaaacttaacaataaatttatgagtttcaatggagatcaaataattccaattgtttgggtcgatggatcatatgctcaggtattaaataggatgggcttagttttaattttgaaagcattaatgggtcctaaagaatgatatagattacaaaatcctgttataatgatatgtatatataatgaatgggagcgaagcatatgccgagaggagcagttactaaagcacgtaatttacaattgtacattgaaggaccagtaaaagaatggatggatattcaaaactcgcttggttcatctattggccaatccattgtatttattactgcattgtatggggaagtagatttaccttctacactccctaaaatacgagcaaatcaacaaatgaaatttaataatagtaatttaaaaaatggacaaaaaagcgacaatatccaaaatggaaaatttgaaaccaagactaaaacaattagaataccggactatagtgaagttagcgcttggtttgaagcacagacggctcctagcgaatcagtgaatcaattaatctttttagtcattggtatgttcggaattactgattttccttgcgccttatctttttcacagggtgaaataattagcgctttagagcagtctttctttaataatccgaaagagttaagcaaacaagatagttttcagactaaagaaactaacaagcaggaaagtcaagaatcacaaatgaacgctgatttatctgattcatctaatattgatttatcaatgatcagtacagatttagatgataaatagtcgaagatttgaaacttaaattttaattataaaatataaacttcataaacttgagtttatgaagtttatatagttagaatagtaatttttagctgaatatatttttacttttcaatataagtgttaaatattacttatgttgaaacttataggttgatataaattgttagaattttttcaggaaaataaagtagggattggtacaatgaatttaaattctgattcaactagattaatcaaaaattggcttcttaaagttcctctagatgaattaagaaaaaagattaatgaatgtaaaaatcagtctgataaagaatggtgggaacgcatttataaaattgctgctcagcgaagaaagtaagaaaaactaaaaagtgatcgtgtattattagataatagtgaaagaagggagcatagttatggcaaataatacagctttagctcaatttattgcctcatttgggagtttgaatggttatggaagcacagttgctcagacaaaaaaggctttagatacaggaaatactaatgctttggaacaagataatgaggatgtaccaatctttaaagatgctttagctggaattaaagcagtaaaaaaagatggttttacagttgatggaattattaatatcaataaatcttttgtatatagtaaggaagaggatccggctattcctggtcatttaagaaattcaatgtataatccagatgataatattgcaattacaattgatacagctggaaaagatcattattttcctcccgaagtagtttataaagctgatttacaaaagattattgatgagtttaagcattctgcgcaaactaaacaggatgcatggctcgtatttgcaaagttagcaaaattacaaccttttcaagatggtaataagcggacagcgttaattgctgcaaatgcagcctataatgtttgggagaaagaaaattatttagtcctaccttttaatgaacttgatcgtgctgaatttacaattaacttaatgcgatattatggagcaacagatcctagtaccgaaagtaaggctttttcaaaaatgctagaacttcttccaaatgataatgagcaaatttatcataaacatattaacgaacaaaaagctttaaatccgaaaactgtaaaactaaaacctctttttcgaaatgatcataaagaaatgcggcgatgaatgaataccaatttagtaaacactatagataactaatctaaattgatatattgggttatacttaagtaataagttagagaaactttgtgaattgaatgattttcccatgggaaaatcatgggaaaaaatattctaggtttctcgatatttctcattaaatctcggtatttagtcaaaaaacataacgtctataaacgttgaggaatcaaggaaaggattgatatatatgagtttagatacagcgatatttgccggcggatgtttttggtgcatggttgaataaatatatcgagaatggcgctatattagtaataacacgttgttaaacaccttattttaattccatgggaaacttatgggaaaattttatttatctaaagaagagatattcttgtgaataacaataatttataaaagaaaaagcgccaacaaaagtcagcgctaagattactacttgagtaaccatttaattagatgtttaatgtgcttactaggcacaatgagaatcagtacacaccaatgcaagggagtcacctccaaacttgcgcttagtaaagattgattaagtcttcggtgcgcttaaccattgtatcacaatttatttatgttataatatatacatgagaattagtacaccggtgtgcaaaatggtttcagttgattacttaaaccgaaccggttggggcgcttaataggcgctcttttttatttacatttaaaattttaaaaatatgtgaggtaattaatgatgaaaagtaaagtgttaaaagaaaatggtgaaaaagttaatgcaaaacattatcaatataaaatttttttgagtaataaaagtgaacctattgaatataattcaactgaagcagtatattcatatgaagaagtttttgaaaaaatttgtgaaaaatatgcaattaagctttctgaaggaaacattgaaaaaattgaaatgtcattagttgattaatatgtgttgagatttaataatacaaaatttaatgaaaataagcagcaagctttcaatttaaattggaagatacttgttgcttatttttattcagatagggcacaagaaagcaataaatgatatgacaaaaaatcttatgaagtaacaaaagaattaagtagttagcataacctatttactttagaattgcatagagatatagctataataaagtttgttttgataaacgagagtgtgatatagtgagcttgataagttctaaggattatgaacatatcctaagaataaatgactttaattaactacttaactaaaagtagaaaggaaaacttgatcggcgcacttttttattgtttaagtggaattaaatttttattaggtgagaataagatgaatagtaataataaagcaataacctcagtttcggagtttataactgaaatagaacgtcattattcagacggtaaagaatatttctttagaggagaatcgaaagattatggaacaattattccaaatttatatcgtgaattaaataagcttatcgatgattcaactaactactataagcgcttatctattgaacttggaatacaaaatacagataatatctcagttattgatcaaatggcgactcttcaacattatggcgcaaaaagtagacttttagatattacaagcaatgcattaattgctttattttttgcagtagaaaataccgatgaaaaagaagacggcattgtacatgtatttaatggcaaagttttttttgattcaggacatacaattgctaccaaaacagcagctaattttatggatatttctttaataaataatttttataaatattgccacaccttcttaaacagtcgtaaatttcctaaaaacgtaagagaagctattatacaatgctcaacctatggtaacggtttggaatatgagttaaataatgtagaaccttatcccattcataatagtgcaaatgttatagctgagttaaggcatatgacaacttctgagatgatgaaagaaatgccgagttttgacttgattgattttatggaaaaattgaatcaaatcgcaaaaactagagaaaggttaaataaaccattagcaatattttttgatatgcatttacctcagatttatttaagtacgtttagtaatgacagaataaaacgtcaacaaggagcatttataactccatcaatactaagtggtcaaaaaagagataactcaaaaaaacttcaaaagtatatttattcgagcttctataaagcagaaaacaatttaataaaagaatatgtggagttaaagaaaagactagttaacaaaccactagttcataacaagcttcccaaaatagtgttaaaaaataaaagaatgaaattagacacattagtaaagtctaaaaaggagttttctcatcaaaaagagaaaagattaataaagttaaaacaaataatgcataaatttgataattatagattatctggtagtgatttaaaacttaaagaagactttaaatataattgttttcagttgatgtttgacgtgaattatgctggttatcgccagtccataacgtactctgtaaaaaagttgaaactgggttcgataataatagatgggagtagtaaatttcaaataaaaaggacattaaatagtcttggaattaatgaagggacagtatatccagatcttaagcatatttcagattcaataattgaaaatcaacattattaagataatgaaccaattttaattattgaatgcatagccggtttttcatgtggaaaatttactgtatttatatcaaaataagattacataatatacagttttactaataaatggtagtattatgaactcataagaaatgaattaagcagcaagccctctacacggaaggaaacttgctgcttattttttattcaaatggggcacgtttagttggcatctcttttccagtaaagggatcatacatagcccatttatcccaataatctactaattcttggcggaatactttctgagcttctgaaatagaaatatggtcaatccgggagattcgttttacataaggtttccattcttctggaatttgaatactgtctaatgaagcttcttcaagaatatagcctttgaaatcttctttatatcctaaatgatcaaacaagagtttacccattacatttgcatcgtgaataatcttttgggccgtttcttctgtatagacgagcgaatattcaaggggggcttcgttaataagatccgcagatttacagaaatatttattagtatgagggttcttcattcggtataaaatagtcataaaaatagctccttttaaacgtatgttcgatattaatatagcatagttagtcatttttatcaaacatacgttctgagcaatggattaagaaaatgtatattaaagcttacttaacttatcagccaaagactcttccatttctttagtaacgtgtaaataaatttcttctgtaattttactattttcatgtcctacgtgattttttataacgtataagggaactccaagttctgctaattttgaaacatgagtatggcgaaaaaaatgtgtagtaacacttttatcaatttttgctcctgcttctaatcgatggagaaaacgatctaaatgtgatgcatcaaatggacgattacttcgtgaatctttattaataaaaatcaagtcatttggatctttattgaggctaagttctttataaatattgacagccttttgtggtaatagtacttctcgattactagcaattgtttttgcaccgtcagttttcttgactgaaactttaactgtagggttacttacagtccctaatagttctcgttggtgtgaaagggagccatcaataattgctttatacttaccttcttctttaattatgtcttttacataaagtccggccgcctctccacaacgcataccagtcaaataaagccactctaggaaaagcttgatatcattacgatcttttttctcacaagcatgaaggattgcgtgatactcatcgtcagtcaaatatttattttcaatacgatcacgttttcttttaatttcgcttcgccatgttatttcaacatctttgaccggattctttttaagatatccatatttaacgccaaatttatatgtcattgataagtatttcttgtaattttggattgaagcattggttaaaggcttatctggatcataaagcttttgatctaaatagcgattaagtatttctgtagttattttattagcaagggtatcgttacctaagtcattacaaatccgtttaagccctcgaaaggcattatagtaagtgttaaccgcaactctttgtttatagatagttaaaaatttgtcagcaaggtttcgaagtgaaatatctttatctgtgaagtattccttttgcttagctttttcaattttttttgccagctcgatggctgctgctcttttagtttgattattatttttaagataactaacagagacttttttatactttcctgttaatggacttttatagttttcgccaaaacgatatctaactttgccacgtacggtatatttttcaacccacatttttatctcctttagtttatattgtgcaaaacatacgttcttttagagtgctaaataaaaacgccagtagaagaaatagctaattctctatattttttgcgcatcgcaaataatgtaaaattagtagctctatcaacgctttctgtcattgaaataggaattcgaaaggcttcaattaattgctgcttagtctcaaaagtgatgtcgtgtgtacggcaataatctaaaagcaacataattgcaattagatcaccatcgccttcggctttttcattaacactgcaataattacaactaagactaacttcatcaccagataaaatgtgtccaatttcatgagctagtgttagtggtcgttcgcaagctggaaaccagttaggattgtaccaaacgcatcgcaattcaatttgcgattgtggtacccagtcacttggccattggctttcagtaaggacagtaatgttatgttccttagctacaccttttaaccactcaataagatcttccatcttgttcatcaacgtcaccttttttctcatcaattttatttatattcagttagtctatgtattgtaattattatttttgcttattttgtttgttattcattgccttttgtgattctaaaaaggacttaattgaattgcgcataaatgctttttgctcatcgctaatttgaagtccttcgtaagaacgtaatccattaaaataatgatcaatatcttcggaagtaatatcaccatttccgttattagtattttgtacttcttctgggtgccggcgctccttcttatcacttacccccattaaccatccttcatccacatttaatactttagctagctcatataatttatcttgcttagcttcatattttcctttgaggtagtcggatattagttgacggtttataccagttcttctgccaagttcggattgggaaatttttgcatcatctaatgctatttttaacctatgctgaaagctgtcaactttcctaatcataattgtttcaactccttaaagctaattttaacattaaaatacaaaatataacatattgagtaaagaaaaattgacagaaaatgattgtaattgcaacactgtcatgttaaacttgcttttgtaaagctaacatgacaaaaagaggatgatttatttgatttttaattatgataaactgaaggatcgaatgcaacaactgagatataatcaggtatctcttgcaaaagctacaaacattgagcgagtaacattaaatcgaaaaattaataataggattatgtttaagcaagacgagattctttcaattgcgaatgcattagatatagggtcagacgagataggtgtatatttttttacccttattgtcaagaaaagatgacaggatatttaagaataataaggaatttgttaattcgggagaggaggtaattctgatgatggcaaacggttggaagagtagggaacaaattatgaaagattatggctatagtgaaggaacttttggtgatcgaatgcgtgaatgtcttgaatctccatacagcagcgccgttgttagcgacacctctaagtatgcaattattattgaaccgctttatcagaagttccttatgtggcgatcagaaaaaatccgtaatgagaagtcggaaaaatcgggtcgtttaactagaggtaagtatgattaaaaatataaaggattaatcataaattggcagaacttggaaaatttatgagggtactcaaaaattgaacaaaggtgataaatgggtgtggaagaatattctaaacaactttcgttacctagatgaccttaaacggatagaggtaaaaggaactacttggaaaccccatagtacttctccttgaatgtttaaggcaataacctttgcacaatggttgaaagagtatttaagcgagttttcaatgaatggaaatggataacagtaaaagaaagtggggtaggtactatgcctaaaattataaagattaaacataaagcggttaaaaatagccaaattcaaattcctgactatgtatttgatgagggactaactctagacgcaattggactgtatatttatttactaagtcgcaaacaaaaagaggttagccttgaggatattaataataaatcgagggattcacaagagcataatttagaaatactgagtgaattggaacaacatcatttaattgctaaaaaacttaatagcaaggctaactttatttggaaattacttccggtaaagcaggtgtagttttatgccgaaaattaagcatcgaagacgtcaagggtattcaactgtaagcaatactccatatgatgaccgccgtctgcagctcgaatcaatgggtgtttttcaattgctatggcacttacctgacgattggtcatttaatgagattgatattgttcaacgttcagcttctggtagaacgaagctccggaaagcgttagacgaacttgaaagatttggttacttaaaacgaagtcgattgcgtaacgaaaaggggcaattaacagctggtgattgggtattagatgatttagggacacttggtgataattcagttttggcaaaaaagaagagaatggaaagaaaaaagccaaggaagcatcaagtaaaattttactcatgggttcaaaagcctatgttctgttttgtgacattggcttatttctcgccaaaaacctatgtcacgttttcaaacataggtgtattttatcgaaaacctatgtcacgttttccaatgttggataacgtcctactactaattactcatagcactaattactcagtaagtagtaagtatgctgctagcaaagcagcacaaactgatgaacagattcttgcaaagaatcgttcagaacattcactagacgatccaaaaggtatttcacaagcatataatctctggaatgatatctggggtaaaccttcagcgttcgtcgaaaagcaaattagccagtgggttaatgaatttggaattgacgttgtcgcccatgcctttaactatgccaaatggaaagtggagcaagcatcagcagcaggctcctacctagcaaaggtatttgacaattatcggcaaaacaacgttcaaacagcttctcaagcagcagaagctgatgcaatgaatttacatcgttcaaagctctcgcaaagagctaagcaaagcgattctactactacgcctagcaaaggcaaatcatctcgcaaagatgatcttaaaaatttaataaaaagcgaaccagaagctatctgttaccgagcagcatgtttagcaaaaatcaatttaagcggagcagaccagcaggctcttaatgagtttgtcaggcatttaggccctaagctagtcctaaatgcgattgaggttgctaaacaagaaacaaggtaccagtacccttcgtggggctttctcagatcgattttaagacgatatgaggctcagggaattaagacggttgaagacgttaagagcggtgatcgaaatatgcctagcaaaggtaattcaaagcaatataagcgtcataagccgattaaagagccaatgccagaatggagtcgaaaaccgcaagaagagctttacaaaaaggcagacccggaagcaatacgtaagcttaaagaacggattgctaatcgcaataagcggcgaaaggaagtttctggttaagcaagttggggaggattaacgatatggggacgaagaaacaagcgcaaattattactcgactagctcacttaatcacaaaaagaagtgaacggctaagtaatcaagaaagtctgtcagctagcgtcagcattaagcttacacaagaaattaagacttactgttttttgattcgcgtatttcaggaaaattaattcgagggagattttgaaaatgaatggggataaattgattgacaatattttgacgatattcatgcttttagggatttgctgcattctagatgcaatattctttgccatcatcctctttgcgcctttaagaaggtaagcgacgatgaaacatttgaattgggctgcaattttattgattggctgggcgttttactttcagatttttttgattgtggcgattaaacggctaattgaatttctgagcgttaacacagttttatcggttttgggagcattgctgctcagcactattttaggtggcaccctgatgttattgattattcaaaacgaaagtggggaatagagaaaatacaatgaaaactgtgcttatttggacttcataggaggtgagtttgcagtgaaagtaacagtgggtcatcacttacttgaagcgtacccagttgaaaattatgtttatgaagtatcatattgcggtagaaaagagttttaccaagatgctttggacgctgctcattcaacgctttacacaaaagatagttcatataatgcaacaattactaaaattccagttaggcctattagtgaaaagagaattgagaagagactgctacatcaaaagtggagtcttgatgactgggatccatcagcggttaaagaattcaaacaatcaaaactttatctttttagactgtatcttagaaaaataggtcttattccattattgattatgttatatgttgcaatttagattgtcttagcaatttttaagtaaagattggtcgaggaggtaacaaaatggggaaagattattcattaagctcagaattatgtcttagtaattggactgcagaaactcttgatagttctgtaaagcactggatgaaaaacagaaatcagctgtcaagtgcaagcgcttatgtaattagcgatgaagattgtaattttctgaagattgattttgaagatccagtaaaacaagctgatgttctaaaaattaatcggggctctcttggtttggcaacagtatttaagactattcaatctgctaatgctgtcataagttttctagaggctgtaggtgttaaaaaaataaaaaatttgcaagtacgaaagctgcaaggtttattgtattaggattgcgaaatgagggtgagtatatggaatttaaagaacaagaacggaactcgcttgaattagttagccaaattttaaaagatagtccattcgatggctgggtaatcgtagcacaatctccggaggaacaagatatgatttcaatcacttctggtggtaggggaatttcacatggtgcgttagtgaatggactttatgattcagcaaaccgttttgcacaattaaattttaagagtgaaattactaagactgattttattttgacaatggcagaagcgatgggagtctcgacggctaatttaaaatcagctattgagaaaaaaccacaaaatatttagggggcttgttacaaatgcaagaaagtaatgcttcacaagcggggtatcaaattgaaaactcgaataatggtttttacccaaataacaaatactgaaagtcaggctgtttttgttcctagtgaactgtcagagagctataaagctttatctcctgaggaacggcaatggtggcttggaattgaacgaaaggttgataataaccggcgtgactatattatccgctttggcacaattctaaaggaaattaaagacaaaactagccgccaaggaaaccgtgataaagacaagattacatttgagcggtggattaaagctcatcatgtttcaaaggggaatgcctataacgctattaacattgcgcaagcatattatcgaattaaggcacagaatgatccggatgaagagctaatgcttgataattatctaagccttcctaagatggcccaattagcaatcgcaaccggaaaggctgatccggaacaggaaaatatttattacatgcaactgtagaagctcgtaattcgcgaatttggcaggaaatggctaagtcgattagcaagaaaaatgagctcgctaaaagtcaatcaaacaaaattcaaaaacttaattctgaaatcagcgtttagctaatcgtttagcagacgttgaaactctcgggctgaaattatgaatgagctgaatgatttacgagaaggaaaaagacacttagaaatgcaactggaggagcaaaaaaacaaggagccggaattagttgaggttgcacctgatgattatgacgaattaaaggctgataaagaagaagctgaaagcttgcttgctgatcgggaagaaaaactcaaaaaagttaaagcggagttaaaagctgctcaagaatcaggacaacaggttgatgatcttgctaaacaagttaatgacttaattcaaaaaaataatgctttgcgaacacagattaagcaacaggaatcagtagaaagtaaacatgacaaagcttttaagcgtgtttcatcattttcatctgaaatgttagcaaatttagtaaaagattttgacctgatgcaagttttacctgaaaccaaattcttaagtcagaaggatttagcccagactgatttagtaaaactagcagaaatgtttgaaagtaagggatcagaaattcgtgaaaaactattagccactcataatagtaaacaagtaattgacggggactttaaggaggcttgagggggagaatgaagaaatgatgtacgtgaaaggaagatttgttaacgcaaatgggcttgaaagaagaccctggtattttgcggtttcctcgaataaattacgggattttaagttggccatgcaactttacaagaaaaaatcagtactagtaatggttagtgatcgacggaaatatgtaaggatagctcaagtggagcctaaaatcatcaaaacacttcctaatagtggaaaatgtgtaggtaatttaattgctatcttaaaagcaagtaacgggcgaccaatcgaattatttaagttagtgcagagttttccagacgacttaaaaaatattacggttgctgaaattgcagctcttcatttgccaagtctaaatcgtaaacttgaccctaatgttcaccaccttcctaaatgaggctagaagcaatgatttatcgtagacgattaacccgagcagaactacgccaacgagctaatcataagatgattagtggatcttggaatgacgaggaagaaaatgagcccgaaacacaactaaaaaacataaaaaatactggtcgatggataacacctattttaggaacctttgtgttgaccttatttatttttttgcttttttggaatttgtatcacttttttcagtgactaaggggacaaaatttatgagttataaggaaaaatcaaatcatgattaggaaaaaattgccaccaaaacggtcgatatatcgacgggagttaaggaaaaaagcattacctaaaaatattctgtataccatgttgttggcatttttaatcttgattctattggtattcttactgctatttgcagcaatgattaagattattttgacttgaacggaggaaattgaagttatgaaagaaattaaattgcggaaatataatcaaggcctaaatcaattgctttattcaactaggttagaaggagaaaacgaactgcgatttaacttttctccttttgatgagggaagttcatggattgcaaatggctcactttccaaaattatgatgtacacgggagttaatgatcaaaacgggaagaaaatttatgaaggcgatattgttcaaataattcatgatcaaaaacctgttataaagcaaactgtcagatttaggtggattgtagaatgaagttagccacccagttggtggtaaataaaaaacgccattcggcgtgacattaggtatcatattaagtgaaccaaacctatatgaaaggatgtccgtcaaatgacgcacttaaatgataccatgtctactagtttattgactactcataaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggtcatttataaggctcgagatttaatgaatgatggcaccctgatcccaaagtcggttgtaacttttatatcaatggattaatgagggtgtgcttcgtacgtccaatttagatctctttgaaaaacctaaacgtaagcatcatcgaactcatccgcaagctaaaaggtgcttagggcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaaattgctggtaaaactgcgcatgcagtaaatcagttctttataaatttacgccagaaaatgggcacagatgcttactatcgcatctttaagacaataacctctgacaacggttcagaatttagtgagttaaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaactgtcagatttaatcacggcaaatttattccagtatgcgattacaggtcgacggaattaagaatcgttggtaatgtttttagcttaaaaaatgatggtgaaccataggtaaagaaggtgaacaaaattgaaatacaaattaaaatttcaatttgatgattataaaggctacgctgtaatcactttacccaaagaagaaagccttgaggaattaaagcatgatttagctttaggcaaatatcttttgaatgcggaagaaagcactttagagttttcaacatttcaaaaatataacgaaaagcgataccacttagtcctttataaaaataaagatacacgcttaacaattgaaggttcctttaatagtactcatgacttgggaatgaatttagttaaagctgaattattgcaattgaaagaacaaaaacctgtgatgcaggctcaacaacttagctttctgtaagtgatttgatgctaagtaatagattaagtggggtaaatttttaatgaatagatatgatccagaattattgcatcgtcgtagagtgattacttttagtgtattaacggtagccgtcatattgcttataacgggctttctctacggaattggagtgcttcatcgaagtagtacaaaaacgcaacaagcagctcttaaaagcaatgagccggtggtagtaatgtactactctaaaacgtgtccagattgtaaaaaagtagcgattgatgttcataaaaatgcttgggaagtaacagcaactcaagccacgattggtaagttgatgccatcaccatatcgccataagaatttatatttacaatggcaaaataatgaagataaaaggctatttaagcaaaacaatgttaattcagtaccaacatttatggtttatcgcaatggaaaaccacaaccgattgctaatgcgaatggaattgatatttatcaatactcaggtactaataagcaggtaattgctaacatctaccattacttacaaataaataaaccgacagaaaaacagcagggggtaaccaatgaataaaagaaaatggcgaaaaaaagatccaattttggattgataagtatggaaaaagatttgctaaatttaagacttggtatgatgaccacgcgatgcaacgtaaattaattattagtggcacgctctttttaacaatgatagggctgcttgttggcacacgagttgcaccaagcaaatcgcgatttgccgatactccattaaatacagcagagagttttggtaatgatagtaatgccacaatagcactaacttctcgtaaatataatgctaagcaacaattcctggttgcgcgctttaaggtggcaccacaatctggtcaatatatcgatcctaaaaatattaaatttaaggttcgtacattaacaaaacaagatgcttcttatcaagttattcgcttgttaataataactttgtagtagttattgataacttaccgaaaggatacaaagcaattcagctagaagctattaataaacaaggagacagttcgcaaattacttatgatgcttcttctagtattgatccagaatctttaagttctagtgatagcgaactttcatcatcaagcagtgggaatggccagactggagcaggcaaaaacagttacaaatttgtcattaatgaagataaaaaatttgttgataatcgtttaactagacaaacccaaaagaatatgcggttcaatcattacaagaatcaatcaagttaatgaacagagaaattcgaaaagaaaaaggagctttgactacctatcagaaacaattagctgcagatcaagcagcaatttctcaagcaaagaataatcaacaatatcaagtcgataaagatagtaattctgataatattcagcaagctcaagcagatattgcgactcaaaagcagaatattaagaacgtaaataaggtaattaaacaaagtaaattacaaattaagctttatcaaaaaaattgatgatactcaatcaggtaagtataatcccagcaaaggttgcaactaagaagatggaataaggaaaaaagaattaaataaattcaaaagccagtcgatcaaaggctggctttagttataactaataaacatttcatttttagtttaagaaggttgaaggaatgaaagaatgttaatttttttatggataagcggatttaataggaaactggtaatatatctttttatttttttgagcactttaatatttatatataacctaatggaattattctttataagttttcgcaaaaataaatatttagaatggagtgaaatacaaaaactaactaatttgaagatagtttttagtccttaatatgttatttatcattggcctatgaatctggtaagaggaaaggtggtatggatcagttgccgttacgaatgagttctgttagaaaatataaaatttaagtcagactggaataattataatacactatcttttgtcttgatgtaggtttggaaaaaggtattgatacaatgcaaaactagaaattatagcagatattagattgaaatagtcactacttagaactaaaagcaatgaagttataattgaaatgatgaaagaattttggcgatagtaattgctactttaaagcattgtccttcattagaaaatattgaacagagaagtaaataaataatacatgaaaaaatgctcgatcctaaaagtaatacgatggttactacaatccaatatataaaggtcattttattatgggaaaaaccaactactatagaagaaaaagcagaatgctttagaggatgagagaagatttgcataaaagtggagaaaaaattttgagtagatatatggatagaattattccaagaattagtattagataattaaatttagtctttttcacgggcttagtctctctttattaatttattttggcgaaactttgaaaagtatcagcaataaatatactacaaatgatgatgcttttgtagatttacgtgatgcaaaagcgcatttttctgagtgtcaaatagtcggcagacgagagaattggggtaacacaagaaaaccccgccactggcgggtacctggcttgccaggtatcgttttcccttatgctcattaattagactagcacttaattttactgtttaagaattaggttggcactcaaaagaaaggacatgattttatgaagaaaatagatggcgaaacacttcaacattttagattagataataatcaagttggcaaggtgcaaaaggaggtaagaaatataacatgacaaagcagaattttatcgcatggtggtcagtgattatttcaaaaatgaaactgttgcgaatttaactccagaatatatagatacgttgaagcaattaattgaaattctgaacgtaattggtgaacggcaaaaacgtattgaacgatcagttaattattgtgaagatcatttacggatcttttttgatgatacgatggtgaggaggaaaactaacatgacaagaactactttaagaatgacaaaatccactgaaagtaaattaattattttgaagctaaacttgaaaatgatcctgccttaattaaaatattccatcctcaaataatggcctgattaatatgctattaaatgattatcttactttaataattaatgctggaataaaagtctcgaaaaagatacgaaactatttatcaagaattttatcgacgcatgacacaaactaaataatttaattaagcatgaacaaaaaacaaatgaatcgaattaatgaaattctatatttgttaatggcaactaatcaagcagtcgtccgagttgataaagatgactggaaatttaaaaagcatgatcaacagatagcaataccgcaagagtttttccaagaagaaagtgatgatatcaaattctattgatgatcatcggattttgattactggtaatataaaattgcgtggtttaactccagcaatataaaaaaattcttcgttatattctagacaataatgaaaaaacaaccttttttacgtatggtcttggcatccaaggcgttttagaaaatacgttagaaataaataatccggtaaatatcggaagtgtattaaatgtttttccagcaatacagataaattttcagataatgagacaacgtcaattggtaattttgatatatctttcacgtcagaattaaatggggacgaattagtagtatcgattagatcagaaagaaataaaatttcgctttttcagctatatcgcatgatactaagaaaggaaaagatagtaacgacatgaatgagctttataaaaagcgttaaactcgttttaaaaatctagttaaccaggaggaagttgattatgattgctaatacagttaacacgattaaaaatcacgatcacgaaatggttttctgtttttatgtacaatcaaatcaaaccaggaaaaattttttcaagatattgttactgaaactttctatgatataaaatttatatataataatgcaaattcgtcgttaatggatgcaagtaattttaagttgcttgcaaaaaatatgagcgagtattttagccctggcttaattgtgaatgtagaatttgggaaccagttacctatttagagttaaaaaactctagaatatctgaagagaaactttttgacgaattttggaattttcgtgagaatgttggtttgatttgccaaaagacttaactaaaaatcgtcatttagctatgggatagtatttatgtttgattggaaagaatatttaaatgttgcgaaag

SEQ ID NO: 47 - DNA, 22125 bp, Artificial Sequence
  Based on Lactobacillus reuteri
aacaactaccgtggcttcgcttgctggactcgttaatcagaacggtttatgactaaacctaacctgattaacgagtgaatttttttggggggagtgcttaatcgaacttaacttcatcgagcatttgttctcggctgacttgatccagacctaaatattttaaggtcatggcttctgaggaatgattaagcagcgacatcactaaaccgatattgtaatgagtttgtgtgtagacccggtaagccccagtttttctcattgtgtgagtaccgaggtagttaatcccaagtaaatcgccagttttagccatgattttgtaaaactgtttttcagtgatgtgccgatcggggtgtttagtcgatggaaaaagccaatctgagtggagattttgttggtttagccactgaaaatagtcttttaggtcttgtttaactggttttaggtacaaagtattgggctttccggtctttttatcccgaatataagcatttttagcgatagtcccatcgttattgaagatctcattgcgtctgagagctaataaatcggacactcggagtaacgttgccttgccaacttggaaaattgtgtaatttcggcggccagctttaaaattatgtaggagagtatcttcgacttcatgcaggatattggaatctttgatgggtaaaacgagttgtttcatgattaattgctccttatttaggggctactttttgtatatataaattaaaagcccctatattctgattgtagaatacaggggcttgacatatcaacattctataggggctatttatcacaaatagaccctattatgaactggtttcagtcaatcttttttattaatctttcaatttgataataattaattgttattacgaataagtcttacagcaataatcaaaagaaatgggattaaagttagcacaaaactaacggtaaatatacttaaatttttgatggtatctttagattgggtcatgaagtccgtcctaacttattggttttgtcacttataagtttaaggcttcatggcctttttggtctagttatttaggtgttgcacttacattgtaaatccggcgtcacaaaaaaattgactgacgagtcaataattcgttgactcgtcagtcaatcgcgactatactggaaaaggttgatcagataccgacatattaaaacgtgtttcaagtttgaccttaaggaggatgacaaaaatgacaacagctattatcgaacttgaccatcttcaaaaaaactttggcaagtttgccgcattaaaagatgtcagtttcacgttggcacccggtcaggttctgggttttctaggacctaatggggccggcaaatccacgaccattcgagttattttaggcttattaaaaaagagtggcggctcagtgaccgtcttcggcaaagatgcctggcgggatgatgcggcgattcatccacgcatcgcctatgttcctggggacgtttatttatggccaaatctttctggcggcgaaattatcgacctattgctacgtttaaatggccgccagcataatcaaaagaccgatgaactaatcaaggcctttgaatttgatccgaagaaaaaagctcgtacctattcaaaaggcaatcgtcaaaaagtagcgttaattgctgcgttttcgcaagatgccgatttgtatatttttgatgaacccacttctgggcttgatccattaaatgaacagactttccagcaagaagttttaaaactgaaaagagccggtaaaagtgtgctgctatcaagccacattttgtccgaagtcgagcgaatgtgtgattcaattgttatcatccgtgatggtagtgtgattgagagcggcaatcttgatcaattacggcatctatcgcggatcaaaattgaagtcaccaccgctaccccaatgactgctttggcaaagcaagctggcgttcacgacctcacttatcgcgattccgagcacaccaaggcggttttcaccgctgatcgagacgcgcttggcaccatcatgaccacactggccgccaacaccgtggtcgacatgcaatcaacgccgccaacgctggaagagttattcctgcgttattatggaaagcaaggtgagactcatgcggcacagtaatcggaacgcaggttatctgcttcgggcaaacctcaaacaaaatctaaaattttcactcatctggcttgtcattttgatcatgatgattgccagtggtgctggcaaattggaagcagactttgcaggcggggcctcgggctctaaagagattgtcaaaatgctgcaagcgccgggcatggcggcaatgtttggcgcgatgccaaaggtggacacgtataacacagcgattgtgtttgctggtgtgatggtcgtcttcatgattattttgcaggccttatgggttatgccgctgatgattcgcaacacccgcggtcaagaagaaagtggcttgctcgaaatggttcgcgctcgcaatgttgggcgaacggctgccatcaccgccgcttcgcttgagcttctcatcgacagtgccataatgggtatcctctattttgtctcgttggccgctgtcaacatgggtggtactgacttgtacggtgacttcctgttttcactggggatggtgatcgccaacttgctattcggagccattgcgttgctattcgcgcaactaaccaataacacacgtacagccaatatgttgagctacatggtgctgactgccgcttatttggttcggctggtcaccgatatccagcatcaaaatctgacgtggttatcaccaattggttggttcgaaaaagcaaacttctatactgataacaacgtctgggctttaggtttggccttactggtcagcattctgcttgcggccagcgccaccatgattgcccgcaaccgcgatctgggcgccgggattattgctgaacgcaccggccgagccaaagctgccggctggcttcgctcgatccctgccttactgtggcgaactgagcgcggattatttgctgggtggttaatcggcgccgtggtgtttggcggcgtcatgggtagtgtgctcggcggcgttggcgacattcttaaaacgaatccgctttatcgtaaaatactagatgttggccaaatcaacgctgccaatcagaccatggtcctgtcattcttaggcatgtatctcggcattttcgtcgcattagccgtgactgctggcgtccaagtggcattccgactcaaacgcgatgacaaccttggttacttgagcgtcattcatgccgaaaagccaacgcgaaccacgatcagtgtcagctactattgctttggtctgctggcaggcgtgttcgtcctttctgctgggctgctggccttgttcttcactgggaacactgttctcagtcacccgttgccgctcaagtacctcggtcgcctattcgtggctagcgttccggctgtgatatcgtttatcgcccttggcatcgcactagtcggtctgtggccacgcttaagcagtctattctggctgtatatgggagccggtctgatcgttcaaattttccggggattgtttgatttgccaaaacacgcaggcaacttcacaccttttggctggattgccaatgtaccggttgaaaacgttgatcaaacatggctaatcgtgatggttgttagcgctatagtattatttattcttggcattgctggttatcgccgtcaggatttgagcctatgaaaaatgttgtgacagatcctgaaaaggtcacccgaatcctcaaaacagcgacggaaattttcggccagcaaggcttcatcaagagcaaaaccgatcagattgccaaccaagcacaagtatctaagggcttgctcttccattattttggcaataaacaagcgctgtatcttgacgctttcaaatatgcctatcatcgaatttatgatcacatggaccctaaaaagtggcagaatgcccctggcttggctgccatgatgaccactgcagttaagtatgagttgaaactacaattcaaattcccagctgaataccgcttgattatgcaagcctatgctgatttaccgcattttcccgaaccgttgcgacaacaagtgcagcaagaaacaactgccatatccgctgaaatcgatcgcatttttcgcgagaaaattgaacagctgcctcgtcgtgagggcctgtcagtcgatgacgttttcggtgtcgtttctgccttaatcgcccaacaaacggcggtcaccatcagactcattgccagtggccattatcgcaagtttgaagatctgcagtccgtggttgagacgatagcacgccagttattgattgtcgaacacggctttttaccagatgaaagttgacgtcagctgatagatcaaaaaaggtcattagggtataccctagtggccgtttttatttctgtgctatactaggaattacaatcgttcattagaactgtccaaaaggagaattggaaatggctaaaatcggttatgcgcgtgtgagttccaaggagcaacatttagatcgacagttagcggctttaaaagacgttgataaattatttacggataaattaagtggggctaacactaatcggccagaactgcaaaaaatgctggcctatattcgtgagggtgatattgtaatggtcactgaattagatcgcttaggcagaaacaaccatgatttgactaagatcatgaactccattcaaaataagggtgccaccctagatgtgttaaatttgccgtccatgacagggattgctgacccaaatttacgtcaactgatgaccaacttgattattgaactctataagtatcaggccgaaagtgaacgtaagcgaatcattgagcgccagcaacaagggattgccttagctaagcagcagggtaaatatcatgggcgcaaaccccaatatgccaaagatgatccccgtttgcaacatgcttttaagctttatcgagctggcatgagtgacattgatgtgtcccgaaatacaggtattaaacggacgacctttattcgataccgtgtgaaatacggtattaaaagaaaatagggcgcccttttggttagcacatgttaactgaaagggtccctattttctttacttaaaaggtagattgatgaaatgctagctaacgctagtcctagtgataaattgtctaaacgcttgcaagcaatctttgcccaagcatctatttctcggcgtgatatgttgggtgcaatgattggcgccggtatgaatattgctacagcaaaaagtgaatcatttgcagtgaatgaactcaaacagcagtatatcgatggctataataattcaagccctaataaactatcaacagttccagataaagtagccaaccaagctgagtattctcaacgaatttgggtgcatggcgacgtcatgacgacacgaatgaaagaaaccctgaacaagggtttgagtcgccgcatgaagaaatcagacatcaataaaatgacccgcagtattcctcaaagcggtgatcgaattgatgacaatttaacaacgcctatgaaccaaatgctatccagaattcatacgttaacaactaatgaagctatacgcaatagcaacggtggtaagaatagagcgtatgatgaacagaatgttcagtatgtgatgtggttaaccgaggaagatgatcgtgtttgtgatatttgtgaaccacttgatagacaaacatttgcctatggacaagcaccgattccagtcacggatactcatccaaggtgtcgttgccagctggtagcctgtgatgaagatgggaatctgctgtctggtgaacttgatagggtatttaaggaacaaaaaaagcccacttagtttaaaactaagtgggtcaggaatattattaattggctccgctcacaacaaagtcgaggggtgctaactaagttagcatctataattagcgatgcgttcatgactatggacagtaagattaacatcttttagtacaggcttagaaaagctttttgatacatgacttaaagttaataataatgaatttggattagatgatcctgtaatcaaattttctagactaacgtttaagatccttgctaaagcaattaaattgtccaaattaggttctgtatcaccattttcccattttgatactgcctgacgagatacaaaaagtaaattagcaatatctgtttgagaaagttgctgctcagttcgtaatttgagtagctgatgagcaaaagcattgtgcatattaatctccccgttctattaaaattgcatagtttatttctactaacatttttgttttacgtcaatataatccctagataataatgtttgcgtaactagcaactaaatgttgctagcatacagacgtaaagctagcagatacttaaatcaaagtatgaggggaatatggagttgtaatgattaaccagattgataagaattaggctagggtctaatggaatattttccaaaagaagctatgaccaatattatctgtttcttcttttggtagtttagctggtaatgatttttgctgttgatgtgtggttaaatctaattgttgagcctgatcagcaagcttattagcggtagcaatttgttcatctttaatagttaattgcttctttaacagtttgattatctcagcttgttcattaactctggccgttaattgattgatgatatcgtctttagttgcatttttgtgctgttttacctcagaattaggtttaaactgataatattttttcatttcctgataaacgctgttactgtagtatttagcgttgtgatttccagttttaacaggcttaaaatgatgtttttggataaaacgagaggctgaaactactgaaatgctgaattcccttgctaaatctgaggttgtatatgttttagttttacttttatccatgttttagcctcctttagcctaattctagcatataattgttattgctatttgataggaattaagtttatacttaacaagtaagcgttatacgcctactaacagtttaataaatttagagtaaagaaaaagcccgttaaagtactccaatactttaacgagctaccgattaactaggacaagtagtaaatcggggttgtctatttctttaatacaattattgtaggggaaatagatggatatttcaagatataacactataaaactattactgaaatcaaaccctaaaatactaaaccgactagttaatcgctagtcgtttttttcttttggttcgcaaccggtaaactcaaaagcggcggcaccgcatcgtagtagcatctcgaaaacgcccgtgacctcttggatgtatagaggttgtagtcaacatcatgggaaagccaatcccgtacgctttacaaacgtcaaaagagcggctataggaagccttggaaatgcttcagataacccataacattatttagtgagtctttatgatggtttctcacagttgcgacagcttaatttgctgcctagcggacaaaaagaaccagcccgctgaacagggtataggtggaaacacaagagcagaatgttattgggacaagggcagggtgcgtttaaactatctgcattgcaattattaatgagcttagtagtgttaaattactgagttgatcaataattgcgatgagtcgactgagagaacaatgctctctcgagacttagccactgacaggctaagtctcgagagagcaagctggagcaagttctttgcggaagcttgctcttcctttaataggttaaggataagtgggtaaaacttatagttaaaactgtctttcatcgtctttgttaaggcgtttgttcattgcattggtaatttgctgagtagctttttgtctttgtttttgattagcaaatagaattgccttttgtaatttaaggatggggtcattattgagcttgttcattagctgtttttctctttggtaatcaaatggatgtttagaagcttgaattgtagatggatctagataccttgattttaggtttggtttgggttgattggggttcgttggagttgttagagttttggtgatttggtcaacgaatttgagtgcttcttcttttactttttgaagagctttagcagcaaccttaatcaggtatttgatgttttgtttgaggtgttgttgacgaccaggatcagtgttaactggttgagggcgttcattgttgtttagtaatgattgttcgacttgatgtgatggatcgttttgggcaattgaatcgacaagttggtttttgtaggagttaatgttatcttgaatggcttggttagatgttgttaattgatcattttgggtttgcaggtctttattgtcattaataagcttagtgtgtttggtttgatctgtttgccattgttgccgttgatcattgcgccattggtcgatggaggcttcaacatcgttgatattgtctgcggttattggttcattatcaccgtacattaggttattacggtcaaattcctgttgagcttccttaacgcgctgtaatttgcgttgctttaattgttcgtcagcatcgttaatttggttttgtaaagtttgtagttgttgtcgctgttgatttagtagctgttcttgttgttcttgctgctgtttggcagctttttctttttcttgagtagctaccatgtctttatctgcttgttctttattgctttgagaggccctagcagcgtgtgtaatgccatttgccatttctaagggtgttagatcatttccgtccttatcaactgcctggtggcctgtggtggcctcatagatggctttgagattcttagtaacagtttcaacctgatgtttgacattattattctgattggtaaggtcgttagtttgcttttgcagtgattggatagcttctttgtgttcagcaatttcttggtgttgagcttttagttgttccattgaaagtccggtttgaagcgatttgtcagtctcagttttacgttcaaactcaagaatttttttattttgggggactttataagttttatgcagctcggtttccaagcatttaagggcaaatttatctatgctagcccggtaccatttggtagctgctcggcctgagcaatattgacctgttaccgcatggtgtaggctgactaatgcttgattgagtgagttagtcgcatgggcaggtcgctttttaccgccacgtgtcatgccaaaggttgctatctcgtaatggatatgtgagattcccatttcatcgttgttagtagcatagcggccgcgatgtaaataatcgccaatatttactcgttttcctgatttgagattccaaccaacattgttattagtagcagtaattaaagtgcgattgaagcaatcgtaaaatcgtttagcgacagcaatgttatttttaatcggctgctcgtgttcgtcttttagcttaaaaacaagatgagtagttccatcgggaagcttttcctctacgtacgaagaagccgggcaaaactctttcatcaattgactttgaacttccatattgccaatggtcaaaactgcagtagcttttttcttcctcttgagaaagttttttacacttccgtattgtcgttcagcatgacctttttctcgttgatgttggtcgtgctgttccacgtagttatggaagtgttgctcattccaatcgtcaatagcttgacgggtggcagttgattcatcatatacgttaaattgagtttcactgaatacaatatccttgtttgaatggttaatactctggtcatgttccacgtgcttttgaataccagaataaccattagtatcttttgcctgtaagtctgttgttactgtacatttcaatgccattatttcatcaccagcgttcatagttttacattttaattgtagcacgttcagtaatgagtaaagtggataacttatccaatttactagctccctagtcaaaatggagtaatcccattttgtcggtcgctcttccgagggaattaggaacacatttcctaataaccattgatttaattttcaagattgtatttgaaaattaaatattaccttttaatcaaaaggtaataccaaaataaaaaattcccaatgtctttcgacaaagggaattttttacaatccagctttaacatttagttaatctggattgttcccattgggaaattcattatcatgtaatggattctttcccaatggttttgcgtgactttgttcctgctgctcttgttttattttagccacaaatgcagtcacaaaatcatgcaaatcttttttcgcaaatggcttttgatcatcaccaatttgcgaatcaataatgctgtttaagcgttgcattaagtcatcattattgctggccgaagttagcatagcttcggccaattccgctttccattttagttcgtttaaggctaaaacatcagcgttatgtttcatctggagcttcttatactccatatcttcaggaacagtacgaccactcagttttttggctttaagttcttgccaacgggcaattgatttaggggacatcatgataaaaacttctttctattaagtaattagattaactattatgagaagttaacagtcaatctcttgcccaaagcgttagcaattttggttaaagtatcaatactggtgttggcgccgctttcaattcgtgcaattgttgattgaggaacatcagaaacagtagctagatctcgttgagaaaggcctgattcttttctaaccttagttaatgcaatggcactctctaacttagttgtttcgttttcaaattcctttttaaattccggatcctttaattgttcatttaagtagtctttaaaattaatgttgctcataattattgctcctttcggttggcaaagtattcgtcacgtaatttcttagcatgattaatttctcgtggcggtgttttctgggttttcttagtaaagccatgggtaataacgtagtgaacgccatcaacgtgaaaataaaggccacgttgttgattattactaacccgagagcgaatttcatagaggttcttctccagtggcttaacccagttatgttgaattccagcactaagtccataagttgcgaccatgttaatccgtgctaataactttgctttagctttaacgtcaagactatctaaatattctgcaaattcagtatggccattagggcgagtataaaattcaaattctaaatcttccatgccctaatgatagcatatattgtattaattatcaatatatgctatctagaacaactaccgtgcttcgcttgctggactcgttaatcagaacggtttatgactaaacctaacctgattaacgagtgaatttttttgggggggagtgcttaatcgaacttaacttcatcgagcatttgttctcggctgacttgatccagacctaaatattttaaggtcatggcttctgaggaatgattaagcagcgacatcactaaaccgatattgtaatgagtttgtgtgtagacccggtaagccccagtttttctcattgtgtgagtaccgaggtagttaatcccaagtaaatcgccagttttagccatgattttgtaaaactgtttttcagtgatgtgccgatcggggtgtttagtcgatggaaaaagccaatctgagtggagattttgttggtttagccactgaaaatagtcttttaggtcttgtttaactggttttaggtacaaagtattgggctttccggtctttttatcccgaatataagcatttttagcgatagtcccatcgttattgaagatctcattgcgtctgagagctaataaatcggacactcggagtaacgttgccttgccaacttggaaaattgtgtaatttcggcggccagctttaaaattatgtaggagagtatcttcgacttcatgcaggatattggaatctttgatgggtaaaacgagttgtttcatgattaattgctccttatttaggggctactttttgtatatataaattaaaagcccctatattctgattgtagaatacaggggcttgacatatcaacattctataggggctatttatcacaaatagaccctattatgaactggtttcagtcaatcttttttattaatctttcaatttgataataattaattgttattacgaataagtcttacagcaataatcaaaagaaatgggattaaagttagcacaaaactaacggtaaatatacttaaatttttgatggtatctttagattgggtcatgaagtccgtcctaacttattggttttgtcacttataagtttaaggcttcatggcctttttggtctagttatttaggtgttgcacttacattgtaaatccggcgtcacaaaaaaattgactgacgagtcaataattcgttgactcgtcagtcaatcgcgactatactggaaaaggttgatcagataccgacatattaaaacgtgtttcaagtttgaccttaaggaggatgacaaaaatgacaacagctattatcgaacttgaccatcttcaaaaaaactttggcaagtttgccgcattaaaagatgtcagtttcacgttggcacccggtcaggttctgggttttctaggacctaatggggccggcaaatccacgaccattcgagttattttaggcttattaaaaaagagtggcggctcagtgaccgtcttcggcaaagatgcctggcgggatgatgcggcgattcatccacgcatcgcctatgttcctggggacgtttatttatggccaaatctttctggcggcgaaattatcgacctattgctacgtttaaatggccgccagcataatcaaaagaccgatgaactaatcaaggcctttgaatttgatccgaagaaaaaagctcgtacctattcaaaaggcaatcgtcaaaaagtagcgttaattgctgcgttttcgcaagatgccgatttgtatatttttgatgaacccacttctgggcttgatccattaaatgaacagactttccagcaagaagttttaaaactgaaaagagccggtaaaagtgtgctgctatcaagccacattttgtccgaagtcgagcgaatgtgtgattcaattgttatcatccgtgatggtagtgtgattgagagcggcaatcttgatcaattacggcatctatcgcggatcaaaattgaagtcaccaccgctaccccaatgactgctttggcaaagcaagctggcgttcacgacctcacttatcgcgattccgagcacaccaaggcggttttcaccgctgatcgagacgcgcttggcaccatcatgaccacactggccgccaacaccgtggtcgacatgcaatcaacgccgccaacgctggaagagttattcctgcgttattatggaaagcaaggtgagactcatgcggcacagtaatcggaacgcaggttatctgcttcgggcaaacctcaaacaaaatctaaaattttcactcatctggcttgtcattttgatcatgatgattgccagtggtgctggcaaattggaagcagactttgcaggcggggcctcgggctctaaagagattgtcaaaatgctgcaagcgccgggcatggcggcaatgtttggcgcgatgccaaaggtggacacgtataacacagcgattgtgtttgctggtgtgatggtcgtcttcatgattattttgcaggccttatgggttatgccgctgatgattcgcaacacccgcggtcaagaagaaagtggcttgctcgaaatggttcgcgctcgcaatgttgggcgaacggctgccatcaccgccgcttcgcttgagcttctcatcgacagtgccataatgggtatcctctattttgtctcgttggccgctgtcaacatgggtggtactgacttgtacggtgacttcctgttttcactggggatggtgatcgccaacttgctattcggagccattgcgttgctattcgcgcaactaaccaataacacacgtacagccaatatgttgagctacatggtgctgactgccgcttatttggttcggctggtcaccgatatccagcatcaaaatctgacgtggttatcaccaattggttggttcgaaaaagcaaacttctatactgataacaacgtctgggctttaggtttggccttactggtcagcattctgcttgcggccagcgccaccatgattgcccgcaaccgcgatctgggcgccgggattattgctgaacgcaccggccgagccaaagctgccggctggcttcgctcgatccctgccttactgtggcgaactgagcgcggattatttgctgggtggttaatcggcgccgtggtgtttggcggcgtcatgggtagtgtgctcggcggcgttggcgacattcttaaaacgaatccgctttatcgtaaaatactagatgttggccaaatcaacgctgccaatcagaccatggtcctgtcattcttaggcatgtatctcggcattttcgtcgcattagccgtgactgctggcgtccaagtggcattccgactcaaacgcgatgacaaccttggttacttgagcgtcattcatgccgaaaagccaacgcgaaccacgatcagtgtcagctactattgctttggtctgctggcaggcgtgttcgtcctttctgctgggctgctggccttgttcttcactgggaacactgttctcagtcacccgttgccgctcaagtacctcggtcgcctattcgtggctagcgttccggctgtgatatcgtttatcgcccttggcatcgcactagtcggtctgtggccacgcttaagcagtctattctggctgtatatgggagccggtctgatcgttcaaattttccggggattgtttgatttgccaaaacacgcaggcaacttcacaccttttggctggattgccaatgtaccggttgaaaacgttgatcaaacatggctaatcgtgatggttgttagcgctatagtattatttattcttggcattgctggttatcgccgtcaggatttgagcctatgaaaaatgttgtgacagatcctgaaaaggtcacccgaatcctcaaaacagcgacggaaattttcggccagcaaggcttcatcaagagcaaaaccgatcagattgccaaccaagcacaagtatctaagggcttgctcttccattattttggcaataaacaagcgctgtatcttgacgctttcaaatatgcctatcatcgaatttatgatcacatggaccctaaaaagtggcagaatgcccctggcttggctgccatgatgaccactgcagttaagtatgagttgaaactacaattcaaattcccagctgaataccgcttgattatgcaagcctatgctgatttaccgcattttcccgaaccgttgcgacaacaagtgcagcaagaaacaactgccatatccgctgaaatcgatcgcatttttcgcgagaaaattgaacagctgcctcgtcgtgagggcctgtcagtcgatgacgttttcggtgtcgtttctgccttaatcgcccaacaaacggcggtcaccatcagactcattgccagtggccattatcgcaagtttgaagatctgcagtccgtggttgagacgatagcacgccagttattgattgtcgaacacggctttttaccagatgaaagttgacgtcagctgatagatcaaaaaaggtcattagggtataccctagtggccgtttttatttctgtgctatactaggaattacaatcgttcattagaactgtccaaaaggagaattggaaatggctaaaatcggttatgcgcgtgtgagttccaaggagcaacatttagatcgacagttagcggctttaaaagacgttgataaattatttacggataaattaagtggggctaacactaatcggccagaactgcaaaaaatgctggcctatattcgtgagggtgatattgtaatggtcactgaattagatcgcttaggcagaaacaaccatgatttgactaagatcatgaactccattcaaaataagggtgccaccctagatgtgttaaatttgccgtccatgacagggattgctgacccaaatttacgtcaactgatgaccaacttgattattgaactctataagtatcaggccgaaagtgaacgtaagcgaatcattgagcgccagcaacaagggattgccttagctaagcagcagggtaaatatcatgggcgcaaaccccaatatgccaaagatgatccccgtttgcaacatgcttttaagctttatcgagctggcatgagtgacattgatgtgtcccgaaatacaggtattaaacggacgacctttattcgataccgtgtgaaatacggtattaaaagaaaatagggcgcccttttggttagcacatgttaactgaaagggtccctattttctttacttaaaaggtagattgatgaaatgctagctaacgctagtcctagtgataaattgtctaaacgcttgcaagcaatctttgcccaagcatctatttctcggcgtgatatgttgggtgcaatgattggcgccggtatgaatattgctacagcaaaaagtgaatcatttgcagtgaatgaactcaaacagcagtatatcgatggctataataattcaagccctaataaactatcaacagttccagataaagtagccaaccaagctgagtattctcaacgaatttgggtgcatggcgacgtcatgacgacacgaatgaaagaaaccctgaacaagggtttgagtcgccgcatgaagaaatcagacatcaataaaatgacccgcagtattcctcaaagcggtgatcgaattgatgacaatttaacaacgcctatgaaccaaatgctatccagaattcatacgttaacaactaatgaagctatacgcaatagcaacggtggtaagaatagagcgtatgatgaacagaatgttcagtatgtgatgtggttaaccgaggaagatgatcgtgtttgtgatatttgtgaaccacttgatagacaaacatttgcctatggacaagcaccgattccagtcacggatactcatccaaggtgtcgttgccagctggtagcctgtgatgaagatgggaatctgctgtctggtgaacttgatagggtatttaaggaacaaaaaaagcccacttagtttaaaactaagtgggtcaggaatattattaattggctccgctcacaacaaagtcgaggggtgctaactaagttagcatctataattagcgatgcgttcatgactatggacagtaagattaacatcttttagtacaggcttagaaaagctttttgatacatgacttaaagttaataataatgaatttggattagatgatcctgtaatcaaattttctagactaacgtttaagatccttgctaaagcaattaaattgtccaaattaggttctgtatcaccattttcccattttgatactgcctgacgagatacaaaaagtaaattagcaatatctgtttgagaaagttgctgctcagttcgtaatttgagtagctgatgagcaaaagcattgtgcatattaatctccccgttctattaaaattgcatagtttatttctactaacatttttgttttacgtcaatataatccctagataataatgtttgcgtaactagcaactaaatgttgctagcatacagacgtaaagctagcagatacttaaatcaaagtatgaggggaatatggagttgtaatgattaaccagattgataagaattaggctagggtctaatggaatattttccaaaagaagctatgaccaatattatctgtttcttcttttggtagtttagctggtaatgatttttgctgttgatgtgtggttaaatctaattgttgagcctgatcagcaagcttattagcggtagcaatttgttcatctttaatagttaattgcttctttaacagtttgattatctcagcttgttcattaactctggccgttaattgattgatgatatcgtctttagttgcatttttgtgctgttttacctcagaattaggtttaaactgataatattttttcatttcctgataaacgctgttactgtagtatttagcgttgtgatttccagttttaacaggcttaaaatgatgtttttggataaaacgagaggctgaaactactgaaatgctgaattcccttgctaaatctgaggttgtatatgttttagttttacttttatccatgttttagcctcctttagcctaattctagcatataattgttattgctatttgataggaattaagtttatacttaacaagtaagcgttatacgcctactaacagtttaataaatttagagtaaagaaaaagcccgttaaagtactccaatactttaacgagctaccgattaactaggacaagtagtaaatcggggttgtctatttctttaatacaattattgtaggggaaatagatggatatttcaagatataacactataaaactattactgaaatcaaaccctaaaatactaaaccgactagttaatcgctagtcgtttttttcttttggttcgcaaccggtaaactcaaaagcggcggcaccgcatcgtagtagcatctcgaaaacgcccgtgacctcttggatgtatagaggttgtagtcaacatcatgggaaagccaatcccgtacgctttacaaacgtcaaaagagcggctataggaagccttggaaatgcttcagataacccataacattatttagtgagtctttatgatggtttctcacagttgcgacagcttaatttgctgcctagcggacaaaaagaaccagcccgctgaacagggtataggtggaaacacaagagcagaatgttattgggacaagggcagggtgcgtttaaactatctgcattgcaattattaatgagcttagtagtgttaaattactgagttgatcaataattgcgatgagtcgactgagagaacaatgctctctcgagacttagccactgacaggctaagtctcgagagagcaagctggagcaagttctttgcggaagcttgctcttcctttaataggttaaggataagtgggtaaaacttatagttaaaactgtctttcatcgtctttgttaaggcgtttgttcattgcattggtaatttgctgagtagctttttgtctttgtttttgattagcaaatagaattgccttttgtaatttaaggatggggtcattattgagcttgttcattagctgtttttctctttggtaatcaaatggatgtttagaagcttgaattgtagatggatctagataccttgattttaggtttggtttgggttgattggggttcgttggagttgttagagttttggtgatttggtcaacgaatttgagtgcttcttcttttactttttgaagagctttagcagcaaccttaatcaggtatttgatgttttgtttgaggtgttgttgacgaccaggatcagtgttaactggttgagggcgttcattgttgtttagtaatgattgttcgacttgatgtgatggatcgttttgggcaattgaatcgacaagttggtttttgtaggagttaatgttatcttgaatggcttggttagatgttgttaattgatcattttgggtttgcaggtctttattgtcattaataagcttagtgtgtttggtttgatctgtttgccattgttgccgttgatcattgcgccattggtcgatggaggcttcaacatcgttgatattgtctgcggttattggttcattatcaccgtacattaggttattacggtcaaattcctgttgagcttccttaacgcgctgtaatttgcgttgctttaattgttcgtcagcatcgttaatttggttttgtaaagtttgtagttgttgtcgctgttgatttagtagctgttcttgttgttcttgctgctgtttggcagctttttctttttcttgagtagctaccatgtctttatctgcttgttctttattgctttgagaggccctagcagcgtgtgtaatgccatttgccatttctaagggtgttagatcatttccgtccttatcaactgcctggtggcctgtggtggcctcatagatggctttgagattcttagtaacagtttcaacctgatgtttgacattattattctgattggtaaggtcgttagtttgcttttgcagtgattggatagcttctttgtgttcagcaatttcttggtgttgagcttttagttgttccattgaaagtccggtttgaagcgatttgtcagtctcagttttacgttcaaactcaagaatttttttattttgggggactttataagttttatgcagctcggtttccaagcatttaagggcaaatttatctatgctagcccggtaccatttggtagctgctcggcctgagcaatattgacctgttaccgcatggtgtaggctgactaatgcttgattgagtgagttagtcgcatgggcaggtcgctttttaccgccacgtgtcatgccaaaggttgctatctcgtaatggatatgtgagattcccatttcatcgttgttagtagcatagcggccgcgatgtaaataatcgccaatatttactcgttttcctgatttgagattccaaccaacattgttattagtagcagtaattaaagtgcgattgaagcaatcgtaaaatcgtttagcgacagcaatgttatttttaatcggctgctcgtgttcgtcttttagcttaaaaacaagatgagtagttccatcgggaagcttttcctctacgtacgaagaagccgggcaaaactctttcatcaattgactttgaacttccatattgccaatggtcaaaactgcagtagcttttttcttcctcttgagaaagttttttacacttccgtattgtcgttcagcatgacctttttctcgttgatgttggtcgtgctgttccacgtagttatggaagtgttgctcattccaatcgtcaatagcttgacgggtggcagttgattcatcatatacgttaaattgagtttcactgaatacaatatccttgtttgaatggttaatactctggtcatgttccacgtgcttttgaataccagaataaccattagtatcttttgcctgtaagtctgttgttactgtacatttcaatgccattatttcatcaccagcgttcatagttttacattttaattgtagcacgttcagtaatgagtaaagtggataacttatccaatttactagctccctagtcaaaatggagtaatcccattttgtcggtcgctcttccgagggaattaggaacacatttcctaataaccattgatttaattttcaagattgtatttgaaaattaaatattaccttttaatcaaaaggtaataccaaaataaaaaattcccaatgtctttcgacaaagggaattttttacaatccagctttaacatttagttaatctggattgttcccattgggaaattcattatcatgtaatggattctttcccaatggttttgcgtgactttgttcctgctgctcttgttttattttagccacaaatgcagtcacaaaatcatgcaaatcttttttcgcaaatggcttttgatcatcaccaatttgcgaatcaataatgctgtttaagcgttgcattaagtcatcattattgctggccgaagttagcatagcttcggccaattccgctttccattttagttcgtttaaggctaaaacatcagcgttatgtttcatctggagcttcttatactccatatcttcaggaacagtacgaccactcagttttttggctttaagttcttgccaacgggcaattgatttaggggacatcatgataaaaacttctttctattaagtaattagattaactattatgagaagttaacagtcaatctcttgcccaaagcgttagcaattttggttaaagtatcaatactggtgttggcgccgctttcaattcgtgcaattgttgattgaggaacatcagaaacagtagctagatctcgttgagaaaggcctgattcttttctaaccttagttaatgcaatggcactcttaacttagttgtttcgttttcaattcctttttaaattccggatcctttaattgttcat

SEQ ID NO: 48 - DNA, 13813 bp, Artificial Sequence
  Based on Lactobacillus reuteri
attaagaatgatcgttactttgcggttatgtattgtcttgataaaaaagaagaaatattcgaccccacaatgtggattaaagctaatcctttgatgagtaatcctaagattgctaagacaatgagggaacacattcaaaatgatttagatgtagccacaaaacaaaataatattaataacgtacttgtaaagaatatgaatatgtttgtacagcagaatgaaaattcatatattagtacgcaagattgggaacatggattgattgaaaaagctccagatattagtaatagagatgtttatattggtgctgatctatcaaaaagccgagatttaacggcgattagttggttagttccgttagaagatggaaagttttacgctgattcccacgcctttgtatctcgttatggtggaattgttactaaatcaaaacgtgatggaattgattatgaaatggctgctaaacgtggagaatgttcaatcagttcattagaaagtggcttgattgattatgattccgtatatgatttcgtgatggacctaatcggtaagtataatctaaatgttaaattcttagtatttgacccttataaatgggctgatcttgttaatcgttttgaacgggcaggactaccacaacttcaattaacacaatcctataagaatttatcggtaccaattgggacttttaaggaagaattaattgctggtaacattcttcacactaacaatcagatgttagcttacaacgtaggaaatgcaatattgaaatataactttaatggtcaagcgttattagacaagactagaaagcaaaataaaatagattgccttgctgctcttatggatgcttgggcggctggttatgattacttcactaagagaaaggagcaagaacgtacaaatgaatactatgaaactgctaaaaatcttttctagctatattaaaccggttttgttgatcaccggaggcgttctaatggagatcagtgctataggattaaccggttggttgtttgggattggctttcttggtattgaaatgattgttctagctttcatgattaactattctgataatcacaagtaaaggagggtagataatgggcctatttagtaagagaacaacgactacaagcgcacaagacccctttctagacgctctagtaagtctttctagtaatgaccctaatagttacgttagtgcttcggctttacgtaatagtgatatatttgctgcaattagttctatcgctggtgatcttgccagtaatccgattaagtctagttctagcctatataacaagatgattaatgatcatcctaacgagttaatggacggcagaagtttcaagtacgccctagcggttgaaatgctattaaatggtaatgcgtttgccgaaattgatttaagttcacacacgctaaattttattcctaacaataaattaactgtccagcaagatgatgtaacgcaaaagctgacttacacatacagcccagatggacgtattaagcgagtaattgcctcttctaacatcttacattttaagtattttacccgtgatggtttagtcggactatcgccactgtatgcgctaaaagatgaaatgaagatacaggcggctggaaacaggttaatgactggattctttaataatggaattcatggcacaacagttgtccaagtccaccaagctgatcttagttcggatggtaaagagaacattagaaaacaatttgatgaggcaactaccggcaataattcacttaacacaattgttactgatgatggtatggacgttaaaagcctaccacttaatacagacgtgttaaagctagtaaattctaatgactggaatacccgtcaaattgcgaaagcgttcggactaccacccgagcgtttaggtgtagaaaacgagcatagcaaccaacaacaaagtaacgttcagtatttacaaggtactttacagcactatgaagattgctttacttctgaattgaactacaagctagggcaagattttagctttgataatagcaagctattaagccttgacccgtccgctcaacagcagatggcagttgatggttatgttaacggtatctacacacgcaatgaagcccgagccttacttaatttagtgccggtaactaatggagataattttattgaaaaagaaggaggagttacagccaatggagaaacgactaacaactaacgcaggtttacaaacggtaagccctaaagaagacccaacaaaagaccagcaagataaccaagatgaaacgcaagcctcacagcctaatacagttgaaggctatgcgttactctttaatcaacccagcaaggacttaggcggttttgttgaagtgattgaccctagcgcccttgataacgtagacctatccaatgtagttatgcttgatcaacacgactacactaagccactagcaagcgttaaggctggttcattacaacttgatgtggacgataaggggcttcacttcaaggcaactattgacccaagtgtaagttacgcaagtgacactcttaataatgttaagaatgggaacattaattctatgtctttccgttttgatgttgatgatggttctgacagttggacacgtgacgacaacggacaaattacacgcaccgttaatcagattaaagatttatttgaggtttcaaccgttacagtgccttcatatgatcagacaaatgttgatgtagataaaacaagcattcgtagttacaaccaatttatcgaaagtgaggaacataataaaatgcaacacacaatcttagaccccaaaaacaatacagaacaaccagctaacgcctttgaaagcttcattcgttcacgtggtgaaacccgtgacggattaacaactaagggggcagaagccgttattccagaagaagttgttactccagtcctagacttaaagaacagtgcttataacttagcaaagtacgctactgtaaagactgtagggactggttccggtcattatccaatcgctacccgttacaacacagcggtacttactactaaggaagaacaagcagaaattgctgatgtagacgctaatatgtttgaagatgtgaagtttgatgtaaagacccgtgccggtaagattgcactatcaaatgaagttgttgacgattcagaagttgatattgtatctgaagtaaagaaccaacttcaaaagttagttgataacactgataacgctgaaattatcaaggtattacaaggcgataactttactaagaaaaccgtagctaatgttgacgacttgaagcaagtattcaacgttgaccttgacccagccttacaaagtacttctacatggttagtaaatcaatcagctttccaagtattagatactttgaaagacaatgaaggacgttacttattacaaccagatgtaaccgctcctagtggattttctttacttggccaacccgttgttaagattagtaataagttcttaccagataacacagacggttcacatccaatgattttaggtgatatttcagaagcggtagcagtattccggcgtaatcaagttacagcccaatgggacaagttcgacagttacagtcaaggtttatctgttatcgtccgtaatgactaccaaccaattagtaatgacgctgcttttaatctctctttaaccacaactaaggcgaccgaaagtaaataatagctactagcacagggtgggcaatatcgcccactctttttttatgaggtgtattaatgcgaaaagaagtaaaaagtctagtaatagtaatactgaaagattatccttcaattaataagaaactaaaaagccgtaagtttgaactaatgcaccctatccgcaaaagagatgaaaatgtaggtggtggacgtgctatcaatcgaccatggacttattacgatgatatgttaataaccattgaccaagatagatatatgcaccgcttaaaacgtgagaaagaagctattgacttagcattacaagacgctggggactgtacccagaagataattaaagaatgctattttaaccctaatcataagacgataaagaacctagtagcaactggcgatatatggtgtagcactacaaaagcgtacaagttacgtgatcaatttatagtagatgttgctaaaaagttagacctagatgtgttctaaaagaaggtgaaattaatgaaatttgatgtagagcagtgggaagtagacaactttaagcaagccttatatcttgacggtgaagaagaagaccaattaatcaaggattatctaaagaacgctaaggcttatgtacaaaacgctgtaaaccccacagcagacttaacccagtatgaacaatatacgttcgctgttcagatgttggcgcaattttggtatcaaaatagaggtattgacatgtcaaataccccttaccaagtgttaagcatgattcaacaattgcgggcgcttgtatagataactagtatagattgatgcgttatatacctaaaatgtatggtataattaatagcgggaagtgagtaaaacttcccgtgaacattaagtgtttggagcaatacagccagcattacagtatttattttctttcaagccttgtaaactccttccagaatatagctatcaaagtcaccatagtagaaagctttattcaattggaaaggggatggttatatggaaataaagtataaccgttttcttgtcgcttagttaagcgataggaagtataaagtcgtgacggacaagaatacaacggcttctttgatgtgtggactgactaatgttattgtttggttggcactcaatgtccacaacatggcataccttgtagagtgtgggttaaagtctttaatggctttcttatttttaatttggtagaataaatatccatattttccttagtcgggctttaattagtccggctttttttgctctcaaacgaaatgaaaaatcactagacgggtaattgatcatcttattttgttagagaaggaattaaaccaagggtagtgtttccagaaatcgagaaaactttttttgtgatgataaataaaaaacgccacgtaaattgtgacgattggaatatgtatttaaataagtagatatgtatcttgccagccagaagatattgagaacattttgagaacaaaaagtgatatatgttgaaatgttgtgataaattaaagggctgttaaaccgctatataaagcaatttgaacaaccctttaacattctgattaattatctaaggagacaaggggacttctaataatttgaaaaattctcctataatccttgatattaaagggttttaaaaatatttaattgaaatttgagaacattttgagaacattatactaaactatcggcgaacttgtcggcgattccttgttctggttcagtatctgcattaatataaacttcaagaacagtttccattgtatcgcctaatctatctgctattaattttggctgggtaccaatagaagccaaatgtgtagcatgggtatgacgtaatccatggaatgtaactttctttagattatttctaacaattactttatttaacggcttgtccaattctgcacctaaaacaattttatttttagtgtaggtagagaaaatcaattgctctttttggtgtggattaaaacctagtttagttaaaatatctatctgttgctgtttccatctttttagataggaagcagtttttttatctattgaaatccagcgataagagttagcggttttagggccaccaagatagggatgttttgcgttcttaatagccttgttaatatggattattccaccgctttttgtaaatttaacatcttgccacgtcaaggcttgaagttcttgttttctcatgccagtaaaaagggctaaccatagaaccatgaaagcacgaggatttttttcttcgtagtctttttttatacacttgataaaattgtgaagttgcttttcattaaagaaattattgttagtaaatgttttgtcatgttttttacgaggctttactacagaattcattggattagttgggatcgctcttaattgtactgcgtagtctaacattcgcttagtatagttaaaagggtcactctttactaattcttctttccatttagcagcaacttcagttaataactcaatgctaagatcagcaactttatagtttccaatgcggggtagaatatgatttttaatgatttgttttgttttatgaatagtagaattttctatcccagtctgttcatatactggcaaccatttttttgatagctcttcaacggtcatgttatggttattcatttgaccatattttttaagctccacagctttttcttgttcccacgctacagcgtccgattttaatttgaaacctcgcttactggttgatttaccattaatgcggtatttaacataccacgtaccatttcttttatccttgtatactgacatttttactttcctcctacaatcgcacagctggctggcaagagattgtagagaaaggtttaaaattatttttttaaaattttaaaatatccgttatcatttaaaaactgtgtaagtttttctttgaagggtggtaaatccttgcggaaagcaggatagcgatttgcctcttcgtcaataattaggcttaaatacgtatttgcaagtaattcaaattgttcattaatttgtttaaaatttatttcattggtaattggtacgccggtaagtaatccatctaatgtattccaaacaaattttttaagttgttcatgttctttgtcattgctagattcatctgggtacacaagataaccataattatcaagcaaaacagcagctaataaatgtctttttatgtcgtcacgccctaacccacgttcaataatacttctatcattttcaatatgagcagctttctttttgagagatacggaatcgagcgttgctaaatcatgaaaggtaatattgttgggaattccatagactagaaaatctagaggaacatctaatatttgaggtaaactgtgaaaaatcgaagcaggtataatccgctggccacgttcataattccccaaggctggttgtgatattccaatttttcttgctaagtctttttgagtcatctttttagctttacgaattagtgcaatgttagaacctattttctggtcagatgaaatttctttcacattaattcctccttgtatagttaatatattatacataaccgaaaataacaatacaaaacacaatatattttattttgttgttgcataatatttcattatgttatatattgtaattacgatatgaaataaagaggtgataataatgagtacagctattttagatcagttcattgatcagttagctgaagctgtggctaaaaagctagagaacaataagttacaagatgctaagactgttaaaaccgaaccagagtttatgaataagggccaaactgcggattatctaagtgtttctcgaacaactattgatcgttggattaagacccgaaattttccatcatcaaaggttggaggaaaatatgtatataaacgtgaagatgttgaccgttgggtaaaagaaaattctaagtaataatcgcacagctggctggcaagtgattgtagagaaataaataggaggaggtgagacatatgttacaaaaaattgatggtaagattttagcttactggtggacttcaccagaccaacgcctttgggcttatctagcaacgtttttaccattgctgggtattgttgttgcaattagtaacttattttaaggagtaataagaaatgagtttatacactaaaaaatttgaataagaaatattaagtaaaagaattattgatatagaagacaggattgttaaagctggcagttatataaattcaattactgaagattgttttgaaggtactatcactaaagaaaatggagaaataattgcagatgatccgatttcctcagcagatgaaattattaaggtcgctaaagaaattaaagatttagcaattcaatataaaactttaactgattttgaaaacgactttatggatggtaataaaaaagccgttgatagtgagaacgccaattcagacactaacaacgactaaataaaacttagagaattaaatttagctaataaaaaagccaacaatctttacgggggatgttggacgaattactaatatttaattctctttcattctaacatgagtggagggtttaaacaatggaaaaagataagaaccaagaactagcgtttgaaaatcagttgtgggaagcagattccaatgttgaagaaacaaccggaatagcccaagcactgtatgatcagttaaatgatgtttttgctccaattgtacgagtagacaattatgcagcaatgagtgatgaacaagtgtctacggttgctcaaacagtagtatcacgtaagaaagcattgttagcactatctagtattttgttggataagttagatcaaattcatgatcaattgcaataggtgggacgtgattaatagtgttaagttttgaagaaaaactatccgttaatcctttattagatagtgacaagatggaaaaaattattaattcaacgtcacatccccttaatgagtacgcaaagaaacagtttcagaaagcacttgaatactataacgatgattacaaggttatagaacgagctgttagtagtaaaagtagtagaaaatttattgctctttataaaaataatgaggaaataatttcctactacctaaataaatatcatagcgttaaacctgctattggtgcaatgtgtttttatcttctctactacacaggggatgacgttaaacaagttaaccgaatactgcaccgtacaccactctttaagtattggaataatgctagtcaaaacgaagatcaatcaatagtcgattgggacaatatatacgaagaaacaagtttagacgggaaaagctttgaatatatcaaaacaaaaggcgaagtagagattatcagtcttaaatacaaacgctaaattaccatgtaaagagaggaaaaatatggctaatattgatgacttagtaaataacaatagttttccagaatggttaactgtaagtgataaaggaaataaactggttgatgaaattaagttggctaaatatttagaaaaaaagtatcactttacatccaaccaatttatagaacacggctattggttcgatcctaaaagtagacaatggaaaaattacgctgattcagtcattgaaaaatcaatcaaaaatgaaattgtacctcatggaatatggagaacgaacttattagcatcggtttctaaattaattgccttagattcacaagaaattgtagaagacaatccatttgatcaaccagcaccttataaagcagtgtttggtaaacacacttacaacttgatgacggacactttagaagataattcaccagagaactatcttttacaaaatagaccatatgaattagaaacaaaaggaaaagctacaacgtggaataaatggttaaaacaatcattagtaccctcaactaaagaaatccgtgatgatactggaaaactacaagatgaatatgacctaacagcaattgaaacagtaaaagcctttattggttttgctttagcaggtagttttaaggactttcaaatttatatgattctatacgggttgggtggggatggtaaatctacatttctaaataaactaatggagttaatagggaagcctaacgtttcaaacgtttctttagaagcattatccgaccaaaaagaagctaaatttgctacttctcagctgtatcataaagctgctaatgtttttgctgatataagccccaaatttatggaacagactaatattattaaaacattaactggtgacgacactacaacagctcaatttaaatataaagatccatttaaacttgaaaatgaagctaaattgatttttagcgctaatgatttaccagccttcaatgattttacagacggatttaaaagacgaccaattattgtaacgttccataagattaaacattttaaagagcaattcaaagagcaagactttaaaagagaaatgccagcatttgcctatgaatgcttaaaatcttataaaaaagcacttgattctggtaagtttccagtgactgaatacatggaacagcaaaagcgaagctgggtaaatgctaatgacaatatcggtaattggattaatgattgctgtactacaaatgagaaagataaagaaaaatcagtatatctatatgataattacaaagagtattgtaaaaatactgctgttccttgtcttagtaatcgtaagtttgcgaaagagctaatagcacgaggatacaaacacactacagttaagattaacggtaaaaatgttaaaggttataaaggaattgctcttaaaaattagttatagttttatatttatcggttacctttgcagaagttcttataaagcttgatataaagctatttaaaggtaaccgaaagcattttgaggtaaccgatagtttcgggttactatattaagtaactgcaatgtatcggttacctttatatcctatcggttaccatataaatgttgatataaaggcgattgtgggtacttgaaacggggtaaccgataaaagtaaaaactattttcaattgaagagatgaaaattaacaattaaaactgcttttaccgtacttttattttgaggcagtgaccacataccaccggataggtgaaaagcctattaaggagttaaaaataaagtaacagtagatttcactagaacggctgcaaacgttctactattgcttgtatctgcaagtacaggcagaaaggaataattaaatgcgaagtaataaatacgcaattacacgattaaagcataaggtcacattcggtcatgaaggtggtacggggaaacgtaacccgaatactggtatgatcatgacaggttttgtaggagatgtgacagtacattgtggtaactattcaatcagtgctagtcaagctattagtgaggcaggtagttcaattactgatgatgttatattggtagttcgtcacaagaaagatttaacggacatgaagaaatatccagaagcacaatacaatggcagtatctataaagttgctggttggtcaattgatgatgagttattggcgtatgatattgtaaccttacgcaagcttgatagtcataaataagaggtgaaatggggatgagtaaattaacagtcaacacgcacccagagtataacaactttattaatgtaatgattgaggcaagcggtgatgatccttctaattatcatatgtatactacgctttatagtttaaaattagtctcagtaaatggcagtccattaccattagcgattgatctaggactaccagacaaccaagagctagtaaagtgtattgcacaagtggcagtatgcaaggacgcagaggaaagtcgccaagactgggtgatgatggcaaggtatagactaagcgagtgtgacccttacagcgccgatacaatggagcttgaagcttgcattaagagaacggttaacgatgttaaaagctggcacataagcaggcttgaagcatatagtaaggcaatggaattaattaataagtaagtgctaagggtgtcgtgttatgcgatgcccttttttcataggaggttatcaaatgagtgtagtaaggttttgtagtgctgctggttgtcgagaggtgattccagtaggtcaatatttttgtaaaaaacatcaatatctacaaaaagaatatgaagacaagcgtaaacattggcaacgagataactataaaaagatgaccaaagaacagaaacatgaatacaatagaaaagtatacaaaaagcgaatggaaagaagcgccaaagctcctcatgactataatagattctacaaaacgagtaagtgggttaaattaagccgtcaaacgctccagaaaagcccagtttgtgttatgtgtttacgaaagggaatagtaaaaaaaagctgatttagttgaccacattgtacctatacgtgaagattggagtaaaagattggattcaactaatctacaatcactttgctatcgttgtcaccgagaaaagacaagaaaagatcatcaacgagaaaggaaaataaatatgaatagctgaaataattttaatacccccgctattggtatagaccggtaggagccgtaatggtggggtttcttttaaaaaaattctcctttacaaaaaaacgccttaaaatccgaagatttcaagacgtttctttttattttgtatggttttcttttcaactttattaaataatttagagcctcaaatgtcaaggattttttattataacttttaggcattgaacttaacaaactattcaaatatggtataataagggttaaataatacgataattgaatatgaaatgatgtttttttatttttttaaacaaatagtgacatggtgtcaccaaataaatagaaggaggttaaatagttggctcaaccaatgaagacccgtccagaaggtcatattactaaggcagaaaaagcacaacgtgaagacgctgaaaaagcattggcagaatacccaaacttaacatctcacgcccctaaatggcttgatgatgtagcaaaaaaggaatggcgtagaattgtcccactcttaaagaagagtgcccctattagcgaactagatgttagtttaatcgctactcactgtactttgtattcaacaattatcaaatgtactaaagagattgatcgtactggggtagttattgatacaaaacgaggattacagcagtcaccttactacatggcacgtgataaggctattaaagaaatgaagtcaattgatagtcaaatggcacttagcccacaatcacgggtacgcctagaagtccacaaggcaatgagtgaagaagctcctactgatgagtttgaagagatgttgtcataatggatagagctattcagtatgctaattcagttgttaaaggtgagttaatcgccggtaagttagttattcatgcttgccagcgcttcttagacgacatgaaaaagcaaaagaccgatgactttccttattattattctgaaacgtatgctggtaaggttattaaatttgttgagagcttaccacaaacaaacggtgaaccattgaagctagagccatttgaagtgtttatcttatctaatatctatggttggcgacaggtagacgataattcattgcgcttcaatcggattctattaagtgaagcccgtaaaaatggaaagagcttcttactggcagcgattggcgttgtgtctcttcttatggaaaagcaaccagcccgtaatcgacaaatactatttactgctaacattcccagcagcacaccttgcgtttgatattatgagtgaccaactagaaaacttacggcgtaattcaaagtatttaaggcaacgagtgaaaatcaataaacaacgggtgactgacaaaaagacaggtagcttcgcaattccactatctactgatacccacagtacggacggttataacccgacactgggcgtagtcgatgaatatcaccaagctaaagataacactattctaaacgccttgaattcaggtatggctcaacaagacaatggtattctagcgattatttctactgctggtttaatcttaattcacccttcaaaaatgaatgggactatgcagccgatatactcaacggcaaa

(The sequence listing continues in the following parts.)

---

The invention claimed is:

1. A method of stimulating an immune response or increasing antibody titer to an infectious respiratory disease vaccine in a subject, said method comprising: administering an effective amount of an immunogenic probiotic composition comprising a combination of two Lactobacillus reuteri strains, wherein the first Lactobacillus reuteri strain comprises the genomic nucleic acid sequence SEQ ID NO: 49 or a sequence having at least 98% sequence identity with SEQ ID NO: 49, and wherein the second Lactobacillus reuteri strain comprises the genomic nucleic acid sequence SEQ ID NO: 44 or a sequence having at least 98% sequence identity with SEQ ID NO: 44, and an infectious respiratory disease vaccine to the subject.

2. The method according to claim 1, wherein the first *Lactobacillus reuteri* strain comprises SEQ ID NO: 49 and the second *Lactobacillus reuteri* strain comprises SEQ ID NO: 44.

3. The method according to claim 1, wherein the ratio of the two strains is approximately 0.75-1.5:1.

4. The method according to claim 1, wherein the first *Lactobacillus reuteri* strain is *Lactobacillus reuteri* 3632 deposited with ATCC under patent deposit number PTA-126788 and the second *Lactobacillus reuteri* strain is *Lactobacillus reuteri*3630 deposited with ATCC under patent deposit number PTA-126787.

5. The method according to claim 1, wherein said composition does not comprise *Lactobacillus buchneri, Lactobacillus plantarum, Lactobacillus gasseri, Lactobacillus*

*johnsonii, Lactobacillus acidophilus, Lactobacillus rhamnosus, Lactobacillus paracasei*, or *Lactobacillus animalis.*

6. The method according to claim 1, wherein the immunogenic probiotic composition is formulated as animal feed, feed additive, food ingredient, water additive, water-mixed additive, consumable solution, consumable spray additive, consumable solid, consumable gel, injection, or combinations thereof.

7. The method according to claim 1, wherein the infectious respiratory disease vaccine is a viral vaccine.

8. The method according to claim 7, wherein the infectious respiratory disease vaccine is a coronavirus vaccine, an influenza virus vaccine, an adenovirus vaccine, a parainfluenza virus vaccine, a herpesvirus vaccine, a cytomegalovirus vaccine, a respiratory syncytial virus vaccine, or a pneumovirus vaccine.

9. The method according to claim 8, wherein the infectious respiratory disease vaccine is a coronavirus vaccine or is a Porcine Reproductive and Respiratory Syndrome (PRRS) vaccine.

10. The method according to claim 9, wherein the coronavirus is a human coronavirus selected from SARS COV-2, SARS COV, MERS COV, 229E, NL63, OC43, and HKU1.

11. The method according to claim 9, wherein the coronavirus is a non-human coronavirus selected from infectious bronchitis virus (IBV), canine coronavirus, and feline coronavirus.

12. The method according to claim 1, wherein the immunogenic probiotic composition is administered orally and the vaccine is administered by inhalation route or by parenteral route.

13. The method according to claim 1, wherein the immune response or the antibody titer is increased by at least 5%, as compared to a subject not administered the immunogenic probiotic composition.

14. A method of vaccinating a subject for an infectious respiratory disease or decreasing viral load of an infectious respiratory disease virus in a subject, said method comprising administering an effective amount of an immunogenic probiotic composition comprising a combination of two Lactobacillus reuteri strains wherein the first Lactobacillus reuteri strain comprises the genomic nucleic acid sequence SEQ ID NO: 49 or a sequence having at least 98%, sequence identity with SEQ ID NO: 49, and wherein the second Lactobacillus reuteri strain comprises the genomic nucleic acid sequence SEQ ID NO: 44 or a sequence having at least 98% sequence identity with SEQ ID NO: 44,and an infectious respiratory disease vaccine to a subject.

15. The method according to claim 14, wherein the first *Lactobacillus reuteri* strain comprises nucleic acid sequence SEQ ID NO:49, and the second *Lactobacillus reuteri* strain comprises SEQ ID NO:44.

16. The method according to claim 14, wherein the first *Lactobacillus reuteri* strain is *Lactobacillus reuteri* strain 3632 deposited with ATCC under patent deposit number PTA-126788, and the second Lactobacillus reuteri strain is *Lactobacillus reuteri* strain 3630 deposited with ATCC under patent deposit number PTA-126787.

17. The method according to claim 14, wherein the ratio of the two strains is approximately 0.75-1.5:1.

18. The method according to claim 14, wherein the infectious respiratory disease is a coronavirus associated disease, an influenza virus associated disease, an adenovirus associated disease, a parainfluenza virus associated disease, a herpesvirus associated disease, a cytomegalovirus associated disease, a respiratory syncytial virus associated disease, or a pneumovirus associated disease.

19. The method according to claim 14, wherein the disease is a feline coronavirus or canine coronavirus associated disease.

20. The method according to claim 14, wherein said infectious respiratory disease is selected from PRRS and IBV.

21. The method according to claim 1, wherein the subject is poultry, and the immunogenic probiotic composition is administered to the subject by oral administration and the infectious respiratory disease vaccine is administered by spray/inhalation.

22. The method according to claim 21, wherein the subject is poultry and is at least 1 day old.

23. The method according to claim 14, wherein the subject is poultry and the infectious respiratory disease vaccine is an IBV vaccine.

24. The method according to claim 1, wherein the first *Lactobacillus reuteri* strain comprises a nucleic acid sequence having at least 99% identity to SEQ ID NO: 49, and the second *lactobacillus reuteri* strain comprises a nucleic acid sequence having at least 99% identity to SEQ ID NO: 44.

25. An immunogenic probiotic composition, said composition comprising a combination of two *Lactobacillus reuteri* strains, wherein the first *Lactobacillus reuteri* strain comprises the genomic nucleic acid sequence SEQ ID NO: 49 or a sequence having at least 98%, sequence identity with SEQ ID NO: 49, and wherein the second *Lactobacillus reuteri* strain comprises the genomic nucleic acid sequence SEQ ID NO: 44 or a sequence having at least 98% sequence identity with SEQ ID NO: 44, a pharmaceutically acceptable carrier, and an infectious respiratory disease vaccine.

26. The composition according to claim 25, wherein the first *Lactobacillus reuteri* strain comprises SEQ ID NO: 49 and the second *Lactobacillus reuteri* strain comprises SEQ ID NO: 44.

27. The composition according to claim 25, wherein the ratio of the two strains is approximately 0.75-1.5:1.

28. The composition according to claim 25, wherein the first *Lactobacillus reuteri* strain is *Lactobacillus reuteri* strain 3632 deposited with ATCC under patent deposit number PTA-126788, and the second *Lactobacillus reuteri* strain is Lactobacillus reuteri strain 3630 deposited with ATCC under patent deposit number PTA-126787.

29. The method according to claim 13, wherein the immune response or the antibody titer is increased by at least 10%.

30. The method according to claim 14, wherein the first *Lactobacillus reuteri* strain comprises a genomic nucleic acid sequence having at least 99% sequence identity with SEQ ID NO: 49, and the second *Lactobacillus reuteri* strain comprises a genomic nucleic acid sequence having at least 99% sequence identity with SEQ ID NO: 44.

31. The immunogenic probiotic composition according to claim 25, wherein the first *Lactobacillus reuteri* strain comprises a genomic nucleic acid sequence having at least 99% sequence identity with SEQ ID NO: 49, and the second *Lactobacillus reuteri* strain comprises a genomic nucleic acid sequence having at least 99% sequence identity with SEQ ID NO: 44.

* * * * *